US006972197B1

(12) United States Patent
Preuss et al.

(10) Patent No.: US 6,972,197 B1
(45) Date of Patent: Dec. 6, 2005

(54) PLANT CHROMOSOME COMPOSITIONS AND METHODS

(75) Inventors: Daphne Preuss, Chicago, IL (US); Gregory Copenhaver, Oak Park, IL (US); Kevin C. Keith, Chicago, IL (US)

(73) Assignee: The University of Chicago, Chicago, IL (US)

( * ) Notice: Subject to any disclaimer, the term of this patent is extended or adjusted under 35 U.S.C. 154(b) by 0 days.

(21) Appl. No.: 09/531,120

(22) Filed: Mar. 17, 2000

Related U.S. Application Data

(60) Provisional application No. 60/172,493, filed on Dec. 16, 1999, provisional application No. 60/154,603, filed on Sep. 17, 1999, provisional application No. 60/153,584, filed on Sep. 13, 1999, provisional application No. 60/134,770, filed on May 18, 1999, provisional application No. 60/127,409, filed on Apr. 1, 1999, and provisional application No. 60/125,219, filed on Mar. 18, 1999.

(51) Int. Cl.[7] .................... C12N 15/82; C12N 15/87; C07H 21/02; A01H 1/00; A01H 11/00

(52) U.S. Cl. ..................... 435/468; 435/469; 435/470; 536/23.1; 800/278; 800/292; 800/293; 800/295; 800/298

(58) Field of Search ................ 435/468, 469, 435/470, 6, 91.2, 320.1, 240.4, 252.33, 240.1, 254.2; 536/23.1, 23.4, 27; 800/278, 292, 293, 295, 298; 530/350

(56) References Cited

U.S. PATENT DOCUMENTS

| 4,889,806 | A |   | 12/1989 | Olson et al. ............. | 435/172.3 |
| 5,270,201 | A |   | 12/1993 | Richards et al. ......... | 435/240.4 |
| 5,288,625 | A |   | 2/1994  | Hadlaczky ............... | 435/172.2 |
| 5,695,967 | A |   | 12/1997 | Van Bokkelen et al. ... | 435/91.1 |
| 5,712,134 | A |   | 1/1998  | Hadlaczky ............... | 435/172.2 |
| 5,721,118 | A |   | 2/1998  | Scheffler ................. | 435/69.1 |
| 5,773,705 | A |   | 6/1998  | Vierstra et al. ........... | 800/250 |
| 5,869,294 | A |   | 2/1999  | Harrington et al. ...... | 435/91.1 |
| 5,891,691 | A |   | 4/1999  | Hadlaczky ............... | 435/172.3 |
| 6,156,953 | A | * | 12/2000 | Preuss et al. .............. | 800/278 |
| 6,307,123 | B1| * | 10/2001 | Kriz ......................... | 800/282 |

FOREIGN PATENT DOCUMENTS

| EP |       1033405 | 9/2000  |
| WO | WO 89/09219   | 10/1989 |
| WO |       97/40183 | 10/1997 |
| WO | WO 98/55637   | 12/1998 |
| WO |       99/06581 | 2/1999  |

OTHER PUBLICATIONS

Ebinuma et al., "Selection of marker-free transgenic plants using the isopentenyl transferase gene", Proc. Natl. Acad. Sci. USA, (1997), vol. 94, pp. 2117–2121.*

Newman et al., "Genes galore: a summary of methods for accessing results from large-scale partial sequencing of anonymous arabidopsis cDNA clones," Plant Physiology, 106:1241–1255, 1994.

Norris et al., "The intron of Arabidopsis thaliana polyubiquitin genes is conserved in location and is a quantitative determinant of chimeric gene expression," Plant Mol. Biol., 21:895–906, 1993.

Sun and Callis, "Independent modulation of Arabidopsis thaliana polyubiquitin mRNAs in different organs and in response to environmental changes," Plant. J., 11(5):1017–1027, 1997.

Sun et al., "A model for the evolution of polyubiquitin genes from the study of Arabidopsis thaliana ecotypes,", Plant Mol. Biol., 34:745–758, 1997.

Tsugeki et al., "A transposon insertion in the Arabidopsis SSR16 gene causes an embryo–defective lethal mutation,", Plant J., 10(3):479–489, 1996.

EMBL database accession No. AC006586.
EMBL database accession No. AC006161.
EMBL database accession No. AF074021.
EMBL database accession No. AF072897.
EMBL database accession No. B97084.
EMBL database accession No. AC012392.
EMBL database accession No. AF162444.

Mayer et al., "Sequence and analysis of chromosome 4 of the plant Arabidopsis thaliana," Nature, 402:769–777, 1999.

Richards et al., "The centromere of Arabidopsis thaliana chromosome 1 contains telomere–similar sequences," Nuc. Acid. Res., 19:3351–3358, 1991.

EMBL nucleotide and protein databases, "Arabidopsis thaliana chromosome II section 41 of 255 of the comnplete sequence. Sequence from clones T25N22, T13E11," No: XP002159529, 1998.

EMBL nucleotide and protein databases, "Arabidopsis thaliana BAC T27D20," No: XP002159530, 1998.

Abel et al., "Delay of disease development in transgenic plants that express the tobacco mosaic virus coat protein gene," Science 232:738–743, 1986.

Alfenito et al., "Molecular characterization of a maize B chromosome centric sequence," Genetics, 135:589–597, 1993.

(Continued)

Primary Examiner—Jeffrey Fredman
Assistant Examiner—Teresa Strzelecka
(74) Attorney, Agent, or Firm—Marshall, Gerstein & Borun LLP

(57) ABSTRACT

The present invention provides for the identification and cloning of functional plant centromeres in Arabidopsis. This will permit construction of stably inherited minichromosomes which can serve as vectors for the construction of transgenic plant and animal cells. In addition, information on the structure and function of these regions will prove valuable in isolating additional centromeric and centromere related genetic elements and polypeptides from other species.

5 Claims, 183 Drawing Sheets-

OTHER PUBLICATIONS

Allshire, "Centromeres, checkpoints and chromatid cohesion," *Curr. Opin.Genetics and Devel.*, 7:264–273, 1997.

Alonso–Blanco et al., "Development of an AFLP based linkage map of Ler, Col, Cvi *Arabidopsis thaliana* ecotypes and construction of a Ler/Cvi recombinant inbred line population," *Plant J.*, 14(2):259–271, 1998.

Baum et al., "The centromeric K–type repeat and the central core are together sufficient to establish a functional *Schizosaccharomyces pombe* centromere," *Mol. Bio. Cell.*, 5:747–761, 1994.

Bell and Ecker, "Assignment of 30 microsatellite loci to the linkage map of *Arabidopsis,*" *Genomics*, 19:137–14, 1994.

Bevan et al., "Structure and transcription of the nopaline synthase gene region of T–DNA," *Nucleic Acids Research*, 11:369–385, 1983.

Bevan et al., "Clearing a path through the jungle: progress in *Arabidopsis* genomics," *BioEssays* 21:110–120, 1999.

Birchler, "Do these sequences make CENs yet?," *Genome Res.*, 7:1035–1037, 1997.

Bloom, "The centromere frontier: Kinetochore components, microtubule–based motility, and the CEN–value paradox," *Cell*, 73:621–624, 1993.

Brandes et al., "Multiple repetitive DNA sequences in the paracentromeric regions of *Arabidopsis thaliana* L., " *Chrom. Res.*, 5:238–246, 1997.

Burke et al., "Cloning of large segments of exogenous DNA into yeast by means of artificial chromosome vectors," *Science*, 236:806–812, 1987.

Cambareri et al., "Structure of the chromosome VII centromere region in *Neurospora crassa*: degenerate transposons and simple repeats," *Mol. Cell. Biol.*, 18:5465, 1998.

Capecchi, "High efficiency transformation by direct microinjection of DNA into cultured mammalian cells," *Cell* 22(2):479–488, 1980.

Carbon and Clarke, "Structural and functional analysis of yeast centromere (cen3)," *J. Cell Sci. Supp.*, 1:43–58, 1984.

Carbon and Clarke., "Centromere structure and function in budding and fission yeast," *New Biologist*, 2:10–19, 1990.

Chang et al., "Restriction fragment length polymorphism linkage map for *Arabidopsis thaliana,*" *Proc. Natl. Acad. Sci., USA*, 85:6856–6860, 1988.

Choo, "Turning on the centromere," *Nature Gene.*, 18:3–4, 1998.

Christou et al., "Stable transformation of soybean callus by DNA–coated gold particles," *Plant Physiol.*, 87:671–674, 1988.

Chu et al., "Separation of large DNA molecules by contour–clamped homogeneous electric fields," *Scienc*, 234:1582–1585, 1986.

Chye et al., "Characterization of TSCL, a nonviral retroposon from *Arabidopsis thaliana,*" *Plant Mol. Biol.*, 35:893–904, 1997.

Clarke and Carbon, "Isolation of a yeast centromere and construction of functional small circular chromosomes," *Nature*, 287:504–509, 1980.

Clarke et al., "Analysis of centromeric DNA in the fission yeast *Schizosaccharomyces pombe,*" *Proc. Natl. Acad. Sci. USA*, 83:8253–8257, 1986.

Clarke, "Centromeres: proteins, protein complexes, and repeated domains at centromeres of simple eukaryotes," *Genetics and Development*, 8:212–218, 1998.

Copenhaver and Pikaard, "RFLP and physical mapping with an rDNA–specific endonuclease reveals that nucleolus organizer regions of *Arabidopsis thaliana* adjoin the telomeres on chromosomes 2 and 4," *Plant J.*, 9:259–272, 1996.

Copenhaver et al., "Assaying genome–wide recombination and centromere fuctions with *Arabidopsis tetrads,*" *Proc. Natl. Acad. Sci.* 95:247–252, 1998.

Copenhaver et al., "Genetic Definition and sequence analysis of *Arabidopsis* centromeres," *Science.* 286:2468–2474, 1999.

Depicker et al., "A negative selection scheme for tobacco protoplast–derived cells expressing the T–DNA gene 2," *Plant Cell Reports*, 7:63–66, 1988.

du Sart et al., "A functional neo–centromere formed through activation of a latent human centromere and consisting of non–alpha–satellite DNA," *Nature Gene.*, 16:144–153, 1997.

Earnshaw et al., "Proteins of the inner and outer centromere of mitotic chromosomes," *Genome*, 31:541–552, 1989.

Earnshaw, "When is a centromere not a kinetochore?," *J. Cell Sci.*, 99:1–4, 1991.

Franz et al., "Cytogenetics for the model system *Arabidopsis thaliana,*" *Plant J.*, 13:867–876, 1998.

Frary et al., "Molecular mapping of the centromeres of tomato chromosomes 7 and 9," *Mol. Gen. Genet.*, 250:295–304, 1996.

Fromm et al., "Expression of genes transfered into monocot and dicot plant cells by electroporation," *Proc. Natl. Acad. Sci. USA* 82:5824–5828, 1985.

Grill and Somerville, "Construction and characterization of a yeast artificial chromosome library of *Arabidopsis* which is suitable for chromosome walking," *Mol. Gen. Genet.*, 226:484–490, 1991.

Hadlaczky et al., "Centromere formation in mouse cells cotransformed with human DNA and a dominant marker gene," *Proc. Natl Acad. Sci. USA*, 88:8106–8110, 1991.

Harrington et al., "Formation of *de novo* centromeres and construction of first–generation human artificial microchromosomes," *Nature Genetics*, 15:345–355, 1997.

Hegemann et al., "The centromere of budding yeast," *Bioassays*, 15:451–460, 1993.

Heller et al., "Mini–chromosomes derived from the human Y chromosome by telomere directed chromosome breakage," *Proc. Natl. Acad. Sci. USA*, 93:7125–7130, 1996.

Hauge et al., "Mapping the *Arabidopsis* genome," *Symp Soc Exp Biol*, 45:45–56, 1991.

Heslop–Harrison et al. "Polymorphisms and genomic organization of repetitive dna from centromeric regions of *Arabidopsis* chromosomes," *Plant Cell*, 11:31–42, 1999.

Hwang et al., Identification and map position of YAC clones comprising one–third of the *Arabidopsis* genome, *The Plant Journal*, 1:367–374, 1991.

Ikeno et al., "Construction of YAC–based mammalian artificial chromosomes," *Nature Biotech.*, 16:431–439, 1998.

Kaszas and Birchler, "Misdivision analysis of centromere structure in maize," *J. EMBO*, 15:5246–5255, 1996.

Klein et al., "High–velocity microprojectiles for delivering nucleic acids into living cells," *Nature*, 327:70–73, 1987.

Klein et al., "Stable genetic transformation of intact Nicotiana cells by the particle bombardment process," *Proc. Nat'l Acad. Sci. USA*, 85:8502–8505, 1988.

Konieczny et al., "A procedure for mapping *Arabidopsis* mutations using codominant ecotype–specific PCR–based markers," *The Plant Journal*, 4:403–410, 1993.

Konieczny et al., "A superfamily of *Arabidopsis thaliana* retrotransposons," *Genetics*, 127:801–809, 1991.

Koorneef, "Linkage map of *Arabidopsis thaliana*," *J. Heredity*, 74:265–272, 1983.

Koorneef, "The use of telotrisomics for centromere mapping in *Arabidopsis thaliana* (L.) Heynh," *Genetica*, 62:33–40, 1983.

Koorneef et al., "Trisomics in *Arabidopsis thaliana* and the location of linkage groups," *Genetica*, 61:41–46, 1983.

Lin et al., "Sequence and Analysis of Chromosome 2 of *Arabidopsis thaliana*,"*Nature*, 402:761–768, 1999.

Lorz et al., "Gene transfer to cereal cells mediated by protoplast transformation," *Mol. Gen. Genet.*, 199:178–182, 1985.

Maluszynaska and Heslop–Harrison, "Molecular cytogenetics of the genus *Arabidopsis*: In situ localization of rDNA sites, chromosome numbers and diversity in centromeric heterochromatin," *Annals Botany*, 71:479–484, 1993.

Maluszynska and Heslop–Harrison, "Localization of tandemly repeated DNA sequences in *Arabidopsis thaliana*," *Plant Jour.*, 1:159–166, 1991.

Marra et al., "zA map for sequence analysis of the *Arabidopsis thaliana* genome," *Nature Genet.* 22:265–270, 1999.

Martinez–Zapater et al., "A highly repeated DNA sequence in *Arabidopsis thaliana*," *Mol. Gen. Genet.*, 204:417–423, 1986.

Mozo et al., "Construction and characterization of the IGF *Arabidopsis thaliana* BAC library," *Mol Gen Genet*, 258:562–570, 1998.

Mozo et al., "A complete BAC–based physical map of the *Arabidopsis thaliana* genome," *Nature Genet.* 22:271–275, 1999.

Murata et al., "Physical mapping of the 5S ribosomal RNA genes in *Arabidopsis thaliana* by multi–color flourescence in situ hybridization with cosmid clones," *Plant J.*, 12:31–37, 1997.

Murphy and Karpen, "Localization of centromere function in a *Drosophila* minichromosome," *Cell*, 82:599–609, 1995.

Murray and Szostak,"Construction of artificial chromosomes in yeast," *Nature*, 305:189–193, 1983.

Napolini et al., "Introduction of a chimeric chalcone synthase gene into petunia results in reversible co–supression of homologous genes in trans," *Plant Cell*, 2:279–289, 1990.

Pelissier et al., "Dna regions flanking the major *Arabidopsis thaliana* satellite are principally enriched in athila retroelement sequences," *Genetica*, 97:141–151, 1996.

Pelissier et al., *Plant Mol. Biol.*,"Athila, a new retroelememt from *Arabidopsis thaliana*," 29:441–452, 1995.

Potrykus et al., "Direct genc transfer to cells of a graminaceous monocot," *Mol. Gen. Genet.*, 199:183–188, 1985.

Perkins, "The detection of linkage in tetrad analysis," *Genetics*, 38, 187–197, 1953.

Preuss et al., "Tetrad analysis possible in *Arabidopsis* with mutation of the QUARTET (QRT) genes," *Science*, 264:1458–1460, 1994.

Rattner, "The structure of the mammalian centromere," *Bioassays*, 13:51–56, 1991.

Richards et al., "The centromere region of *Arabidopis thaliana* chromosome 1 contains telomere–similar sequences," *Nucleic Acids Research*, 19:3351–3357, 1991.

Rosenfeld,"Human artificial chromosomes get real," *Nature Genetics*, 15:333–335, 1997.

Round et al., "*Arabidopsis thaliana* centromee regions: genetic map positions and repetitive dna structure," *Genome Res*, 7:1045–1053, 1997.

Sasnauskas et al., "Molecular cloning and analysis of autonomous replicating sequence of *candida maltosa*," *Yeast*, 8:253–259, 1992.

Schmidt et al., "Physical map and organization of *Arabidopsis thaliana* chromosome 4," *Science*, 270:480–483, 1995.

Singh et al., Centromere mapping and orientation of the molecular linkage map of rice (*Oryza sativa* L.), *Proc. Natl. Acad. Sci. USA*, 93:6163–6168, 1996.

Simoens et al."Characterization of highly repetitive sequences of *Arabidopsis thaliana*," *Nuc. Acids Res.*, 16:6753–6766, 1988.

Smythe, "Pollen clusters. New *Arabidopsis* mutations that result in all four products of meiosis being held together as a tetrad of fused pollen grains may facilitate genetic mapping and lead to new insights into pollen biology," *Current Biology*, 4:851–853, 1994.

Sun et al., "Human artificial episomal chromosomes for cloning large DNA fragments in human cells," *Nature Genetics*, 8:33–41, 1994.

Sun et al., "Molecular structure of a functional *drosophila* centromere," *Cell*, 91:1007–1019, 1997.

Tavoletti et al., "Half tetrad analysis in alfalfa using multiple restriction fragment length polymorphism markers," *Proc. Natl. Acad. Sci. USA*, 93:10918–10922, 1996.

Thompson et al., "Identification and distribution of seven classes of middle–repetitive dna in the *Arabidopsis thaliana* genome," *Nuc. Acids Res.*, 24:3017–3022, 1996.

Tsay et al., "Identification of a mobile endogenous transposon in *Arabidopsis thaliana*," *Science*, 260:342–344, 1993.

Tyler–Smith et al., "Mammalian chromosome structure," *Current Biology*, 3:390–397, 1993.

Tyler–Smith et al., "Localization of DNA sequences required for human centromere function through an analysis of rearranged Y chromosomes," *Nature Genetics*, 5:369–375, 1993.

Valvekens et al., "Agrobacterium tumefaciens–mediated transformation of *Arabidopsis thaliana* root explants by using kanamycin selection," *Proc. Natl. Acad. Sci.*, 85:5536–5540, 1988.

Voytas and Ausubel,"A copia–like transposable element family in *Arabidopsis thaliana*," *Nature*, 336:242–244, 1988.

Wevrick et al., "Partial deletion of alpha satellite DNA association with reduced amounts of the centromere protein CENP–B in a mitotically stable human chromosome rearrangement," *Mol Cell Biol.*, 10:6374–6380, 1990.

Willard, "Centromeres: the missing link in the development of human artificial chromosomes," *Genetics and Development*, 8:219–225, 1998.

Willard, "Human artificial chromosomes coming into focus," *Nature Biotech*, 16:415–416, 1998.

Willard, H., "Centromeres of mammalian chromosomes", *Trends Genet.*, 6:410–416, 1990.

Williams et al., "Neocentromere activity of stucturally acentric mini–chromosomes in *Drosophila*," *Nature Genetics*, 18:30–37, 1998.

Wright et al., "Multiple non–LTR retrotransposons in the genome of *Arabidopsis thaliana*," *Genetics*, 142:569–578, 1996.

Xiang and Guerra, "The anti–*nptll* gene," *Plant Physiol.*, 102:287–293, 1993.

Zentgraf et al., "Telemere–binding proteins *Arabidopsis thaliana*," *Plan. Mol. Bio.*,27:467–475, 1995.

International Search Report dated Oct. 28, 1998 (PCT/US98/11288)(ARCD:257P).

Fig. 17 from U.S. Appl. No. 09/531,120.

Fig. 18 from U.S. Appl. No. 09/531,120.

Table 3 from U.S. Appl. No. 09/531,120, "Predicted genes within CEN and CEN4 that correspond to the cDNA database.".

Table 4 from U.S. Appl. No. 09/531,120, "List of additional genes encoded within the boundaries of CEN4.".

Table 5 from U.S. Appl. No. 09/531,120, "BAC clones residing within *A. thaliana* centromeres and associated Genebank accession numbers.".

Table 6 from U.S. Appl. No. 09/531,120, "Fully sequenced BAC clones containing *A. thaliana* centromere sequences.".

Co–pending U.S. Appl. No. 09/090,051, filed Jun. 3, 1998. (ARCD:257).

* cited by examiner

|    | A     | B      | C                 |
|----|-------|--------|-------------------|
| 1  | T1-1  | PLA391 | tetrad seed stock |
| 2  | T1-2  | PLA392 | tetrad seed stock |
| 3  | T1-3  | PLA393 | tetrad seed stock |
| 4  | T1-4  | PLA394 | tetrad seed stock |
| 5  |       |        |                   |
| 6  | T2-1  | PLA395 | tetrad seed stock |
| 7  | T2-2  | PLA396 | tetrad seed stock |
| 8  | T2-3  | PLA397 | tetrad seed stock |
| 9  | T2-4  | PLA398 | tetrad seed stock |
| 10 |       |        |                   |
| 11 | T3-1  | PLA399 | tetrad seed stock |
| 12 | T3-2  | PLA400 | tetrad seed stock |
| 13 | T3-3  | PLA401 | tetrad seed stock |
| 14 | T3-4  | PLA402 | tetrad seed stock |
| 15 |       |        |                   |
| 16 | T4-1  | PLA403 | tetrad seed stock |
| 17 | T4-2  | PLA404 | tetrad seed stock |
| 18 | T4-3  | PLA405 | tetrad seed stock |
| 19 | T4-4  | PLA406 | tetrad seed stock |
| 20 |       |        |                   |
| 21 | T5-1  | PLA407 | tetrad seed stock |
| 22 | T5-2  | PLA408 | tetrad seed stock |
| 23 | T5-3  | PLA409 | tetrad seed stock |
| 24 | T5-4  | PLA410 | tetrad seed stock |
| 25 |       |        |                   |
| 26 | T6-1  | PLA411 | tetrad seed stock |
| 27 | T6-2  | PLA412 | tetrad seed stock |
| 28 | T6-3  | PLA413 | tetrad seed stock |
| 29 | T6-4  | PLA414 | tetrad seed stock |
| 30 |       |        |                   |

*FIG. 4A*

|    | A     | B      | C                 |
|----|-------|--------|-------------------|
| 31 | T7-1  | PLA415 | tetrad seed stock |
| 32 | T7-2  | PLA416 | tetrad seed stock |
| 33 | T7-3  | PLA417 | tetrad seed stock |
| 34 | T7-4  | PLA418 | tetrad seed stock |
| 35 |       |        |                   |
| 36 | T8-1  | PLA419 | tetrad seed stock |
| 37 | T8-2  | PLA420 | tetrad seed stock |
| 38 | T8-3  | PLA421 | tetrad seed stock |
| 39 |       |        |                   |
| 40 | T10-1 | PLA422 | tetrad seed stock |
| 41 | T10-2 | PLA423 | tetrad seed stock |
| 42 | T10-3 | PLA424 | tetrad seed stock |
| 43 |       |        |                   |
| 44 | T11-1 | PLA425 | tetrad seed stock |
| 45 | T11-2 | PLA426 | tetrad seed stock |
| 46 | T11-3 | PLA427 | tetrad seed stock |
| 47 |       |        |                   |
| 48 | T12-1 | PLA428 | tetrad seed stock |
| 49 | T12-2 | PLA429 | tetrad seed stock |
| 50 | T12-3 | PLA430 | tetrad seed stock |
| 51 |       |        |                   |
| 52 | T13-1 | PLA431 | tetrad seed stock |
| 53 | T13-2 | PLA432 | tetrad seed stock |
| 54 | T13-3 | PLA433 | tetrad seed stock |
| 55 |       |        |                   |
| 56 | T14-1 | PLA434 | tetrad seed stock |
| 57 | T14-2 | PLA435 | tetrad seed stock |
| 58 | T14-3 | PLA436 | tetrad seed stock |
| 59 |       |        |                   |
| 60 | T18-1 | PLA437 | tetrad seed stock |

*FIG. 4B*

|     | A     | B      | C                  |
|-----|-------|--------|--------------------|
| 61  | T18-2 | PLA438 | tetrad seed stock  |
| 62  | T18-3 | PLA439 | tetrad seed stock  |
| 63  |       |        |                    |
| 64  | T20-1 | PLA440 | tetrad seed stock  |
| 65  | T20-2 | PLA441 | tetrad seed stock  |
| 66  | T20-3 | PLA442 | tetrad seed stock  |
| 67  |       |        |                    |
| 68  | T27-1 | PLA443 | tetrad seed stock  |
| 69  | T27-2 | PLA444 | tetrad seed stock  |
| 70  | T27-3 | PLA445 | tetrad seed stock  |
| 71  |       |        |                    |
| 72  | T28-1 | PLA446 | tetrad seed stock  |
| 73  | T28-2 | PLA447 | tetrad seed stock  |
| 74  | T28-3 | PLA448 | tetrad seed stock  |
| 75  |       |        |                    |
| 76  | T29-1 | PLA449 | tetrad seed stock  |
| 77  | T29-2 | PLA450 | tetrad seed stock  |
| 78  | T29-3 | PLA451 | tetrad seed stock  |
| 79  |       |        |                    |
| 80  | T30-1 | PLA452 | tetrad seed stock  |
| 81  | T30-2 | PLA453 | tetrad seed stock  |
| 82  | T30-3 | PLA454 | tetrad seed stock  |
| 83  | T30-4 | PLA455 | tetrad seed stock  |
| 84  |       |        |                    |
| 85  | T31-1 | PLA456 | tetrad seed stock  |
| 86  | T31-2 | PLA457 | tetrad seed stock  |
| 87  | T31-3 | PLA458 | tetrad seed stock  |
| 88  |       |        |                    |
| 89  | T32-1 | PLA459 | tetrad seed stock  |
| 90  | T32-2 | PLA460 | tetrad seed stock  |

*FIG. 4C*

|  | A | B | C |
|---|---|---|---|
| 91 | T32-3 | PLA461 | tetrad seed stock |
| 92 | T32-4 | PLA462 | tetrad seed stock |
| 93 | | | |
| 94 | T33-1 | PLA463 | tetrad seed stock |
| 95 | T33-2 | PLA464 | tetrad seed stock |
| 96 | T33-3 | PLA465 | tetrad seed stock |
| 97 | | | |
| 98 | T34-1 | PLA466 | tetrad seed stock |
| 99 | T34-2 | PLA467 | tetrad seed stock |
| 100 | T34-3 | PLA468 | tetrad seed stock |
| 101 | T34-4 | PLA469 | tetrad seed stock |
| 102 | | | |
| 103 | T35-1 | PLA470 | tetrad seed stock |
| 104 | T35-2 | PLA471 | tetrad seed stock |
| 105 | T35-3 | PLA472 | tetrad seed stock |
| 106 | T35-4 | PLA473 | tetrad seed stock |
| 107 | | | |
| 108 | T36-1 | PLA474 | tetrad seed stock |
| 109 | T36-2 | PLA475 | tetrad seed stock |
| 110 | T36-3 | PLA476 | tetrad seed stock |
| 111 | T36-4 | PLA477 | tetrad seed stock |
| 112 | | | |
| 113 | T37-1 | PLA478 | tetrad seed stock |
| 114 | T37-2 | PLA479 | tetrad seed stock |
| 115 | T37-3 | PLA480 | tetrad seed stock |
| 116 | T37-4 | PLA481 | tetrad seed stock |
| 117 | | | |
| 118 | T38-1 | PLA482 | tetrad seed stock |
| 119 | T38-2 | PLA483 | tetrad seed stock |
| 120 | T38-3 | PLA484 | tetrad seed stock |

FIG. 4D

|     | A      | B      | C                  |
|-----|--------|--------|--------------------|
| 121 | T38-4  | PLA485 | tetrad seed stock  |
| 122 |        |        |                    |
| 123 | T39-1  | PLA486 | tetrad seed stock  |
| 124 | T39-2  | PLA487 | tetrad seed stock  |
| 125 | T39-3  | PLA488 | tetrad seed stock  |
| 126 |        |        |                    |
| 127 | T40-1  | PLA489 | tetrad seed stock  |
| 128 | T40-2  | PLA490 | tetrad seed stock  |
| 129 | T40-3  | PLA491 | tetrad seed stock  |
| 130 |        |        |                    |
| 131 | T41-1  | PLA492 | tetrad seed stock  |
| 132 | T41-2  | PLA493 | tetrad seed stock  |
| 133 | T41-3  | PLA494 | tetrad seed stock  |
| 134 | T41-4  | PLA495 | tetrad seed stock  |
| 135 |        |        |                    |
| 136 | T42-1  | PLA496 | tetrad seed stock  |
| 137 | T42-2  | PLA497 | tetrad seed stock  |
| 138 | T42-3  | PLA498 | tetrad seed stock  |
| 139 |        |        |                    |
| 140 | T43-1  | PLA499 | tetrad seed stock  |
| 141 | T43-2  | PLA500 | tetrad seed stock  |
| 142 | T43-3  | PLA501 | tetrad seed stock  |
| 143 |        |        |                    |
| 144 | T44-1  | PLA502 | tetrad seed stock  |
| 145 | T44-2  | PLA503 | tetrad seed stock  |
| 146 | T44-3  | PLA504 | tetrad seed stock  |
| 147 | T44-4  | PLA505 | tetrad seed stock  |
| 148 |        |        |                    |
| 149 | T45-1  | PLA506 | tetrad seed stock  |
| 150 | T45-2  | PLA507 | tetrad seed stock  |

FIG. 4E

|     | A     | B      | C                  |
|-----|-------|--------|--------------------|
| 151 | T45-3 | PLA508 | tetrad seed stock  |
| 152 | T45-4 | PLA509 | tetrad seed stock  |
| 153 |       |        |                    |
| 154 | T46-1 | PLA510 | tetrad seed stock  |
| 155 | T46-2 | PLA511 | tetrad seed stock  |
| 156 | T46-3 | PLA512 | tetrad seed stock  |
| 157 | T46-4 | PLA513 | tetrad seed stock  |
| 158 |       |        |                    |
| 159 | T48-1 | PLA514 | tetrad seed stock  |
| 160 | T48-2 | PLA515 | tetrad seed stock  |
| 161 | T48-3 | PLA516 | tetrad seed stock  |
| 162 |       |        |                    |
| 163 | T49-1 | PLA517 | tetrad seed stock  |
| 164 | T49-2 | PLA518 | tetrad seed stock  |
| 165 | T49-3 | PLA519 | tetrad seed stock  |
| 166 | T49-4 | PLA520 | tetrad seed stock  |
| 167 |       |        |                    |
| 168 | T52-1 | PLA521 | tetrad seed stock  |
| 169 | T52-2 | PLA522 | tetrad seed stock  |
| 170 | T52-3 | PLA523 | tetrad seed stock  |
| 171 |       |        |                    |
| 172 | T53-1 | PLA524 | tetrad seed stock  |
| 173 | T53-2 | PLA525 | tetrad seed stock  |
| 174 | T53-3 | PLA526 | tetrad seed stock  |
| 175 |       |        |                    |
| 176 | T55-1 | PLA527 | tetrad seed stock  |
| 177 | T55-2 | PLA528 | tetrad seed stock  |
| 178 | T55-3 | PLA529 | tetrad seed stock  |
| 179 |       |        |                    |
| 180 | T56-1 | PLA530 | tetrad seed stock  |

*FIG. 4F*

|     | A     | B      | C                 |
|-----|-------|--------|-------------------|
| 181 | T56-2 | PLA531 | tetrad seed stock |
| 182 | T56-3 | PLA532 | tetrad seed stock |
| 183 | T56-4 | PLA533 | tetrad seed stock |
| 184 |       |        |                   |
| 185 | T57-1 | PLA534 | tetrad seed stock |
| 186 | T57-2 | PLA535 | tetrad seed stock |
| 187 | T57-3 | PLA536 | tetrad seed stock |
| 188 | T57-4 | PLA537 | tetrad seed stock |
| 189 |       |        |                   |
| 190 | T58-1 | PLA538 | tetrad seed stock |
| 191 | T58-2 | PLA539 | tetrad seed stock |
| 192 | T58-3 | PLA540 | tetrad seed stock |
| 193 |       |        |                   |
| 194 | T60-1 | PLA541 | tetrad seed stock |
| 195 | T60-2 | PLA542 | tetrad seed stock |
| 196 | T60-3 | PLA543 | tetrad seed stock |
| 197 | T60-4 | PLA544 | tetrad seed stock |
| 198 |       |        |                   |
| 199 | T61-1 | PLA545 | tetrad seed stock |
| 200 | T61-2 | PLA546 | tetrad seed stock |
| 201 | T61-3 | PLA547 | tetrad seed stock |
| 202 | T61-4 | PLA548 | tetrad seed stock |
| 203 |       |        |                   |
| 204 | T62-1 | PLA549 | tetrad seed stock |
| 205 | T62-2 | PLA550 | tetrad seed stock |
| 206 | T62-3 | PLA551 | tetrad seed stock |
| 207 |       |        |                   |
| 208 | T63-1 | PLA552 | tetrad seed stock |
| 209 | T63-2 | PLA553 | tetrad seed stock |
| 210 | T63-3 | PLA554 | tetrad seed stock |

*FIG. 4G*

|     | A     | B      | C                 |
|-----|-------|--------|-------------------|
| 211 |       |        |                   |
| 212 | T64-1 | PLA555 | tetrad seed stock |
| 213 | T64-2 | PLA556 | tetrad seed stock |
| 214 | T64-3 | PLA557 | tetrad seed stock |
| 215 | T64-4 | PLA558 | tetrad seed stock |
| 216 |       |        |                   |
| 217 | T66-1 | PLA559 | tetrad seed stock |
| 218 | T66-2 | PLA560 | tetrad seed stock |
| 219 | T66-3 | PLA561 | tetrad seed stock |
| 220 |       |        |                   |
| 221 | T68-1 | PLA562 | tetrad seed stock |
| 222 | T68-2 | PLA563 | tetrad seed stock |
| 223 | T68-3 | PLA564 | tetrad seed stock |
| 224 |       |        |                   |
| 225 | T69-1 | PLA565 | tetrad seed stock |
| 226 | T69-2 | PLA566 | tetrad seed stock |
| 227 | T69-3 | PLA567 | tetrad seed stock |
| 228 |       |        |                   |
| 229 | T70-1 | PLA568 | tetrad seed stock |
| 230 | T70-2 | PLA569 | tetrad seed stock |
| 231 | T70-3 | PLA570 | tetrad seed stock |
| 232 |       |        |                   |
| 233 | T71-1 | PLA571 | tetrad seed stock |
| 234 | T71-2 | PLA572 | tetrad seed stock |
| 235 | T71-3 | PLA573 | tetrad seed stock |
| 236 |       |        |                   |
| 237 | T72-1 | PLA574 | tetrad seed stock |
| 238 | T72-2 | PLA575 | tetrad seed stock |
| 239 | T72-3 | PLA576 | tetrad seed stock |
| 240 | T72-4 | PLA577 | tetrad seed stock |

*FIG. 4H*

|  | A | B | C |
|---|---|---|---|
| 241 | | | |
| 242 | T73-1 | PLA578 | tetrad seed stock |
| 243 | T73-2 | PLA579 | tetrad seed stock |
| 244 | T73-3 | PLA580 | tetrad seed stock |
| 245 | | | |
| 246 | T74-1 | PLA581 | tetrad seed stock |
| 247 | T74-2 | PLA582 | tetrad seed stock |
| 248 | T74-3 | PLA583 | tetrad seed stock |
| 249 | | | |
| 250 | T75-1 | PLA584 | tetrad seed stock |
| 251 | T75-2 | PLA585 | tetrad seed stock |
| 252 | T75-3 | PLA586 | tetrad seed stock |
| 253 | | | |
| 254 | T78-1 | PLA587 | tetrad seed stock |
| 255 | T78-2 | PLA588 | tetrad seed stock |
| 256 | T78-3 | PLA589 | tetrad seed stock |
| 257 | | | |
| 258 | T79-1 | PLA590 | tetrad seed stock |
| 259 | T79-2 | PLA591 | tetrad seed stock |
| 260 | T79-3 | PLA592 | tetrad seed stock |

*FIG. 4I*

| Chromosome # | Marker name | name used in '99 manuscript | Marker Type | Public? |
|---|---|---|---|---|
| 1 | nga59 | | SSLP | YES |
| 1 | nga63 | | SSLP | YES |
| 1 | m59 | | CAPS(BstU I) | YES |
| 1 | g2395 | | CAPS(Xba I) | YES |
| 1 | m235 | | CAPS(Hind III) | YES |
| 1 | athZFPG | | SSLP | YES |
| 1 | SO392 | | SSLP | YES |
| 1 | UFO | | CAPS(Taq I) | YES |
| 1 | Cxc750 | | SSLP | NO |
| 1 | 7G6 | | CAPS(Acc I) | NO |
| 1 | AlG1 | | CAPS(Mnl I) | NO |
| 1 | ml63 | | CAPS(Nla III) | NO |
| 1 | ml342 | ml342 | CAPS(Hinf I) | NO |
| 1 | T22C23-t7 | T22C23-t7 | CAPS(Mnl I) | NO |
| 1 | T5D18-sp6 | | CAPS(Acl I) | NO |
| 1 | F16K23-sp6 | F16K23-sp6 | SSLP | NO |
| 1 | T19K14-sp6 | | SSLP | NO |
| 1 | F5L13-sp6 | F5L13-sp6 | CAPS(Cac8 I) | NO |
| 1 | T3L4-sp6 | T3L4-sp6 | CAPS(Mae III) | NO |
| 1 | T3P8-sp6 | T3P8-sp6 | CAPS(Hae III) | NO |

*FIG. 5A-1*

```
CGCCAAAGACTACGAAATGATC         ATAATAGATAAAGAGCCCCACAC
GGGTCTGGTTATGCCGTGAAG          GTTTTACTTAGTCCAATGGTAG
AAATGGCCAACGATCAGAAGAATAG      GAAGTCCGGCATGTTATCACCCAAG
CAAGTCGCAACGGAAAATG            AAACTACGCCTAACCACTATTCTC
GAAGTACAGCGGCTCAAAAGAAG        TTGCTGCCATGTAATACCTAAGTG
GTTGACTTGTATTTGATTTCTTTTTC     CGAGTGATTTCCTTTTGCTACC
AAGATAAAGCAGCGAATGTGTC         CGAAAGCCGTAACTAGATAATAAG
TACCAGCATACAGGAGAACG           CCTGATTGCAGTTTTATTTTACC
TCCATACCTAAGTTCCACAAG          AGGGGCGAGTAAATCAATC
GAAGTGCGGATCTGTTTGAAG          ATAAAAAGCCGGAGATGGTTG
ATTCATGAGTGGAAAGGGTAGAG        CTCAGCCAAAGAATCAAGTAGAG
AAGCTTGATTCTGTGGTTTTG          AGAATCCTTAGCCCGTCCTG
```

*FIG. 5A-2*

| | | | | |
|---|---|---|---|---|
| 1 | T10N9-sp6 | T10N9-sp6 | SSLP | NO |
| 1 | T27K12 | | SSLP | YES |
| 1 | jcc3 | | CAPS (Nla III) | NO |
| 1 | GPCml19 | | CAPS (Fnu4H I) | NO |
| 1 | nga280 | | SSLP | YES |
| 1 | nga128 | | SSLP | YES |
| 1 | ETR | | CAPS (Nco I) | YES |
| 1 | TAG1 | | SSLP | YES |
| 1 | AthATPASE | | SSLP | YES |
| 1 | nga692 | | SSLP | YES |
| 2 | nga1145 | | SSLP | YES |
| 2 | m246 | | CAPS (Mae III) | YES |
| 2 | ml310 | | SSLP | NO |
| 2 | F5J15-sp6 | F5J15-sp6 | CAPS (Fhu4h I) | NO |
| 2 | F28M8-t7 | | CAPS (Mse I) | NO |
| 2 | F16D14-t7 | | SSLP | NO |
| 2 | T22D4-t7 | T22D4-t7 | CAPS (Hinf I) | NO |
| 2 | T2O15-t7 | | SSLP | NO |
| 2 | F9A16-t7 | F9A16-t7 | SSLP | NO |
| 2 | ml421b | ml421b | CAPS (Hae III) | NO |
| 2 | F8P2-t7 | F8P2-t7 | SSLP | NO |
| 2 | T15D9-19 | T15D9 | SSLP | NO |

FIG. 5B-1

GCCTTGGATGATCAGTGGTG

GGCTACTGGTCAAATCATTC
GCGGCTGATGATCTCCACCTC

AGCCCTTGGATCATATTCTTTAGC

GAATCTTTGCAAACGAGTGG
TTACCCCGCAGGAAAAAGTATG

ACTTCATCACTTGCGGGACTG
ACCGGAAGTGTGGCTGTTG
ATGCCTATTAGCCTTTTTATAG
TGAGAGGTGCAAAATCATAAACAG
GGCCGCGTAAGAGGAGAC
CGTTCGAAGCGTTTGTTC
AAGTTGATTTTCTACTGTTTATTTAG
TAACGTTCCGAGATGAGG
CATCTCCATGAAGGTGAATAG
GAGCCCTTCTATGAGCCTACCTGTTC

GGCCCAAGAAGCCCACAACAC
CTATTCTAGAAGATTGTTAGGAGTTAC
CGTCTGTATGGATTCGTAGC
ACCGGTCGTTGGAGG
AAACTGATATTGTAGATGTGTATTCG
ATTAGAGTTTTGCGTAGAAGATGG
CATCGTCATATGGGTTGTTC
AACTCTGTACGTGGTGGA
AAGTTATGCAAAATGTTATGACG
AGAGATCCCCTGTTACTAAAGCCTATTCTG

FIG. 5B-2

| | | | | |
|---|---|---|---|---|
| 2 | T6A13-sp6 | T6A13-sp6 | SSLP | NO |
| 2 | T13H18-t7 | T13H18-t7 | SSLP | NO |
| 2 | T13H18-sp6 | | SSLP | NO |
| 2 | T10J7-sp6 | T10J7-t7 | SSLP | NO |
| 2 | T17A11-t7 | | CAPS(Msp I) | NO |
| 2 | GPC6 | | SSLP | NO |
| 2 | m1398 | | CAPS(Mnl I) | NO |
| 2 | THY1B | | CAPS(Rsa I) | NO |
| 2 | PhyB | | CAPS(Xho I) | YES |
| 2 | nga1126 | | SSLP | YES |
| 2 | nga361 | | SSLP | YES |
| 2 | nga168 | | SSLP | YES |
| 3 | nga32 | | SSLP | YES |
| 3 | nga172 | | SSLP | YES |
| 3 | nga162 | | SSLP | YES |
| 3 | ARLim | | CAPS(EcoR I) | YES |
| 3 | GAPA | | SSLP | YES |
| 3 | GL1 | | CAPS(Taq I) | YES |
| 3 | atpox' | atpox | CAPS(Msp I) | NO |
| 3 | T25C10-sp6 | T25C10-sp6 | SSLP | NO |
| 3 | T27C7-sp6 | T27C7-sp6 | SSLP | NO |
| 3 | T9G9-sp6 | T9G9-sp6 | SSLP | NO |

*FIG. 5C-1*

ATATTCGTCGATCGTGTTTG
GGTAACAGCCTTCACTCGTC
TCTTTCCCTTAATCTATTGTTGTG
TCTCTGTGCTTTCTCTTTCCTGAC
TTGTTTTTCTAGGTTTTGTTGTAAG
AGTCGATGTCTAGGCTCTTC
ACTAAGGCCTGTGTTGATGTTTCTC
GGCGACCCTTGGACCCTGTATACG

GTGCCTCAGGGACTTCAC
AAAGACTTGTATTTGGGATTTG
AAACGATTGTTTCCTGTAGTG
GCAATGCTACCGCTCTGATAG
ATGCTGCGATGTTTGTAAGG
CTTCCATTTCTTGATTAGTTC
AACCGCTTCCCATTCGTCTTC
AACCGCCATTTCATTTCTATC

TAGGGGACATATCAAACCAAC
ATGCCTAACTATTCGCTGAC
GGCATTAATTGGGAAGGTC

GTCTAAAACCATCTTCACCATAAT
TTCTGTAGTTCTTTGTGAGTGC
TATAACATCAAAAGCGGTCATCAG

FIG. 5C-2

| | | | | |
|---|---|---|---|---|
| 3 | T14H20-t7 | T14h20-t7 | SSLP | NO |
| 3 | T7K14-sp6 | T7K14-sp6 | SSLP | NO |
| 3 | T21P20-sp6 | T21P20-sp6 | CAPS(Mse I) | NO |
| 3 | T20L24-t7 | | CAPS(Apo I) | NO |
| 3 | T5M14-sp6 | T5M14-sp6 | SSLP | NO |
| 3 | ASD.1 | ASD.1 | CAPS(Nla III) | NO |
| 3 | AtAo-2.2 | | CAPS(Dde I) | NO |
| 3 | 91F1 | | CAPS(Fnu4H I) | NO |
| 3 | NIT | | SSLP | YES |
| 3 | AFC1 | | CAPS(Pvu II) | YES |
| 3 | TSA | | CAPS(Alu I) | YES |
| 3 | ngal12 | | SSLP | YES |
| 4 | GA1 | | CAPS(BsaB I) | YES |
| 4 | mi233 | mi233 | SSLP | NO |
| 4 | T5L23.30k14 | T5L23.1 | SSLP | NO |
| 4 | T5L23.28k | | CAPS(Rsa I) | NO |
| 4 | T5L23.32k | T5L23.3 | CAPS(Msp I) | NO |
| 4 | T5L23.50k | | CAPS(Alu I) | NO |
| 4 | T5L23.30k17 | | CAPS(Tsp509 I) | NO |
| 4 | T7M24.30k11 | | SSLP | NO |
| 4 | T25H8.30k9 | | SSLP | NO |
| 4 | T7M24.30k12 | | SSLP | NO |

FIG. 5D-1

```
GCATTAAAGACAAAAAGCCC         CGTTGACCCCGAGAAGATTAC
TTCGGGAATCATGGTCTACAAG       TGTCACATACACGGTTTCTTAG
CAAGCTTCATGGGGACTAG          TAATACGGGACAATCTACAACAC
CTAATTGTAACGGAGAAGAGAG       AAGCATGTTACGTGGATTG
CAAATGATGTCTGGTCTATCTTC      AATTTAAAGGAATCAGAGAACTAC
ATGATCAAAGGGGACGAGG          AAGGAAACACCACCAAACGAAAAC
GAGACAGAGGATTTGGAAC          GAAACCCTCTCCTCAAAC
CCCCTCCCGCCCTAAACCTAC        TTCCGCTACATGGCCTTCTACCTTG

CGTATTCCCCCTGAAAAGTGACCTG    ACATCCGGCCTTCCCATTG
ATTCTTTTGCTTTATGGGACTTC      AAACATGCTGCAGCTTGATTAG
AGGACGATGATACGCTTGTGGAG      ATCATGGGACGCTGCTTTTC
TTGGTTTAAGGCTTTGGTGTAGG      ATGCGCAGAAGAGACGATGATAG
GTTTAAATTTTATGTCATGTCTGTTTC  CTTTGGGCGATGTAGGAGTAG
CGCGACCTTAGCCCTTGTG          TGTGGGCAGGGTAATGGATG
ATATCCGGCTCCGAACTTGTGG       CCGCGAGATGGATGTGATGAC
TGAGGGGCTGACATTTCTT          TTCCCCGAGGCGACTGAC
TCGGTTGGGGATAGAAAATGG        GTGGCACGATCGTATGAGTTAGC
```

FIG. 5D-2

| | | | | |
|---|---|---|---|---|
| 4 | T7M24.30k13 | T7M24.3 | SSLP | NO |
| 4 | T25H8.30k8 | | SSLP | NO |
| 4 | T25H8.30k7 | | SSLP | NO |
| 4 | T24H24.30k3 | T24H24.3 | SSLP | NO |
| 4 | T27D20.C4 | T27D20.4 | CAPS(Dde I) | NO |
| 4 | mi306 | mi306 | CAPS(Tal I) | NO |
| 4 | nga12 | | SSLP | YES |
| 4 | T15D16-sp6 | T15D16-t7 | CAPS(Mse I) | NO |
| 4 | mi87 | mi87 | SSLP | NO |
| 4 | F14G16-t7 | F14G16-t7 | SSLP | NO |
| 4 | F13H14-t7 | F13H14 | SSLP | YES |
| 4 | mi167 | mi167 | SSLP | NO |
| 4 | T25J3-sp6 | | SSLP | NO |
| 4 | T3F12.0 | | SSLP | NO |
| 4 | HY4 | | CAPS(Bgl II) | YES |
| 4 | nga8 | | CPAS(Rsa I) | YES |
| 4 | nga1111 | | SSLP | YES |
| 4 | DET1 | | SSLP | YES |
| 4 | COP9 | | SSLP | YES |
| 4 | SC5 | | CAPS(Apo I) | YES |
| 4 | g4539 | | CAPS(Acc I) | YES |
| 4 | AG | | CAPS(Hind III) | YES |
| 4 | nga1139 | | CAPS(Xba I) | YES |
| 4 | nga1107 | | SSLP | YES |
| 4 | | | SSLP | YES |

```
CTCTCATCGACCCTCACTCTCAAG      AGTCCCAACAAAACCAAAAACATAAAC
GGCCTCCATGCTACCAACAAC         CACAAAATGCCACCCCTACTACC
TGGCAGCAGAGTTATTTGACGAG       ATGCGCGACTGAAGGACACC
GGCCTGCCCATAAACCTG            CCGCTGTGGAACCTGAAAG
AAACGCCGCCAAAATCAGAAC         ACAACCTTAGCCCGATCCATTC
CTGCGAGCGACGGTCAATG           GCAGCCGTGTGGATGGAG

AATCAATTGGTTTCTACTTTTTAG      AACTCCGACTGAAGGTATAGC
TTTGCACCGCCTATGTTACC          GAGGACGTTTGCAGAGTG
TCGACTAGATTTATTATTTCTCTCAG    TTTGGCTTGACTCTGTGAAC
CCCAATTCCTGCCACTAAG           AAGAAGAAGAGGAGGAAGAAGATGTC
AGTGGACGCCTTCTTCAATGTG        TGGTCCGTCGTAGGGCAAC
CTTCACGCTGCCTTCACTCTC         GATACGCTCGTTCCCACTCG
CAAAACCAAATCCGCGAAGAAC        AGTGGCCAGCCTTCTTAACATACC
```

| | | | |
|---|---|---|---|
| 5 | CTR1 | | SSLP | YES |
| 5 | ca72 | | SSLP | YES |
| 5 | nga106 | | SSLP | YES |
| 5 | nga139 | | SSLP | YES |
| 5 | SO262 | | SSLP | YES |
| 5 | nga76 | | SSLP | YES |
| 5 | F13K20-t7 | F13K20-t7 | CAPS(Mse I) | NO |
| 5 | T18M4-t7 | | CAPS(ScH I) | NO |
| 5 | T18F2-sp6 | T18F2-sp6 | CAPS(Mse I) | NO |
| 5 | T24120-sp6 | T24120-sp6 | SSLP | NO |
| 5 | CUE1 | CUE1 | CAPS(Mse I) | NO |
| 5 | T22J22-sp6 | | SSLP | NO |
| 5 | T17M11-sp6 | T17M11-sp6 | SSLP | NO |
| 5 | T14O24-sp6 | T14O24-sp6 | CAPS(Tsp509 I) | NO |
| 5 | F18G23 | F18G23-t7 | SSLP | NO |
| 5 | T2L5.3K | T2L5.3 | CAPS(Fnu4H I) | NO |
| 5 | F7N22.3k1 | | CAPS (Bfa I) | NO |
| 5 | T3L6-sp6 | T3L6-sp6 | CAPS(Mnl I) | NO |
| 5 | T21K16-t7 | | SSLP | NO |
| 5 | phyC | | SSLP | YES |
| 5 | SO191 | | | YES |
| 5 | DFR | | | YES |
| 5 | LFY | | | YES |

FIG. 5F-1

TTTGTGCAATTTATTAGGGTAG
CCGTGGTCGAGAGTTGAGTTAGTC
AGCTTCGATAACAAACTCACC
AACGCTTATCCTCTTTCTCTTTTAC
TCTCGTTCTGATGGCTCCTGTG
CGACGAAGCAGTGGAGGAAC
AGCTACTACCCGAATGTGAATC
TAGGACGCAAATCAGAGAAG
TTGGGCTGGCGTGGAATC
GCTGCGAAGGCTGATGAAG
CACCGACGTTATCTGGGAAAG
GAGCGTGCTTTTTGGAGTTTTG
GACTCATATGTGGCGTTTTC

ATTTGCAGAAGTTGAAGTTGGTC
ACCCGGAGTAGTTTTCAGTGTTC
AGAAGATAAATCAACTAAACAAAATG
ACGGTTGCCCATCTTATCAGTG
GTGTAACCGGTGATACTCTCGCC
GCGAGAAAACGTGAAGAGATAG
TTGGTGTGTTAAGAAGAGTGG
CTAATCATGTCTTTAGGCTATC
AGGGCAGAAAGCGTCAGG
TCGCCGGGAAAAACAGTAAC
AAAAGTTAGGTAGTAGGAAAGAAAGAAG
AACCCTAGATCGCCCTTTTTC
AGGATTCACTGGCGGTTG

FIG. 5F-2

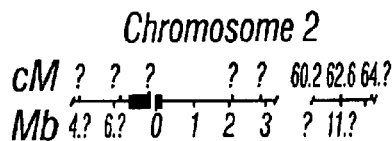
FIG.12A
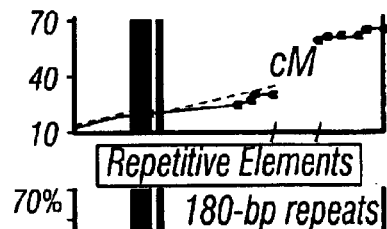
FIG.12B
FIG.12C
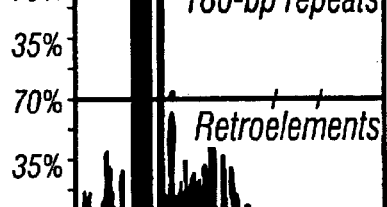
FIG.12D
FIG.12E
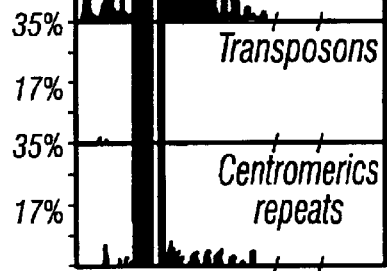
FIG.12F
FIG.12G
FIG.12H
FIG.12I
FIG.12J
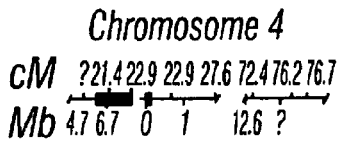
FIG.12K
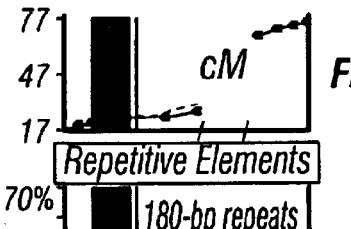
FIG.12L
FIG.12M
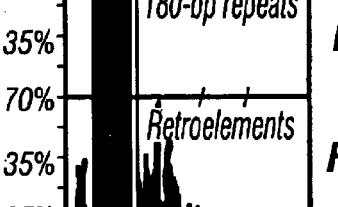
FIG.12N
FIG.12O
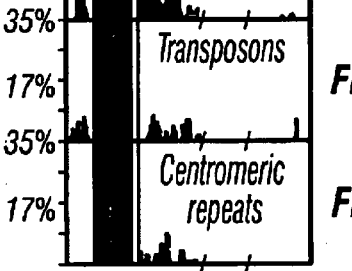
FIG.12P
FIG.12Q
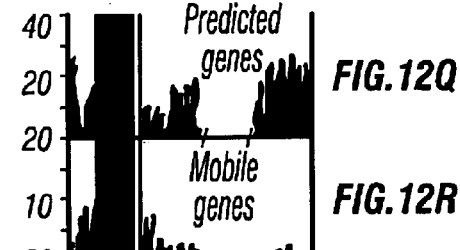
FIG.12R
FIG.12S
FIG.12T

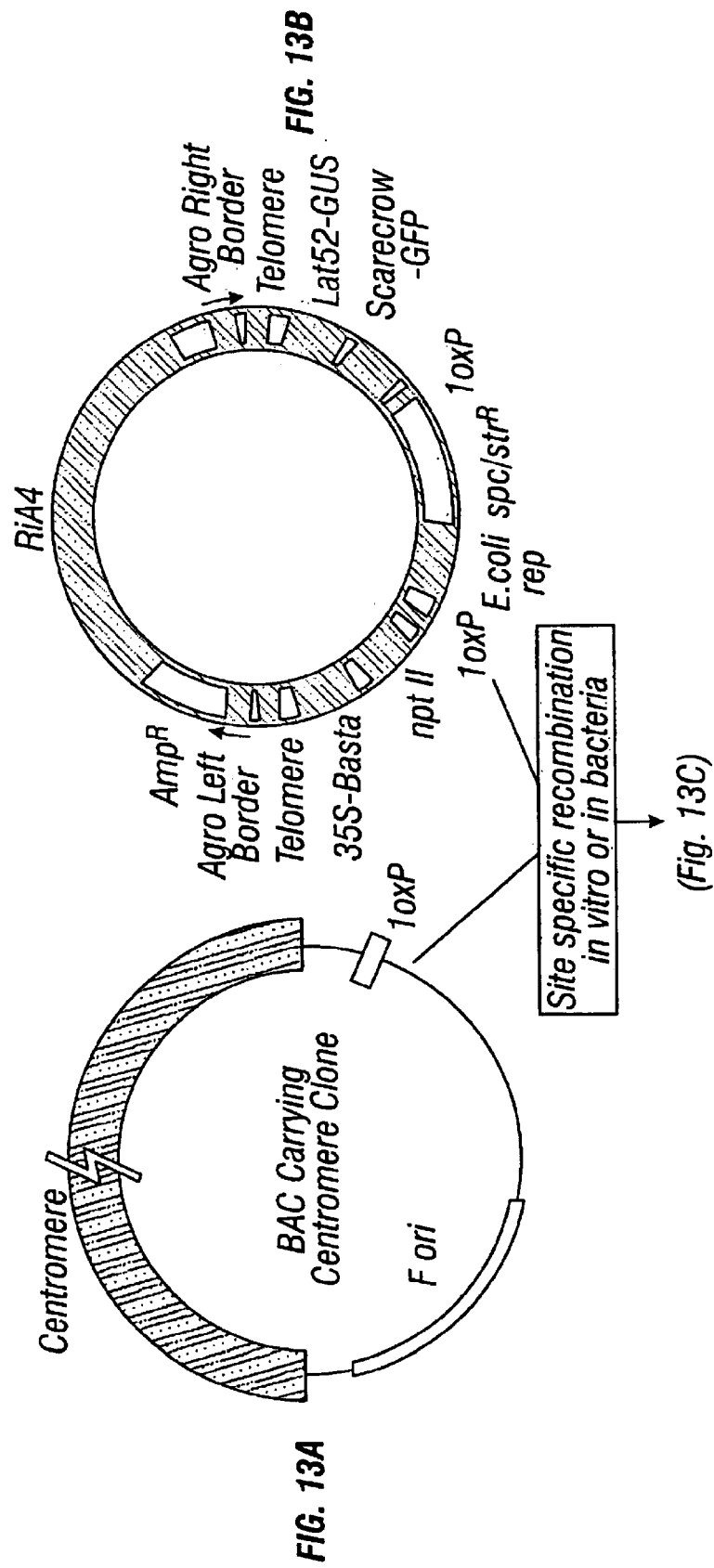

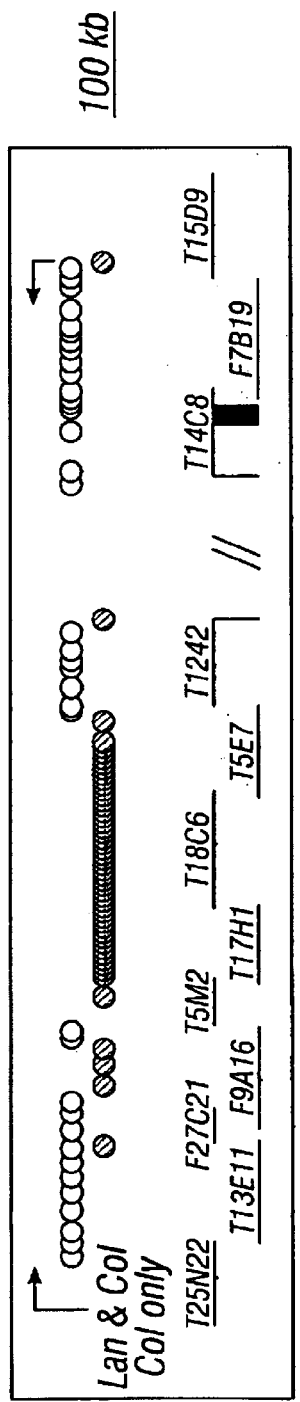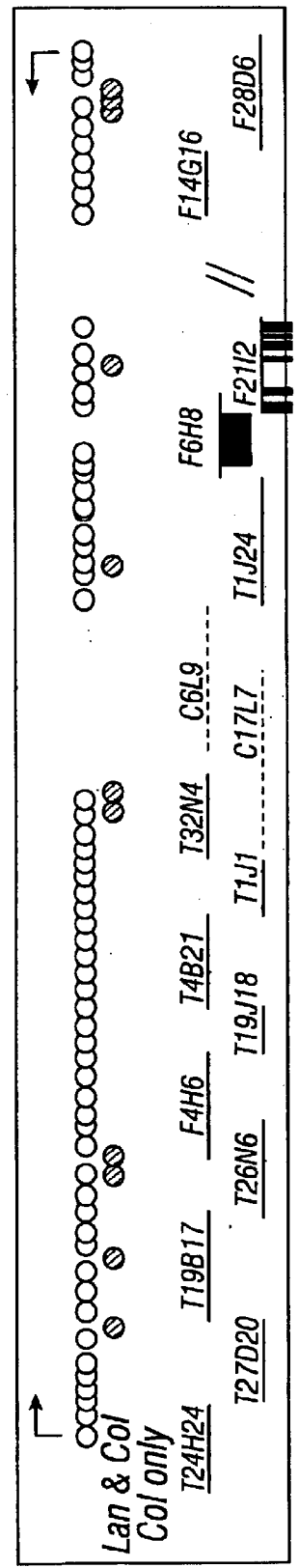
FIG. 14A
FIG. 14B

| Sequenced Clone | Marker name | Marker or Primer pair | Marker Location | marker properties, position |
|---|---|---|---|---|
| T13E11 | T13E11.01 | primer | 1755-2385 | Lan & Col |
| T13E11 | T13E11.30 | primer | 30628-31270 | Lan & Col |
| T13E11 | T13E11.48 | primer | 48187-48969 | Lan & Col |
| T13E11 | T13E11.63 | primer | 63886-64530 | Lan & Col |
| T13E11 | T13E11.78 | primer | 78190-78878 | Lan & Col |
| T13E11 | T13E11.93 | primer | 93907-94579 | Lan & Col |
| F27C21 | F27C21.18 | primer | 18383-19057 | Lan & Col |
| F27C21 | F27C21.02 | primer | 2570-3293 | Lan & Col |
| F9A16 | F9A16.71 | primer | 71978-72592 | Dom |
| F9A16 | F9A16.53 | primer | 53253-53921 | Dom |
| F9A16 | F9A16.38 | primer | 37116-37733 | Dom |
| F9A16 | F9A16.22 | primer | 22166-22889 | |
| F9A16 | F9A16.03 | primer | 3308-4091 | Lan & Col |
| T5M2 | mito border | marker | 17685 | Dom |
| T5E7 | T5E7.23 | primer | 109092-109688 | Lan & Col |
| T5E7 | T5E7.73 | primer | 73460-74120 | Lan & Col |
| T5E7 | T5E7.58 | primer | 57942-58583 | Lan & Col |
| T5E7 | T5E7.40 | primer | 40913-41537 | Lan & Col |
| T5E7 | mito border | marker | 13507 | Dom |
| T5E7 | T5E7.02 | primer | 2919-3585 | Lan & Col |

| Forward Primer | Reverse Primer |
|---|---|
| AGCGCTGGGATGGGTTGGTTG | TTAATGCGCAATGGCTGAACAAG |
| CAGGTTGCGGTTACTACATGGGTTTCAG | TATGCATGCGAGTTGGTGGGAGGTAAAG |
| AACCCCGTAAATTAAACCACAC | CGATACGGGCATGACTCCAG |
| ACGGGCGGTTGAGAGGAGAAGC | CCCCAAACGCAGCAAGACAATC |
| AACAAAACAAATGCCAGGTCAGG | CTCCGGTCGCAAAGTTACATACAG |
| GTTACCCCGGTCCTGAGATTGAG | TTGGGGAGCAGGATTTGATGTG |
| CAGGCGATTGTCTCTTTTATAGGCTGTAAG | TTTTGCTGGAACGGAGGGAGTAC |
| ACAAAGCCGAACTCGTGGAAG | TGCCTGGTTGATTATTGCTGAAAG |
| AATGCTTTTGCGACTCTTTTGAC | TTGTTATTTTGGGTTTTGGGTTGG |
| CGCAGGCGGCTACTTGTTTG | GATGAATTGATCCGTTGTTTTATGTCT |
| CAAGGCGGGAAAACAACTC | AATTATTTCAACGGCTCTTTACC |
| GTATTAGCATTATGTTAGTCTGTTAGTGG | GCTCCTTGCGTATTCTTCACC |
| GATCCAGCAACCTTAGCCCTTC | GATCCCTCAGTTCGAAATCAATCTTC |
| AAGGCATCAACGTTTGTGTG | CTACCAGGTAGGTGAAACG |
| ATTATTGGCTGCTGCACTTCTGTCAC | AGGGGCCGGAGCTCGTATGGA |
| TCTCGGGAGTAGGGCTTTGTTCTG | CGGTCGCCCTCGTTCTGTATCTG |
| AGGGGCTTACAAGAATGAAC | TCGCCAATGAAAAGAGGGTAG |
| GTAGCCGGCTCAGTCTCATAACATC | CTAAATCCCGAAAACCCAAACCAC |
| CGAATTCCTTCAGATGATGC | TTGCCTTACCTATACCCGAC |
| AAATGGCAGAAGCAGAAGCAGGAATAG | TAATGCAAGGGTCTCGTAATGGAAATG |

| | | | |
|---|---|---|---|
| T12J2 | T12J2.01 | primer | 1373-1998 | Lan & Col |
| T12J2 | T12J2.19 | primer | 19369-20038 | Lan & Col |
| T12J2 | T12J2.37 | primer | 37750-38359 | Lan & Col |
| T12J2 | ATEDA59 | marker | 50592 | Lan & Col |
| T12J2 | T12J2.56 | primer | 56455-57533 | Lan & Col |
| T12J2 | T12J2.73 | primer | 73911-74556 | Lan & Col |
| T14C8 | T14C8.1 | primer | 8862-9544 | Lan & Col |
| T14C8 | T14C8.6 | primer | 10837-11485 | Lan & Col |
| T14C8 | T14C8.7 | primer | 45334-46016 | Lan & Col |
| T14C8 | T14C8.3 | primer | 46672-47283 | Lan & Col |
| T14C8 | T14C8.8 | primer | 48833-49538 | Lan & Col |
| T14C8 | T14C8.9 | primer | 71115-71878 | Lan & Col |
| T14C8 | T14C8.5 | primer | 73841-74456 | Lan & Col |
| T14C8 | T14C8.4 | primer | 75442-76122 | Lan & Col |
| F7B19 | F7B19.1 | primer | 108-757 | Lan & Col |
| F7B19 | F7B19.12 | primer | 13831 | Lan & Col |
| F7B19 | F7B19.27 | primer | 27033 | Lan & Col |
| F7B19 | F7B19.2 | primer | 30189-30791 | Lan & Col |
| F7B19 | F7B19.43 | primer | 43142 | Lan & Col |
| F7B19 | F7B19.3 | primer | 55446-56209 | Lan & Col |
| F7B19 | F7B19.59 | primer | 59771 | Lan & Col |
| F7B19 | F7B19.4 | primer | 70859-71492 | Lan & Col |
| F7B19 | F7B19.77 | primer | 77633 | Lan & Col |
| F7B19 | F7B19.95 | primer | 95351 | Lan & Col |

*FIG. 15A-1B*

```
GTGTGGCCTCGTGTGACCTGAC              AGTTTGCTTCGTTGCTTGCTTATTATG
CTGGCCCATCCCTTATCGGTTTAC            AGCGCAATCAAGCTATCCCTACATA
ACCTCCCCACACTTAAACGACACTG           CTCAGAATCCCAAAACAGAGCCACAC
TGAATGCTATGAAAGATGGATGAAAC          AGACGGCTAGTGATTGGTGG
AATCGGGCTCGGTTGTGTAGAAAC            ATGGCGCAATCAAAAGCAATCC
ACTTGTAGGCCCTTTGATGTTCTG            TGCTTTGTGTTGCTTTGATTATTCTATTAG
ACGAACCCGACGACCACTG                 ACGCCTTTGATTCCATTTCTTACC
GACGGGTTGAAAGAAAGCACAC              AGAAGATGATGGCAAGTTACGAAGAG
CGACCATTCACGACCCATAC                AAGCCCATTCAAAAGAGTTAGGAGAG
ATAGCGTCAGCCCTCATTTCAG              ACCTTTTGCTTGTATTTCGTG
CAAATGGGCGGAGGGG                    TGTGGCAAGTCATGGGTAAGGAG
GGTGCGGGAGAACGATGAC                 CCGGTTTCTGCGATATTTGGTTAG
TTCCGCGCCCAAAAGGTG                  AGAGTCAAGCCAAGCAATAACAGG
AAGAAGGCTGGAAATTGGTTGAG             GAGCGGAAGTAGATGCAGAATGTC
AAGGTCCGGCGGTGAG                    GGGTCGAGTGATGTGATTGAGTG
TAACGTCATCAGCGGTAGGAAAC             TTACAAGCGAGAAAAGATGAGAAGC
CCCCGCTGAACTGACTGACTACGAG           TCCGCCCACCGATAAGATACGAC
GCTCGTTGCGGTTGCTGTTC                CCGCGGTGCTGCTTTTAG
CAGGGAAAGTGGTTGGATTGATG             TGCCCTCTTCCGAACTGGTG
ATTTGCCCATCGTCCTTC                  TTATCAATGTATTTCCCCTGTGTATC
TGAAGAATGCGCATAGCCGTAG              TCTGGGATGAAGAGAAAGAGAACTGTC
AAAACCGTGAGACCCATAAATG              TCCAAATCGCGAAAGTGACAG
ATAACCGAAGAAGCCGAGAAATC             ATCCGGAGACGAAATGAACTTAG
TCGATTGCCAGCAGAGTCAGAAC             TGGGGCTTGTAAGGAGGAGTAAC
```

FIG. 15A-2B

| | | | |
|---|---|---|---|
| F7B19 | F7B19.5 | primer | 989977-99658 | Dom? |
| F7B19 | F7B19.6 | primer | 112337-113039 | Lan. & Col |
| T15D9 | T15D9.3 | primer | 2985 | Lan & Col |
| T15D9 | T15D9.1 | primer | 12299-12914 | Lan & Col |
| T15D9 | T15D9.19 | MARKER | 18991 | LAST RECOMBINANT Col |
| T15D9 | T15D9.2 | primer | 37103-37728 | Lan & Col |
| T15D9 | T15D9.3a | primer | 52189-52811 | Col |
| T15D9 | T15D9.55 | primer | 55134 | Lan & Col |
| T15D9 | T15D9.73 | primer | 72993 | Lan & Col |
| T15D9 | T15D9.4 | primer | 73930-74552 | Lan & Col |
| T15D9 | T15D9.5 | primer | 86724-87494 | Lan & Col |
| T15D9 | T15D9.93 | primer | 93763 | Lan & Col |
| F7K9 | F7K9.3 | primer | 21647-22276 | Lan & Col |
| F7K9 | F7K9.2 | primer | 12216-12843 | Lan & Col |
| F7K9 | F7K9.1 | primer | 3590-4226 | Lan & Col |
| F12P23 | F12P23.3 | primer | 61772-62430 | Lan & Col |
| F12P23 | F12P23.5 | primer | 44870-45511 | Lan & Col |
| F12P23 | F12P23.4 | primer | 40880-41507 | Lan & Col |
| F12P23 | F12P23.2 | primer | 22431-23107 | Lan & Col |
| F12P23 | F12P23.1 | primer | 3352-4026 | Lan & Col |
| T4D8 | T4D8.5 | primer | 81647-82250 | Lan & Col |
| T4D8 | T4D8.3 | primer | 47146-47883 | Lan & Col |
| T4D8 | T4D8.2 | primer | 21848-22453 | Lan & Col |
| T4D8 | T4D8.1 | primer | 18915-19589 | Lan & Col |

*FIG. 15A-1C*

```
AGATGGGGTGCTATTCTTGTATG    GCGGTCGAGTGATTGCTGTAG
AGGGCGAAACTTTGAGAGCAC      TATCGGGTTTTGAAGAGGGAAGG
AGCGTCGGCGTGTGGAG          TCCTGGCAAATTGTCTTCTCGTTG
GCTCCGCCATCTCCTCGTC        GAAGTCCCATGCCTATCCCTG
GAGCCCTTCTATGAGCCTACCTGTTC AGAGATCCCTGTTACTAAAGCCTATTCTG
ATGGGTAATCGAATAGTGTGGTC    CCCTAGGGCATCCGTTTTTATCTC
CGGAGAAAGTTGGGGTTAGTTG     GAGAGGTTTGGGTTGGGCTTGTAG
GCTGCGAACCCACACTTTGCTC     ATGTTATCGTCGCCGCGTTTTATG
AACCGGTTGATAGTAGACGAGATG   TCCGGGTTGCGATAGAG
GTAAGACGGAGCCCCTGAAG       AACATGTTAAAGCCAATACCCTCTC
TCGGAAAGGCTAGAGATGGGTAACTG ATTGGACTATATGGGCCTCGTGAC
TTTGCGGATATTCTAAAGTGATG    TACTATTGCGCTGCTGTGAGG
GGATGCAATGCCCGTTATGATG     TCGAGGGAGGATGCTGAGTATG
CAAAGCGGCCATCTCCTTC        GCAATTCATACCGCCACATCTC
ACTATGCGTGGGTGGCTTTGTG     CAGGGGCATGCGGAATCTC
AGCGAGGTTATCTATCAGGGTTG    GATTAGGTCCCGCTTCTTCCAGTTAG
CTTCATTTGCATCATCGTTATTAG   GGTGTGAAGTCTGAGGCTCCC
TACCCATGCCTTGACTGCTG       TTCTGAACGTGTGTGTTCTATTTG
TCGTCGAACTAATTGGTGGGAAC    TCGGAAGAGTGCCTAAGAG
ACAATGGCAACAATGGGCTGATAG   TTCGGGTCGTTGTTCCTAAAG
CTCGGTCGTCGGTAATGTGAAGTGGT ATACGTCGCGGGAGTTGAG
GCCCGTCTGCCATCTCTATC       CGCCTCCTTCACAGCCACAA
AAACTCGCCGCCTCGTAAC        AGGATAAACCCATAGCTTGACCAG
CTCGTCTCATCCAAATCCGTCC     CAATATAACCCCGTCCCGTGAAG
```

FIG. 15A-2C

| Sequenced Clone | Marker name | Marker or Primer pair | Marker Location | marker properties, position |
|---|---|---|---|---|
| T5H22 | T5H22.00 | primer | 248-2654 | Lan & Col SSLP |
| T5H22 | T5H22.21 | primer | 21508-22868 | Col Dom |
| T5H22 | T5H22.41.3 | primer | 35072-35719 | Lan & Col |
| T5H22 | T5H22.41.4 | primer | 64404-65591 | Col Dom |
| T5H22 | T5H22.65 | primer | 65036-66470 | Lan & Col |
| T7M24 | T7M24.04 | primer | 4816-8214 | Lan & Col |
| T7M24 | T7M24.46 | primer | 46240-47868 | Col Dom |
| T25H8 | T25H8.01 | primer | 1889-2953 | Lan & Col |
| T25H8 | T25H8.17 | primer | 16846-17990 | Col Dom |
| T25H8 | T25H8.22.9 | primer | 22482-25074 | Ler & Col |
| T24M8 | T24M8.65 | primer | 65402-66309 | Lan & Col |
| T24M8 | T24M8.54 | primer | 53857-54655 | Col Dom |
| T24M8 | T24M8.43 | primer | 42439-43274 | Lan & Col |
| T24M8 | T24M8.22 | primer | 22640-23386 | Lan & Col |
| T24M8 | T24M8.09 | primer | 5961-8374 | Lan & Col |
| T24H24 | T24H24.82 | primer | 82814-82890 | Ler & Col |
| T24H24 | T24H24.66 | primer | 66082-66765 | Lan & Col |
| T24H24 | T24H24.48 | primer | 47836-48636 | Ler & Col |
| T24H24 | T24H24.11 | primer | 11212-11867 | Ler & Col |
| T27D20 | T27D20.77 | primer | 77681-78420 | Lan & Col |

| Forward Primer | Reverse Primer |
|---|---|
| TTTGTTACCCCTTTGGCTCGGACTGG | AAGGGGACACGCACAAAAACGCTCTC |
| GTCGCCCTTGGTCTAGTAAATGG | CTGTTCGTCGCCCTTCTGCTG |
| TTGCGAGAAACTTGCGAGGAACATC | TTAGAAAAGCATCGGGCACCAAAC |
| CTCCCTCGCATATTTGTGACTG | GTTGCCAAAGTTCTCTACGATTC |
| TCAACCTAAGGCAAATTTTCTAAG | TTTAATGAAGGCCCAACACC |
| GTGCATGGCCTAAACAACAG | GTTCTCATAACGGGTCAGTCC |
| ATGTTATGTTTACGTCGGGGTTGTGTTG | TCTCGGCTCCGGATGCTATTTGTATTTTC |
| TGACGAAGAAGGGGAAAAGTTG | TGACGTGGTGAAAGTAGGCTGTGAAG |
| ACTAAAGCCCCAACTGAAGAGGAAG | AAACCGCCACTACCGCCATAA |
| AATCGATCCGTCTTTCACCAAC | CTTCCTGCAGCCGTTCTTC |
| CGGCATGACCAAACCCTAAACTC | AGGGGAAAGATGAAAGATGAAATAAG |
| TAATAAACGCTCAGCCACCACTCTAAG | GGGCTGCTCCAATCTCGCTACAC |
| CTTAAATTGCCCGTGATGATGGTTG | GATGGAGTCGGCAAAAGATAGGATG |
| ACGAGAAGCGAAACCGAAGATAG | CGAACCTAAACCAAACCTAAACTGAATC |
| GAGTTCTGGGGTAATTTCCTCTCG | ATTCTTGCGTGTCCCCTGGTGTAAC |
| AGACAGCCGGAAGCAATGGTGG | TCTCGCTGCTGGACATACTCACTCAC |
| GTTGAAGGACCGGAGTTGTTAGAC | TGTGGATCGGTTATTGGAGGG |
| CCCCCAGCCCATTGAGTGAGTAG | AGCGGCGGCCTTGAGAGTATC |
| GGCGGCGTAGTTATGTTGATTGAG | TACCACGGCCCCGAGATACTAAC |
| TCGCGCAAATGGGACACG | CGGGAGGCTCGGGAATC |

| | | | |
|---|---|---|---|
| T27D20 | T27D20.64 | primer | 64198-66686 | Ler & Col |
| T27D20 | T27D20.51 | primer | 51084-51783 | Lan & Col |
| T27D20 | T27D20.41 | primer | 41203-42770 | Lan & Col |
| T27D20 | T27D20.06 | marker | 6107-6887 | Col Dom |
| T19B17 | T19B17.96 | primer | 96402-97060 | Lan & Col |
| T19B17 | T19B17.77 | primer | 77318-78093 | Lan & Col |
| T19B17 | T19.B17.59 | primer | 59092-59808 | Lan & Col |
| T19B17 | T19B17.44 | primer | 44057-44788 | Col Dom |
| T19B17 | T19B17.30 | primer | 30680-31352 | Lan & Col |
| T19B17 | T19B17.11 | primer | 112060-120044 | Lan & Col |
| T26N6 | T26N6.12 | primer | 12724-13462 | Lan & Col |
| T26B6 | T26N6.27 | primer | 27839-28536 | Lan & Col |
| T26B6 | T26N6.42 | primer | 43996-44639 | Col only |
| T26B6 | T26N6.59 | primer | 59333-59938 | Col only |
| T26B6 | T26N6.74 | primer | 74460-75083 | Lan & Col |
| T26B6 | T26N6.93 | primer | 93352-93986 | Lan & Col |
| F4H6 | F4H6.44 | primer | 42567-43173 | Lan & Col |
| F4H6 | F4H6.60 | primer | 60209-60835 | Lan & Col |
| F4H6 | F4H6.82 | primer | 82859-83642 | Lan & Col |
| F4H6 | F4H6.100 | primer | 100331-101001 | Lan & Col |
| T19J18 | T19J18.12 | primer | 12781-13435 | Lan & Col |
| Y19J18 | T19J18.27 | primer | 28093-29954 | Lan & Col |
| T4B21 | T19J18.71 | primer | 6380-7009 | Lan & Col |
| T4B21 | T19J18.42 | primer | 20045-20648 | Lan & Col |

*FIG. 15B-1B*

```
ACCTGCGATAGAGTTGTGAGTTC        CTGCCTTTGCCGATAATAGTC
CCGCCCGGCTTATGCTGAG            GAAGAGAAATGCCCTGTGAGTCC
GTGATTCGCAGGACATTGAGTG         TACATTTTGCAGCCATTTGTG
TCGAATGGCTGAAAGAAAGAATAAGAG    AAAACGGGTGGCGGAGAATG
CGTCTCCCGTGAGGTGC              ATTTTCATAATTATTTGGCGTGTGC
CGAACCCCATCCGAACTAAC           TGCCACAACAAACTCCACTATG
AGCGGTCAATGTTCTTCAATGTCGTAG    TATCGCGGCGGAGTCAGGAG
CTGCCCCGACCACCTTTCAAC          TTGCGGATTCGTTATGCTGTTCTC
ATCGCCGCCCGTCTTCTTCAG          CAGGTTCAGCCCGTTCAACTATAATC
TCATTTGCGTCTAGAGGTGGAGTGC      GGGGTAGAAAGAAGCGAGAGGGATAG
CACGGCATCATTCATCAAACGAG        GTAGGATCCGGCTGAATAGTGGTGG
TCTTCCGATGACGACAACGACAC        ATTCTGCTGCTGCTGATTCCTG
GACGGCCTTTTCATTCTCACACAG       TTTCATATTTGCTCATCTAACCCCTTC
GCCTCGAACCCTACACCTCCAC         AGTCGCCGTAGCAAATGAAACC
ATGGGGCCCTTTGACTACTGAG         TCCGGAGACGATTTGATGAC
TTCCCGCATGCATTAGTTCTTGTG       TTGCCATCATCTTTCTGTGTTGTCTATC
GCAGACGCGAGGACACAGACAG         CAGCCTAAGCCCATTTGTTTTGAAG
GTTCCAACGCTAGCAAGGTCTG         AGGGGCCAACATGCACTACAAG
ACAAATCAGAGGCCCAAAGTCAATG      TGGGCCGAATAACAGCAAGTCC
ATCCAAACGCCCAAATGTCAAC         TTAAGTGCGGTGCGGTTCAAATAC
ATGCCCATAAAGAAAGCCCGTC         CGCCTATCTTCGGTGTCTCGTC
CAGCGCGTACAGTGGTCAAATG         CGTGGGTCAGGTGGGTCAGG
CATTACTTACCCGCTTCCGTCTTTATC    AATGTTAGTGCGAGTTTATGGTTGTGTC
TGTCGCCTTACTCCATTCGTTCAAC      CGGCCGCCTTCATGTATCTATCTC
```

FIG. 15B-2B

| | | | | |
|---|---|---|---|---|
| T4B21 | T4B21.20 | primer | 21757-22522 | SSLP polymorphic |
| T4B21 | T4B21.35 | primer | 37346-38074 | Lan & Col |
| T4B21 | T19J18.57 | primer | 38498-39157 | Lan & Col |
| T4B21 | T4B21.52 | marker | 54320-55077 | Lan & Col |
| T4B21 | T4B21.68 | primer | 69927-70543 | Lan & Col |
| T4B21 | T4B21.83 | primer | 85772-86299 | Lan & Col |
| T1J1 | T1J1.08 | primer | 8862-9483 | Lan & Col |
| T1J1 | T1J1.23 | primer | 23155-23843 | Lan & Col |
| T1J1 | T15D16 | marker | 38027 | CAPS |
| T1J1 | T1J1.39 | primer | 39177-40174 | Lan & Col |
| T1J1 | T1J1.50 | primer | 50248-50937 | Lan & Col |
| T32N4 | T32N4.09 | primer | 10175-11108 | Lan & Col |
| T32N4 | T32N4.24 | primer | 24917-25724 | Lan & Col |
| T32N4 | T32N4.45 | primer | 45840-46451 | Lan & Col |
| T32N4 | T32N4.46 | primer | 46637-47558 | Col Dom |
| T32N4 | T32N4.60 | primer | 60777-61645 | Lan & col |
| T32N4 | T32N4.66 | primer | 66497-67374 | Col Dom |
| T1J24 | T1J24.114 | primer | 114825-115648 | Lan & Col |
| T1J24 | T1J24.90 | primer | 90665-91646 | Lan & Col |
| T1J24 | T1J24.81 | primer | 80921-81638 | Col Dom |
| T1J24 | T1J24.79 | primer | 79569-80351 | Lan & Col |
| T1J24 | T1J24.61 | primer | 60440-61245 | Lan & Col |
| T1J24 | T1J24.51 | primer | 51061-51798 | Lan & Col |
| T1J24 | T1J24.27 | primer | 27855-28895 | Lan & Col |

*FIG. 15B-1C*

```
AATAGGCTTTTCCGGTGCTTCTC      AATTGATTTTGGGGTTTCTCTGTTC
GTGAAAGGAGCAGCAGGAACAGTG     ATTTATAGGCCAATGACCCAATCG
CTATCAAACGCAGTCAAAGAAAGG     AGAAGGTGAGCCAAAGAGATTAGTG
ATAGACAAAATTGGCAACACATACC    CACGCCACTCTTCATCTCCCTTTC
TTGTCATTGGCGCTGCTCTATC       GCTTTCCCCACCAATATCCTTTC
AAGCCCGCGATTTGGTTC           CGCTACGCATGGTCTATTTG
TAGAGCGGGTAACTTAACGAATGTGC   ATGTGGGGCCAAATAAATCAAAAC
TGGAGGGCTTGCATGTGAGAGTG      CAGAGCCGGATGAGAAAACAGAGC
AATCAATTGGTTTCTACTTTTTAG     AACTCCGACTGAAGGTATAGC
ACCGGCTCATTGGCTAAAAAGTTC     TTAAGGGTTGGGGTTCATCTGTCAC
AAGTCTGGGAAGAGGATGAGAACCC    ATAAAGTACGCCGCCCATCAATAG
GGCAGATACGGCGGGTCCATAG       TCTGAATCGCATCTCCCTCGTGTAAAG
CGTGGGAGCTGCCGTAGAAG         GCCGTTGATGATGAAAATAGGGTG
CGCCCCTTCAGGTTAGTCC          GTTTGCTCTCCCCTCCCAGTG
CTGGCGTACGAGAGTGCTTGTG       ATGACCCTGTGCTTTTGCTCCTC
CTCTCGGCGTTGCTTCTGG          GCCCGGTCGGTGCTATTC
AAAGAAGCGAAACAACATAACCATAG   GGAGACAAAGAAATCGGCAGAGTAG
CATGCCCGAATTACGACACCTC       GCGCCAAATCTCTAAACAACACTC
AATGAATGGACGAAAACGAAACT      GCATCCCCGGTACTGGTGAG
AATCGCGACTTTGCCTTCC          TAAACTACTATCCCACCACCACTACC
GTGTATCGGGGCCATCTCAG         GCTCAACATCGCCGCAATCT
CCCAAAGTATAAGCGCCCACCTA      TAAGCGCCTCACTTCACCATTG
TCCGGAAGGAGCCACATAAG         TCCCCAGACCTCGTTGAC
GGCCGGGAGTTGGTCATAAGG        TCAATTTCAATCCCCGCTGGTC
```

FIG. 15B-2C

| | | | |
|---|---|---|---|
| T1J24 | T1J24.23 | primer | 23943-24800 | Lan & Col |
| T1J24 | T1H24.01 | primer | 683-1663 | Lan & Col |
| | | | unknown-unique seq | |
| F6H8 | F6H8.70 | primer | unknown | Lan & Col |
| F6H8 | F6H8.51 | primer | unknown | Lan & Col |
| F6H8 | F6H8.94 | primer | unknown | Lan & Col |
| F6H8 | F6H8.114 | primer | unknown | Lan & Col |
| F2112 | F2112.82 | primer | 82463-83233 | Lan & Col |
| F2112 | F2112.70 | primer | 70415-71220 | Lan & Col |
| F2112 | F2112.68 | primer | 68874-69938 | Lan & Col |
| F2112 | F2112.50 | primer | 50288-50891 | Lan & Col |
| F2112 | F2112.48 | primer | 48960-50345 | Col |
| F2112 | F2112.29 | primer | 29895-30702 | Lan & Col |
| F2112 | F2112.02 | primer | 2313-3098 | Lan & Col |
| F14G16 | F14G16.100 | primer | 3496-4174 | Lan & Col |
| F14G16 | F14G16.81 | primer | 22905-23604 | Lan & Col |
| F14G16 | F14G16.66 | primer | 37689-38299 | Lan & Col |
| F14G16 | F14G16.49 | primer | 54150-54777 | Lan & Col |
| F14G16 | F14G16.32 | primer | 8172-8825 | Lan & Col |
| F14G16 | F14G16.66 | primer | 9445-10055 | Lan & Col |
| F14G16 | F14G16.16 | primer | 24251-24873 | Lan & Col |
| F14G16 | F14G16.01 | primer | 39801-40577 | Lan & Col |
| F28D6 | F28D6.42 | primer | 42565-43225 | Lan & Col |
| F28D6 | F28D6.50k | MARKER | 50323 | Col Dom |

FIG. 15B-1D

```
TGGTCGGGCATATTGTTTTCTTGTG    CGGCGCTGTCCCTGGTTCC
TTCCCCAAAAATCGTTCAGC         ACATCGCCTCTTCAACCCACTC
ACCCGAGAAGCCGATGACC          AAATTTGGGGAGTTTGATAAGTGTG
GCTAAGCCATCCAAGTTCTGAG       GTTTGAGTCTTTGGCTTTGTATGTTC
CGTGCAGGGAGTGTCGTG           CAATTTCAATCCCCGCTGGTC
CGCGGCTGCCTTCATGTATCTATC     GCCCATTTGTCGCCTTATTCTATTC
TTTTGGGATAGGGATTGAGTGTG      TAAGCGGAAGGAGAGGTTTGAAGTTG
TGCTGGCCTTTGTCATCTATTTGTC    CCGCGGGGACTGCCTACTC
CCAGAGCCGGGGAAAGCAATAC       TAGCCGGGGTGGTCTCGTCG
TGACTATAGGGGCGGTTGTGGTAAG    TTGGCTTGGAGTTTGCGTCGTC
ACTTTCTTCCTCAACGCACCTCACC    AACCCCTTGGCATATAACTCCGACTC
GTGGGGTCGAGTGGTGTGGTAG       GGATCCCCTGTACTTAAGCCTATTC
AAAATCCTCCCGCGTCAACATC       CATCATCCCAATCCCAAATACAAGTC
AAACTTTCGCCACTCTCCTCTATTATG  ATTTGCGTAAGGCGGTTGATGACTC
CGTCTTCATCGGCTTCGTTCAG       TGGGGAGCGGGCAATCTTCTTCCTCTC
AGCGATTGTACCCCACCATTC        GCTCCCGGCAATCTTAGGATTATTCGTAGTGTTC
ACTTTGGGCAGTTGCAGAGATGGTG    AACCCCTTAGGATTATTCGTAGTGTTC
TCTCGCAGTTGTACCCCACCATTC     TCCGCGAAGAGAAGAGTGATGG
AGCGATTGTACCCCACCATTC        GCTCGGCAATCTTCTTCCTCTC
TGGTGTATTTTGCTTTGTTTCTCAGG   GTTGTTCCGCTATGGGGCTAAGG
GTGCGAAATCTCGGGCTC           AATCACTCAACCGCGAAACTCTATC
ATCAACCCCAAATCACCAGAAAC      AATCGCGGTTAGCCACTTCATC
CGGCTGGCTTTATTATCTGAGTTG     TTCGGGAAGCCTGTGGAAG
```

*FIG. 15B-2D*

| | | | | |
|---|---|---|---|---|
| F28D6 | F28D6.58 | primer | 58994-59869 | Col Dom |
| F28D6 | F28D6.76 | primer | 76571-77289 | Lan & col |
| F28D6 | F28D6.93 | primer | 93823-94512 | Lan & Col |
| F28D6 | F28D6.120 | primer | 7985-8702 | Lan & Col |

FIG. 15B-1E

ACCCCGAGCTCAACTTCTTAGG
AGAATAGGAGCTGGGAGGTCAAAC
CCCCATCCTGCCGACATAAAG
GAGGGGCGAGTAGTTGAATCTGC

GGACGGGAGATGGGATTACC
ATACTTAGATGCAATGGGTGTGGTG
TACTCCGCATCATCTTCCATCTCTTC
CCTAAGCCCGAAACCAAGTGAG

FIG. 15B-2E

```
            AAGCTTCTTCTTGCTTCTCTCAAAGCTTTGATGGTGTAGCCGAAGTCCGTATGAGTCTTTGG
                     10        20        30        40        50        60
f12g6-1     AAGCTTCTTCCTGCTTCTCTCAAAACTTTGATGGTGTAGCCGAAGTCCGTATGAGGCTTTGG
f12g6-10    AAGCTTCTTGCTTCTCTCGAAGCTTTGATGGTGTAGCTGAACTTCGTATGAGTCTTTGA
f12g6-11    AAGCTTCTTCCTACTTCTCAAAGCTTTGGTGTGTAGAGCGAAGTCCGTATGAGTATTTGG
f12g6-12    --GCTTCTTGGTTCTCAAAACTTTGATGGTGTAGCCGAAGTC-GTATGAGTCTTTGG
f12g6-13    AAGCTTCTTCTTGCTTCTCGAAGCTTTGATGGTGTAGCTGAAGTCAGTATGAGTCTTTGA
f12g6-14    ------------CTTTGATGGTGTAGCCGAATTCCATATGATTCTTTGG
f12g6-15    AAGCTTCTTTTGCTTCTCCATAGCTTTGAAGGTGTAGCCGAAGTCCGTATGAGTCTTGGG
f12g6-16    AAGCTTCTTGCTTCTAAAAGCTTTGATGGTGTAGTAAAAGTTGTACGAGTCTTTGT
f12g6-17    --GCTTCTTTCTGGTTCTCGAAGCTTTGCTGTCGTGTTGCCATAGTTCTTATTGTCTTTTG
f12g6-18    AAGCTTCTTTTTGCTTCTCAAAAGCTTTGATAGTGTAGTCGAAGTCCATACGAGTCATTGG
f12g6-2     AAGCTTCTTTCTACTTCTCAAAGCTTTGCTGGTGTAGCTGAAGTCCGTATGAGTCTTTGG
f12g6-20    A-GCTTCTTGCTTCTCGAAGCTTTGATTGTGTAGCTGAAGTCAGTATGAGTCTTTGA
```

```
TTCTTATACTCAATCATATACACATGACATCTAGTCATATATTGACTCCAAAAACACTAAXX
              130           140           150           160           170
TTCTTATACTCAATCATACACATGACATCTAGTCATATATTGACTCGAAAACACTAACC    178
TTCTTATACTCAATCATACACATGACACGATATCTAGTCATATATTGACTCTAACTCCAAAACACTAA    176
TTCTTATACTCAATCATACACATGACATTAGTCTAGTCATATATTGAATCTCCAAAGTACTAACC    178
GTCTTATACTCTAATCATACACATGACACATGAAGTCATCTTTGACTCTCCAAAACA    169
TTCTTATTCTAAATCATAAACATGATATCTAGTCATATATTTACTCTCCAAAACACTAA    176
TTCTTATACTCAATCATACACATGCAATCTAGTCATATATTGATTCTCCAAAACACTAACC    155
GTCTTATACTCTAATCATACACATGACACATCAAGTCATTTTTGACTCTCCAAAACCACAAACC    171
TTCTTATACTCAATCATACGCATGCAATCTAGTCATATATTGACTTGACTCCAAAAGACTAA    176
TTCTTATACTCAATCATACACATGACATCTAGTCATATATTGACTCCAAAAACACTA    173
TTCTTATACTTAATCATACACATGACACATGACACATCTAGTCATATATTGACTCATATTTGACT    164
TTCTTATACTCAATCATACACATGACATTAGTCATCTAGTCATATATTGACTCCAAAACACAAACC    178
TTCTTATACTAATATAAACATGATATCTAGTCATATATTGACCTCAAAACACTAA    175
```

*FIG. 23A-3A*

```
f12g6-21  ----------------TTCTTCTTGCTTCTTCTCCAAGCTTTGATGGTGTAGCCCGAATTGCGTATGAATCTTTGG
f12g6-26  ----------------TTCTTCTTGCTTCTTCTCCAAGCTTTGATGGTGTAGCCCGAATTGCGTATGAATCTTTGG
f12g6-3   ----------------------TGCTTCTCAAAGCTTTGATGGTGTAGCCGTATCCAAAATTCGTATGAATCTTTGG
f12g6-30  ----------------TTCTTCTTGCTTCTTCTCCAAGCTTTGATGGTGTAGCCGTAGCCAAAGTCCGTATAAGTCTTTTA
f12g6-4   AAGCTTTTTTCTTGCTTCTTCTCCAAAGCTTTGATGGCGTAGCCCGAAATCTGTATGAATATTTGG
f12g6-5   AAGCTTTCTTCTTGCTTCTTCTCCAAAGCTTTGATGGTGTAGCCCAAAGTCCGTATGAGTCTTTGG
f12g6-6   AAGCTTTCTTCTCGTGCTCTCTCAAAGCTTTGATGGTGTA-CCGAAGTCCGTATGAGTCTTTGG
f12g6-7   AAGCATCTTCTTGCTTCTCAAAGCTTTGATGGTGTAGCAGAAGTCCGTATGAGTCATTGG
f12g6-8   AAGCTTCTTCTTGCTTCTCTAGAAGTTTGATGGTGTAGCAAAAATCTGTATGAGTCTTTGA
f12g6-9   AAGCTTCTTCTTGGTTCTCAACGCTTTGATGGTGTAGCTGAAGTCCGTATGAGTCTTTAA
f5a13-1   AAGCTTCTTTTATTGCTTCTCAAAGCTTTGATGGTGTAGCCAAAGTCTGTATGAGTCTTTGG
f5a13-2   ----CTTCTTATTGTTTCTCAAAGGTTTAGCTTGATGGTTAGTTAGCCGATGTCCGTATGAGTCTTTGC
f5a13-3   AAGCTTCTTATTGCTTCTCAAAGCTTTGATAGTGTAGCCGAAGTGTAGAGCCCGAAGTCCGTATGAGTCTTTGG
```

FIG. 23A-1B

```
CTTTCTATCTTCTAACAAGGAAACACTA-----GGCTAATATGGTCTAGTTGCGGTTCTAG
CTTTGTATCTTCTAACAAGGAAACACTA-----GGCTTTTAAGATCCGGTTGCGGTTCTAA
CTTTGCATCTTCTAACAAGGAAACACTACTTAGGCTTTACGATTCAGTTGCGGTTCTAG
CTTTGTATCTTCTAACAAGGAAACACTA----GGCTTTTAAGATCATGTTGCGATTCTAA
CTTTGTATCTTCATACAAGGAAACACTACTTAGGCTTTGAAGATCAGAATGTTGTTCTAG
CTTTCTATCTTCTAACAAGGAAACACTACTTAGGCTTTTAAGATTCGGTTACGGTTCTAA
CTTTGCATCTTCTAACAAGAAAAAACTA-TTAGGCTTTTACGATTCGGTTGCGCTTCTAG
ATTTGTATCTGCTAACAAGGATACACTACTTAGGCTTATAAGATCCGGTTTCGGTTATAG
ATTTGTATCTTTTAACAAGGAAACACTACTTAGGCTTTTAAGATCCATTGCAGTTCTAG
CTTTCTATCTTCTAACAAGGAAACACTACTTAGGCTTTAAGATCCGGTTGCGATTCTAG
CTTTCTATCTTCTAAGAACAAGGAAACATTAGTTAGTTCGGCTTTAGCTTTGGGAACCGGTTCTAC
CTTTCTATCTTCTAACAAGGAAACACTACTTAGCTTTAGCTTTTGGGAACCGGTTGCGGTTCTAC
CTTTGTATCTTCTAAAAGGAAACACTACTTAGCTTTAGCTTTAGCTTTGGGAACCGATTGCGGTTCTAC
CTTTGTATTTCTAATAAAGAAATACTGCTTTAGCTTTTGCGAACCAGTTGTGGTTCTAG
```

FIG. 23A-2B

```
TTCTTATACTCAATCATATACACATAACATCTAGTCATGTTTGACTCGAAAAACACTAACC      170
GTCTTATATTCAATCATCATCCACATGACATCATTTTGTCATATTTGACTCGAAAAACA       164
TTCTTATACTCAATCATACATCATACACATGACAT                               137
GTCTTATACTCAATCATACAAGACATCTTGTCATATTTGACT                        156
TTCTAATACTCAATCATCATGACATCTAGTCATATTTGACTCCATAACA                 172
GTCTTATACTTAATCATACACATGACATCAAGTCATTTTTGACTCCAAACCACAAACC        177
TTCTTATACTCAATCATACACATGACATCATTTAGTCATATTTGACTCCAAAACACTAACC     177
TTCTTATACTCAATCATACACATGCCATCATGTCATATTTGACTCCAAAACAC             173
TTCTTATACTCAATTATACACATGACATGATATAGTCATATTTGATTCCAAAACACTAA       176
TTCTTATACTCAATCATACACATGACATCTAGTCATATTCGATTCCAA                  168
TTCTTATACTCAATCATACACATGACATGAAATCTTGTCACATTTGACTCCAAAACACTAAC    177
TTCTTATACTTAATCATACACATGACATCTAGTCATCATATTTGACTCCAAAACAGTAACC     175
TTCTTATACTCAATCAGAAAACATGACATCTAGTCATATTTGACTCCAAAACA----CT       174
```

```
GCTTTGTATCTT--CTAACAAGGAAACACTACTTAGGCTTTTAA------G-ATCCGGTTGCGGTTTAA
         70            80            90           100           110           120           130
GCTTTGTATCTT--CTAACAAGGAAACACTACTAAGGCTTTTAA------G-ATCGGGTTGCGATTTAA
GCATTGTATCTT--CTAACAAGGAAACACTACGTAGGCTTTTAA------G-ATTGGGTTGCGGTTTAA
GCTTTGTGTCTT--CTAACAAGGATACAATTCTTACCGCTTTAA------G-ATACCATTATGGTTTAA
GCTTTGTGTCTT--CTAACAAGGATACAATTCTTACCGCTTTAA------G-ATACCATTATGGTTTAA
GGTTTTATTTT---CTAACAAGGAATCACTACTTAATCTTTTAATCTTTCAAGATCTGGTTGCGGTTCTA
-CTTTGTATCTT--CTAGCAAGGAAACACTACTTAAGGCTTTTG------GGATCTGGTTGCGGTTCTA
GTTTAAGATCTT--CTAACAAGGAAACACTACTATTTAAGCTTTT-----AGATCCCGTTGTGTTCTA
----ATCTT-----CTAAAAGGGAAAACACTACTTTAGCTTTTG------GGATCCAATTGCGGTTCTA
GGTTTGTATCTT--CTAACAAG-----------------------------------------------
GTTTTGGATCTT--CTAATATGGAAAACACTACTT----------------------------------
GCTTTGTATCTT--CTAACAAGGAAACACTACTTAGGCTTTTAA------G-ATCGAGTTGCGGTTTAA
GCTTTGTATCTT--CTAACAAGGAAACACTACTTAGGCTTTTAA------G-ATCGAGTTGCGGTTTAA
GCTTTGTATCTT--CTAACAAGGAAACACTACTTAGGCTTTTAA------G-ATCGGGTTGCGATTTAA
GCTTTGTATCTT--CTAACAAGGAAACACTACTTAGGCTTTTAA------G-ATCGGGTTGCGGTTTAA
GCTTTGTATCTT--CTAACAAGGAAACACTACTTAGGCTTTTAA------G-ATCGAGTTGCGGTGTAA
GCTTTGTATCTT--CTAACAAGGAAACACTACTTAGGCTTTTAA------G-ATCGGGTTGCGGTTTAA
GCTTTGTATCTT--CTAACAAGGATACAATTCTTAGGCTTTTAA------G-ATCCGATTGCGGTTTAA
GCTTTGTGTCTT--CTAACAAGGAAACACTACGTAGGCTTTTAA------G-ATCGGGTTGCGGTTTAA
--------------CTAACAAGGAAACACTACGTAGGCTTTTAA------G-ATTGGGTTGCGGTTTAA
GCATTGTATCTT--CTAACAAGGAAACACTACGTAGGCTTTTAA------G-ATCGGGTTGCGGTTTAA
GCTTTGTATCTT--ATAACAAGTAACACTACTTAGGCTTTTAA------G-ATCAGGTTGCAGTTTAA
```

```
GTTCTTATACTCAATCATACACATGACATCAAGTCAT--ATTCGACTCCAAAACACTAACC    178
        140       150       160       170       180       190
G-------ATACTCAATCATACACATGACATCAAGTCAT--ATTCGACTCCAAAACACTAACC    178
GTTCTTATACTTAATCATACACATGACATCAAGTCAT--ATTTGACTTCAAAACACTAACC    175
GTTCTTATACTCAATCATACACATGACATCAGTAGTCAT--ATTCTACTCCAAAACACTAACC    175
GTTCTTATACTCAATCATACACATGACATCAGTCTAGTCAT--ATTCTACTCCAAAACACTAACC    180
GTTCTTATACTCAATCATACACATTAGATCTAGTCAT--ATGTGACTCCAAAACACTA        115
GTTCTTATACTCATTCATTCATACATGACATCTAGTCAT--ATTTGACTCCAAAACACTA      151
GTTCGTATACTCAATCATACACGTGACATCTAGTCAT--ATTTGACTCCAAAACGCTAAC      112
GCTCTCATACTTAATCATACACTTGACATCTACTCAT---------ATTTGACTCCAAAACACTAACC    92
------------CAATCAT-----------------------------TACTT-------A      68
GTTCTTATACTCAATCATACACATTACATCAAGTCAT--ATTTGACTCCAAAACACTAAC     177
GTTCTTATACTCAATCATACACATTACATCAAGTCAT--ATTTGACTCCAAAACACTAAC     177
GTTTCTTATACTCAATCATACACATGACCTCAAGTCAT--ATTCGACTCCAAAACACTAACC   178
GTTTTTATACTCAATCATACACATGACATCAAAGTCAT--ATTCGACTCCAAAACACTAACC   178
GTTTTTATACTCAATCATACACATGACATCAAGTCAT--ATTCGACTCCAAAACACTAACC    178
GTTCTTATACTCAATCATACACATGACATGACATAGTCAT--ATTCTACTCCAAAACACTAACC  178
GTTCTTATACTTAATCATACACATGACATCAAGTCAT--ATTCGATTCCAAAACACTAACC    110
GTTCTTATACTCAATCATACACATGACATCAAGTCAT--ATTCGACTCCAAAACACTAACC    178
GTTCTTATACTCAATCATACACATGACATCAAGTCAT--ATTCGACTCCAAAACACTAACC    178
```

FIG. 23B-3A

```
t14c8-10  ----TTCTTCTTGCTTCTCAAATATTTGAAGGTGTAGCC-GAAATCCGTATGAGTCTTTG
t14c8-11  ----CTTCTTCTTGATTCTCAAAGCTTTCAAAGCTTTGATGGTGTAGTC-AAAGTCCGTAGGAGTCTTTG
t14c8-12  -------TTCTTGCTTCTCAAAGCTTTGATGGTGTAGCC-AAAGTCCAGATAAGTCTTTG
t14c8-13  AAGCTTCTTTTGCTTCTCAAATCTTTGATGGTGTGAAGAC-AAAGTCCGTATGAGTCTTTG
t14c8-14  AAGCTTCTTTTGCTTCTCAAACCTTTGATGGTGTAG-TCGAAGTCCTATGACTCTTTG
t14c8-15  AAGCTTCCTCTTGCTTCTCTGAAAGTTTGATGGTGTAGGT-GAAGTCCGTATGAGTGTTTG
t14c8-16  AAGCTTCTCTTGCTTCTCAAAGCTTTGATGGTGACATC-GAAGTCCGTATGAGTCTTTG
t14c8-17  AAGCTTCTTCTTGCTTCTCAAAGCTTTGATGGTGTAGCG-GAAATCCGTATGAGTCTTTG
t14c8-18  AAGCTTCTTCTTGCTTCTTTTCAAAGCTTTGATGGTGAAGCC-AAAGTCCGTATGAGTCTTTG
t14c8-19  AAGCTACTTCTTGCTTCTCATAGCTTTGATGGTGTAG-CCAAAGTCCGTATGAGTCTTTG
t14c8-2   AAGCTTCTTCTTGCTTCTCAAAGCTTTGATGGTGTAG-CCAAAGTCCGTATGAGTCTTTG
t14c8-20  ---CTTCTTATTGCTTCTCAAAGCTTTGATGGTGTAGCC-GAAGTCTTTATGAGTCTTTG
t14c8-21  AAGCTTCTTCTTACTTTTCAAAGCTTTGATGGTGTTAG-CCGAATTCCGTATGAGTCTTTG
t14c8-22  ----TTCTTTTTGCTTCTCAAAAACTTTGATGGTGCTGGTTTAG-CCGAAGTCCGTATGAGTCTTTG
t14c8-23  -------TTGCTTCTCAAAGCTTTGATGGTGTAGCC-GAAGTCTGTATGAGTCTTTG
t14c8-24  AAGCTTCTTCTTGCTTCTCAAAGCTTTGATAGTGGTGACGTC-GAAGTCCGTATGAGTCTTTG
t14c8-25  AAGCTTCTTCTTGCTTCTCAAAGCTTTGATGGTGTAGCT-GAAGTCCGTATGAGTACTTG
t14c8-26  AAGCTTCTTCTTACTTCCCAAAGCTTTGATGGTGTAG-CCCAAGTCCGTATGAGTCTTTG
t14c8-27  ---CTTCTTCTTGCTTCTCAAAAGCTTTCGATGGTGTAT-CCGAAGTCCGTATGAGTCTTTG
t14c8-29  AAGCTTCTTCTTTGTTCTTAAAGCATTGATGGTGAAGCC-AAAGTCCGTATGAGTCTTTG
t14c8-28  -------TTGCTTCTCAAAACTTTGATGGTGAAGCT-GAAGTCCGTATGAGCCTTTT
```

```
GTTTTATACTCAATCATCATACACATGATATATCAAGTCAT--ATTCGACTCCAAAACACTAACC   173
GATCTTATACTCAATCATCATACAACTGACATCTAGTTAT--ATTTGACTCCAAAATACTAACC   175
GTTCTTATACTTAATCATCATACACATGACATATTGTCAT--ATTTCAGTCCGAAACACTAAC.   170
GTTCTTATACTCAATCATCATACACATGACGTCTAGTCAT--ATCTGACCCCTAAACACTAACC   178
GTTCTTATACTCAATCATCATACACATGACATCTAGTCAT--ATTTGACTCCAAAACACTAACC   178
GTTCTTATACTCAATCATCATAGACATGACATCTAGTCAT--ATTTGACTGCAAAACAATAACC   178
GTTCTTATACTCAATCATACAAATGACATCTAGTCAT--ATTTGACTCCAAAATACTAACC   178
ATTCTTATACTCAACCATACATACACATGAAAATCTAGTCAT--ATTTGACTCCAAAACACTAACC   177
GTTCTTAGACTTAATCATAGACATGACATATAGTCAT--ATTTATCTCCAAAACACTAAC   177
GTTCTTATAATCAATCATCATACACATGACATCAAGTCATCATATTCGACTCCAAAACA   180
GTTCTTATACTCAATCATCATACACATGACATGACATCTAGTCAT--ATTTCATTCCAAAACACTAA   173
GTTCTTATACTCAATCATCATACACATGACATCTAGTCAT--ATTTGACTCCAAAATCACTAA   175
GTTCTTATACTCAATCATCATACACATGACATCTAGTCAT--ATTTGACTCCAAAGCACTAACC   174
GTTCTTATACAAAATCATACACATGACATCTAGTCAT--ATTTCATTCCAAAACACTAA   166
GTTGTCATACTCAATCATCATATATAACATCTAGTAGTCAT--ATTAACTCCAAAACACTAAC   177
GTTGTCATACTCAATCATCATACACATAACATCTAGTCAT--ATTTGACTCCAAAACACTAA   176
GTTCTTATACTCAATCATCATACACATGACATCTAGTCAT--ATTTGACTCCAAAACACTAACC   178
GTTCTCATACGCAATCAAATACATGACATCTAGTCAT--ATTTGACTCCAAAACACTAACC   175
GTTCTTATACTCAATCATTCATACACATGACATCACTCCAT--ATTTGACAATAAAACACTAACC   178
GATCTTATACTCAATCATCATACACATGACATCTAGTCAT--ATATGACTCCAAAACACTAACC   168
```

```
t14c8-3   AAGCTTCTTCTTACTTCTCAAAGCTTTGATGGTGTAGCC-CAAGTCCGTATGAGTCTTTG
t14c8-30  AAGCTTCTTTTTGCTTCTCAAAACTTTGATGGTGTAGCC-AAAGTCCGTATGAGTCTTTG
t14c8-31  AAGCTTCCTCTTGCTTCTCAAAGTTTTGATGGTGTAGCC-GAAGTCCGTATGAGTGTTTG
t14c8-32  AAGCTTCTTCTTGCTTCTCAAAGTTTTGAAGACGTAGCC-AAAATCTATATGAGTCTTTG
t14c8-33  AAGCTTCTTCTTGCTTCTCCCAAAGCTTTGATGGTATAG-TCGAAATCCGTAGAGTCTTTG
t14c8-34  AAGCTTCTTCTTGCTTCTCAAAGCTTTGATCGTGAAGCC-GAAGTCCGTATGAGTCTTTG
t14c8-35  AAGCTTCTTCTTGCTTCTCAAAGCTTTGATAGTGTAG-CTGAAGTCCGTATGAGTATTTG
t14c8-36  AAGCCTCTTCTTGCTTCTCAAAGCTTTGATGGTGAAG-CCAAAGTTCGTATAAATATTTG
t14c8-37  ---CTTCTTCGTGCTTCTCAAAGCTTTGATGGTGAAGCC-AAAGTTCGCATGAATATTTG
t14c8-38  AAGCTTCTTCGTGCTTCTCAAAGCTTTGATGGTGTTG-TCGAAGTCCGTAGGAGTCTTTG
t14c8-39  ---------------------------------------------------------
t14c8-4   AAGCTTCTTCTTGCTTCTCAAAGCTTTGATGGTGTAGCC-GAAATCCGTATGAGTCTTTG
t14c8-40  AAGCTTCTTGTGCTTCTCAAACCTTTGATGGGGTAG-TCGAAGTCCTTATGACTCTTTG
t14c8-41  --------TTG-----------------------------------------------
t14c8-42  AAG-------------------------------------------------------
t14c8-43  AAGCTTACTTCTTGCTTCTCATAGTTTTGATGGTGTAG-CCATAGTCCGTATGAGTGTTTG
t14c8-44  AAGCTTCTTCTTCTTAACTTTCTCAAAACTTTGATGGTGTTG-TCAAAATCTGTATGAGACTTTA
t14c8-45  ---------------------------------------TCCGTATGAGTCTTTG
t14c8-46  --GCTTCTTTTTGCTTCTCAAAAATTTGATGGTGATGGC-GAAGCCCGTATGAGTCTTTG
t14c8-47  AAGCTTCTTTTTACTTCTCAAAGCTTTGATGGTGTAG-CTGAAGTCCGTATGATTCTTTG
t14c8-48  A-------------------------------------------------GTCTTTG
```

*FIG. 23B-1C*

```
GCTTTGTATCTT---CTAACAAGGAAACACTACTTAGGCTTTTAA--------G-ATTCGGTTGCGGTTCTA
GCTTTCTATCTT---GTAATAAGGAAACACATTATTTAGGCTTTC-A-------AGATCTGGTTGCGATTCTA
GTTTTGTATCTT---CTAACAAGAAAACACTACTTAGGCTTTTTA---------AGATCTGATTGCGGTTCTA
GCATTGTATCTT---CTAACAAGAAAACGAAACACTACTA-GCTTTT-A-----AGATCCCGTTGCAGTTCTA
GATTTGTATCTT---CTAACAAGGAAACAGTGTTCTTAGGCTTTTAA-------G-ATTCGGCTGCG-TTCTA
GCTTTTATCTT---CTAACAAGAAAACTAATACTTAAGCTTCC-A---------AGATCCGGTTGCGGTTATA
GCTTTGTATATT---CTAACAAGAAAACATTACTTAGGCTTTTAA--------G-ATCCAGTATTGTTCTA
GCTTTGTATCTTCG--AACAAGGAAACACTCTTTAGGCTATTAA---------G-ATC-AGTTGCGGTTCTA
GCTTTGTATCTT---CTAACAAGGAAACACTACTTAGGCTTTC-A---------AGATCCGGTTGCGGTTCTT
GATTGGTATCTT---CTAACAAGGAAACATTACATAGGATTTTAA--------G-ATTAATTTGCGATTCTA
-CTTTGTATCTT---CTAACAAGGAAACAATACTTAGGCTTTC-A---------AGATCTGGTTGCGGTTCTA
GCTTTGTATCTT---CTAACAAGGAAACACTACTACTTAGGCTTTC-A------AGATCCGGTTGTGCGGTTCTA
GATTTTATCTT---CTAACATGGAAACATCACATAGGATTTAA----------G-ATTACTTTGTAGTTCTA
----TATATT---CTAACAAGGAAACACTACTTAGGCTTTC-A-----------AGATCCGGTTGCGATTCTA
GCTTTGTATCTTT---GACAAGGAAACACTACATAGGCTTTTAA----------G-ATCCGTTGCGGTTCTA
GTTTGTATCTT---CTAGCATGGAAACAAAACCTTAGCTTTTA-----------GGATCTAGTTGTGGTTCTA
GATTTGTATCTT---CTAACAAGGAAACACTACATAGGCTTTCAA--------ATCCGGTTGTGGTTCTA
----TGTATCTT---CTAGCATGGAAACACAACTTTAGCTTTTA----------GGATCTGGTTGTGGTTCTA
GCTTTCTATCTT---CTAACAAGGAAACACTACTTAGGCTTTC-A---------AGATCCAGTTGCAATTCTA
GCTTTGTATCTT---TAACAACGAAACATTACTTAGGCTTTTAA--------G-ATCCTGTTACGGTTCTA
GCTTTGTATCTT---CTAACAAGGAAACACTACTT-TGCTTTT-A---------AGATTTGGATGTGGTTCTA
```

FIG. 23B-2C

```
GTTCTTATACTCAATCATATACAAATGACATCTAGTCAT--ATTTGACTCCAAAATACTAACC  178
GTTCTTGATACTCAATCATACAGATGACATCTATTCAT--ATCTGACTCCAAAACACTAACC  178
GTTCTTATACTCAATCATAGACACATGACATCTAGTCAT--ATTTGACTGCAAAACAATAACC  179
GTTCTTATACTCAATAATACACATGACATCTAGTAAT--ATTTAACTCCAAAACACTAACC  177
GTTCTTACACTCAATCATGACATGATATCTAGTCAC--ATTTGACTCCAAAACACTAACC  177
GTTCTTATACTCAATCATCACATGACATATAGTCAT--ATTTCACTCCAAAACACTAAC  177
GTTCTTTTACTTAATCATACACATGAAACCTAGTCAT--ATTTGACTCCAAAACACTAAC  177
GTTCTTATACTCAATCATCACATGACATCTAGTCAT--ATTTGACTCCAAATCACTAACC  171
GTTATCATACTGAGTCATACACATGATATCTACTCAT--ATTTGACTCCAAAACACT  178
GTTCTTATACTCAATTATACACATGACATCTAGTCAT--ATTTGACTCCAAAACACTAACC  117
GTTCTTATAATTAATCATACACATGACATATTGTCAT--ATTTCACTCCAAAACACTAAC  178
GTTCTTATACTCAATCATCACATGACATCTAGTCAT--ATTTGACTCCAAATCACTAACC  178
GTTCTTATACTCAATCATCACATGACATCTAGTCAT--ATTTGACTCCAAAACACTAA  114
GTTCTTATACTCGAATCATCACATGACCTCTTGTCAT--ATCTGACTCCAAAACACTA  134
GTTCTTATACTCAATCATCACATGACATCTAGTCAT--ATTTGACTCCAAAAGACTAAC  177
GTTCTTATACTCAATCATCACATGACATCTAGTCAT--ATTTGACTCTAAAATAACTAACC  177
GTTTTTATAGTCAATCATAGACATCTAGTCAT--ATTTGACTCCAAAACACTAA  113
GTTTTTATACTCAATCATCACATGACATCTAGTCAT--ATCTGACTCCAAAATACTAACC  176
GTTATTATACTCAATCATACACATGACCCTCTTGTCAT--ATTTCACTCCAAATCACTAA  176
GTTCTTATACTCAATCATACACATGACATATACTCAT--ATTTGACTTCAAAACACTAACC  126
```

FIG. 23B-3C

```
t14c8-49  AAGCTTTTTTTGCTTCTCAACACTTTGATGGTGAAACC-GAAGTCCGTATGAGTCTTTG
t14c8-5   ---TT-------GCTTCTCAAAACTTTGATGGTGAAGCC-GAAGTCCGTATGAGTCTTTT
t14c8-50  -------------TTCTCAAAGCTTTGATGGTGTAG-CCGAAGTCCGTATGAGTCTTTG
t14c8-51  AAGCTTCTTCTGCTTTTCTCAAAGCTTTGATGGTGAAGCC-GAAGTCCGTATGAGTCTTTG
t14c8-52  AAGCTTCTTCTTACTTCTCAAAGCTTTGATGGTGGAG-CTGAAGTCCGTAGGAGTCGTG
t14c8-53  AAGCTTCTTCGTGCTTCTCACAGCTTTGATGGTGTCG-TCGAAGTCCGTATGAGTCTTTG
t14c8-54  ------------------------------------------------------------
t14c8-55  A-------------------------------------------------GTCTTTG
t14c8-56  AAGCTTCTTCTTGCTTCCCAAAGCTTCGATGATGTAG-CCGAAGTCCGTATGAGTCTTTG
t14c8-57  AAGCTTCTTCTTGCTTTTCAAAGATTTGATACTGAAG-CTGAAGTCTATATGAGTTTTTG
t14c8-58  --CTTCTTCTTCCTTTGCTTCTCAAAGCTTGATGGTGTAG-CCGAAGTTCATATGAGTCTTTG
t14c8-6   --CTTCTTCTTGCTTCTCAAAGCTTTGATGGTGATGGC-AAAGTCCGTATGAGTCTTTG
t14c8-7   --TTCTTCTTGCTTCTCAAAGCTTTGATGGTGTAGGC-AAAGTCCGTATGAGTCTTTG
t14c8-8   --TTCTTCTTGCTTCTCAAATCTTTGATGGTGTATCC-GAAATCCGTATGAGTCTTTG
t14c8-9   AAGCTTCTTCTTGCTTCTCAAAGCTTTGATGGTATAT-TCGAAATCCGTATGAGTCTTTG
t6c20-1   ---CTTCTTCTTGCTTCTCAAAGCTTCATGGTGAGTC-AAAGTCCGTATGAGTCTTTG
t6c20-10  ---CTTCTTCTTGCTTCTCAAAGCTTTCATGGTGAGCC-AAAGTCCATATGAGTCTTTG
t6c20-11  ---CTTCTTCTTGCTTCTCAAAGCTTTCATGGTGAGTC-AAAGTCCGTATGAGTCTTTG
t6c20-12  ---CTTCTTCTTGCTTCTCAAAGCTTTCATGGTGAGTC-AAAGTCCGTATGAGTCTTTG
t6c20-13  ---------------CTTTCATGGTGTAGCC-AAAGTCCGTATGAGTCTTTG
t6c20-14  ---CTTCTTGTTGCTTCTCAAAGCTTCCACGGTGTAGCC-AAAGTCCGTATGAGTCTTCG
```

```
GTTCTGATACTCAATCATATACACATGACATCTATTCAT--ACTTGACTCCAAAACACTAACC    178
GTTGTTATACTCAATCATACACATGACATGACATCAAGTCAT--ATATGACTCCAAAACACTAACC    168
GTTCTTATACTCAATCACACACATGACCTCTTGTCAT--ATTTGACTCCAAAACACTA    161
TTTCTTAGACTTAATCATATACATGACATATAGTCAT--ATTTATCTCCAAAACACTAAC    173
GTTCTTATACTCAATCATACACATGACCTTTTGTCAT--ATTTGACTCCAAAACACTA    174
GTTCTTATACTGGATCATAACCATGACATCTAAACAA--ATTTGAGTCCAAAACACTAACC    178
CTTCTTATAGTCAATCATAGACATGACATCTAGTCAT--ATTTGACTCCAAAACACTAA    113
GTTCTTTTACTCAATCAGACACACATGAAGTCTAGTCAT--ATTTGACTCCAAAACACTAACC    127
GTTCTTATACGCAATCAAATACATGATATCTAGTCAT--ATTTGACTCCAAAACTCTAACC    178
GTTCTTTTGCTCACCCATACACACATGAAATCTAGTCAT--ATTTGACTCCATAACACTAACC    178
GTTCTTATACTTAATCATAAAACATGAAATCTAGTCAG--ATTTGTCTCCAAA    166
GTTCTTATACTCAATCATCATCATCATAAATGACATCTAGTCAT--ATTTGACTCGAAAATACTAACC    175
GTTCTCATACTCAATCATTCATCATGACATCTACTCAT--ATTTAACTCTAAAACACTAACC    174
GTTCCGATACTCAATCATCATGACATGATATCAAGTCAT--ATTCAACTCCAAAACACTAACC    173
GTTCTTATACTCAATCATCATCATGACATGATATCTAATCAT--ATTTGACTCCAAAACACTAACC    178
GTTCTTATACTCAATCATCATCATGACATCAAGTCAT--ATTCGACTCCAAAACACTAACC    175
GTTATTTTTCTCAATCATCATCACATGACATCAAGTCAT--ATTCGACTCTAAAACACTAACC    175
GTTCTTATACTCAATCATTCACATGACATCAAGTCAT--ATTCGACTCCAAAACGCTAACC    175
GTTCTTATACTGAATCATACACATGACATCAAGTTAT--ATTCGACTCCAAAACACTAACC    175
GTTTTTATACTCAATCATACACATGACATCAAGTCAT--ATTCGACTCCAAAACACTAACC    155
GTTCTTATACTCAATCATACACACATGACATCAAGTCAT--ATTCGACTCCAAAACACTAAC    174
```

FIG. 23B-3D

| | | |
|---|---|---|
| t6c20-15 | ----------CTTCTTCTTGCTTCTTCTCAAAGCTTTCATGGTGTAA-CCAAAGTCCATATGAGTCTTTG | |
| t6c20-16 | AAGCTTCTCCTTGCTTCTTCTCAAAGCTTCAAAGCTTTGATGGTGTAGCC--GAAGTCTTTATGAGTCTTTG | |
| t6c20-17 | ----TTCTTCTTGCTTCTTCTCAAAGCTTTCATGATGTAGAG-GAAGTCCATATGAGTCTTTG | |
| t6c20-18 | ----CTTCTTGTTGCTTCTTCTCAAAGCTTTCACGGTGTAGCC--AAAGTCCATATGAGTCTTTG | |
| t6c20-19 | AAGCTTCTTCTAGCTTCTTCTCAAAGCTTTCATGGTGTATCC--AAAGTCCGTATGAGTCTTTG | |
| t6c20-2 | ----CTTCTTGCTTCTTCTCAAAGCTTTCACGGTGTAGCC--AAAGTCCATATGAGTCTTTG | |
| t6c20-20 | ----CTTCTTGCTTCTTCTCAAAGCTTTCATGGTGTAGCC--AAAGTCTATATGAGTCTTTG | |
| t6c20-21 | ----CTTCTTGTTGCTTCTTCTCAAAGCTTTCATGGTGTAGTC--AAAGTCCTTATGAGTCTTTG | |
| t6c20-22 | ----CTTCTTGTTGCTTCTTCTCAAAGCTTTCATGGTGTAGTC-AAAGTCCATATGAGTCTTTG | |
| t6c20-23 | ----CTTCTCTGCTTCTTCTCAAAGCGTTCATGGTGTAGC--AAAGTCCATATGAGTCTTTG | |
| t6c20-24 | ----CTTCTTGCTTCTTCTCAAAGCATTCATGGTGTAA--CCAAAGTCCATATGAGTCTTTG | |
| t6c20-25 | ----TTCTTCTTGCTTTTTAAAGCTTTCATGGTGTCGCC--AAAGTCCATATGAGTCTTTG | |
| t6c20-26 | ----CTTCTTGCTTCTTCTCAAAGCTTTCATGTTGTAGCC--AAAGTCCATATGAGTCTTAG | |
| t6c20-27 | ----CTTCTTGCTTCTTCTCAAAGCTTTCATGGTGTAG-CCAAAGTCCATATGAGTCTTTG | |
| t6c20-28 | ----CTTCTTGTTGCTTCTTCTCAAAGCTTTCATGGTGTAGCCCAAAGTCCATATGAGTCTTTG | |
| t6c20-29 | ----CTTCTTGCTTCTTCTCAAAGCTTTCATGGTGTAGCC--AAAGTCCATATGAGTCTTTG | |
| t6c20-3 | ----CTTCTTGCTTCTTCTCAAAGCTTTCATGGTGTAGTC--AAAGTCCATATGAGTCTTTG | |
| t6c20-30 | ----CTTCTTGCTTCTTCTCAAAGCTTTCATGGTGTAGCC--AAAGTCCATATGAGTCTTTG | |
| t6c20-31 | ----CTTCTTGCTTCTTCTCAAAGCTTTCACGGTGTAGCC--AAAGTCCATATGAGTCTTTG | |
| t6c20-32 | ----CTTCTTGCTTCTTCTCAAAGCTTTCATGGTGTAGTC--AAAGTCC----GAGTCTTTG | |
| t6c20-33 | ----CTTCTTGCTTCTTCTCAAAGCTTTCATGGTGTAGTC--AAAGTCC----GAGTCTTTG | |
| t6c20-34 | ----CTTCTTGCTTCTTCTAAAAGCTTTCATGGTATAG-CCAAATTCCATATGAGTCTTTG | |

FIG. 23B-1E

```
GCTTTGTGTCTT--CTAACAAGGAAACACTACTTAGGCTTTTAA------G-ATCGGGTTGCGGTTTAA
TCTTTGTATCTT--CTAACAATGAAACTTACTTTGGCTTTTAA------G-ATCCGGTTGCGGTTTAA
TCGTTGTATCTT--CTAACAAGGAAACACTACTTAGGCTTTTAG------G-ATAAAGTTGCGGTTTAA
CCTTTGTGTCTT--TTAACAAGGAAACACTACTTAGGCTTTTAA------G-ATAGGGTTGCGGTTTAA
GCTTTGTATCTT--CTAACAAGGAAACACTACTTAGGCTTTTAA------G-ATCGGGTTGCGGTTTAA
GCTTTGTGTCTT--CTAACAAGGAAACACTACTTAGGCTTTTAA------G-ATCGGGTTGCGGTTTAA
GCTTTGTGTCTT--CTAACAAGGAAACACTACTTAGGCTCTCTTAA----G-ATCGGGTTGCGGTTTAA
GCTTTGTATCTT--CTAACAAGGAAACACTACTTAGGCTTATAA-----G-ATCGGGTTGCGGTTTAA
GCTTTGTATCTT--CTAACAAGGAAACACTACTTAGGCTTTTAA------G-ATCGGGTTGCGGTTTAA
GCTTTGTGTCTT--CTAACAAGGAAACACTACTTAGGCTCTTAA-----G-ATCGGGTTGCGGTTTAA
GCTTTGTGTCTT--CTAACAAGGAAACACTACTTAGGCTTTTAA------G-ATCGGGTTGCAGTTTAA
GCTTTGTGTCTT--CTAACAAGGAAACACTACTTAGGCTTTTAA------G-ATCAACTTGCGGTTTAA
GCTTTGTGTCTT--TTAACAAGGATACAATTCTTACGCCTTAGG------G-ATCCGGTTGCGGTTTAA
GCTTTGTGTCTT--CTAACAAGGAAACACTACTTAGGCTTTTAA------G-ATCGAGTTGCGGTTTAA
GCTTTGTGTCTT--CTAACAAGGAAACACTACTTAGGCTTTTAA------G-ATCAGGTTGCGGTTTAA
GCTTTGTGTCTT--CTAACAAGGAAACACTACTTAGGCATTTAA------G-ATTAGGTTGGGGTTTAA
GCTTTGTATCTT--CTAACAAGGCAACACTACTGAGGCTTATAA-----G-ATCGGGTTGCGGTTTAA
GCTTTGTATCTT--CTAACAAGGAAACACTACTTAGGCTTTTAA------G-ATAGGGTTGCGGTTTAA
GCTTTGTATCTT--TTAACAAGGAAACACTACTTAGGCTTTTAA------G-ATCGGGATGCGGTTTAA
GCTTTGTATCTT--CTAACAAGGAAACACTACTTAGGCTTTTAA------G-ATCGGGATGCGGTTTAA
GCTTTGTGTCTT--CTAACAAGGATACAATTCTTACGCCTTTAA------G-ATCCGGTTGCGGTTTAA
```

FIG. 23B-2E

```
GTTCTTTATACTCAATCATACACATGACATCAAGTCAT--ATTC-ACTCCAAAACACTAACC      174
GTTCTTTATACTCAATCATACACATGACATCAAGTCAT--ATTCGACTCCAAAAACACTAACC    178
GTTCTTTATACGCAATCATACTCATGACATCAAGTCAT--ATTTGACTCCAAAACACTAACC     174
GTTGTTTATACTCAATCATACACATGACATCAAGTCAT--ATTCGACTCCAAAACACTAACC     174
GTTTTTTATACTCAATCATACACATGCGCATCAAGTCGT--ATTCGACTCCAAAACACTAAC     178
GTTGTTTATACTCAATCATACACATGACATCAAAAGTCAT--ATTCGACTCCAAAACACTAACC   174
GTTGTTTTTCTCAATCATACACATGACATCAAGTCAT--ATTCGACTCCAAAACACTAAC       175
GTTCTTTATACTCAATCATACACATGACATCAAGTCAT--ATTCGACTCCAAAACACTAACC     175
TTTCTTTATACTCAATCATACACATGACATCAAGTCAT--ATTCGACTCCTAAAACACTAACC    175
TTTGTTTATACTCAATCATACACATGACATCAAGTCAT--ATTCGACTCCTAAACACTAACC     175
GTTGTTTTTCTCAATCATACACATGACATCAAGTCAT--ATTCGACTCCAAAACACTAACC      175
GTTCTTTATACTCAATCATACACATGACATCAAGTCAT--ATTC-ACTCCAAAACACTAACC     174
GTTCTTTATACTCAATCATACACATGACATCAAGTCAT--ATTCGACTCCAAAACACTAACC     174
GTTGTTTATACTCAATCATACACAGACAAGACATCAAGTCAT--ATTCGACTCCAAAACACTAACC 175
GTTCTTTATACTCAATCATACACGACATGACATCAAGTCAT--ATTCGACTCCAAAACACTAACC  175
GTTCTTTATACTCAATCATACACATGACATCAAGTCAT--ATTCGACTCCAAAACACTAACC     176
GTTGTTTATACTCAATCATACACATGACATCAAGTCCT--ATTCGACTC                  162
GTTCTTTATACTCAATCATACACATGACATCAAGTCAT--ATTCGACTCCAAAACACTAACC     175
GTTCTTTATACTCAATTATACACATGACATCACACTAAGTCAT--ATTCGACTCCAAAACAATAAC 174
GTTCTTTATACTCAATCATACACATGACATCAAGTCAT--ATTC                       157
GTTCTTTATACTCAATCATACACATGACATCAAGTCAT--ATTCGACTCCAAAACGCTAACC     171
GTTCTTTATACTCAATCATACACATGACATCAAGTCAT--ATTCGACTCCAAAACGCTAACC     171
GTTCTTTATACTCAATCATACACATGACATCAAGTCAT--ATTCGACTCCAAACCACTAACC     175
```

FIG. 23B-3E

```
t6c20-35    ---CTTCTTCTTGCTTCTCTCAAAGCTTTCATGGTGTAGCC-AAAGTCCATATGAGTCTTTG
t6c20-36    ---CTTCTTTTTGCTTCTCTCAAAGCTTTCATGGTGTAGCC-AAAGCCCATATGAGTCTTTG
t6c20-37    ---CTTCTTCTTGCTTCCTCTCAAAGCTTTCATGGTGTAG-CCAAATTCCATATGAGTCTTTG
t6c20-38    ---CTTCTTCTTGCTTCTCTCAAAGCTTTCATGGTGTAG-CCAAAGTCCATATGAGA-TTTG
t6c20-39    ---CTTCTTCTTGCTTCTCTCAAAGCTTTCATGGTGTAA-CCAAAGTCCATATGAGTCTTTG
t6c20-4     ---CTTCTTCTTGCTTCTCTCAAAGCTTTCATGGTGTAGCC-AAAGTCCATATGAGTCTTTG
t6c20-40    ---CTTCTTCTTGCTTCTCTCAAAGCTTTCATGGTGTAA-CCAAAGTCCATATGAGTCTTTG
t6c20-41    ---CTTCTTTCTTGCTTCTCTCAAAGCTTTCATGGTGTAGC-CAAAGTCCATATGAGTCTTTG
t6c20-42    ---TTCTTCTTTCTTTTAAAGCTTTCATGGTGTAGGC-AAAGTCCATATGAGTCTTTG
t6c20-43    ---TTCTTCTTTTTTTTAAAGCTTTCATGGTGTAGCC-AAAGTCCATATGAGTCTTTG
t6c20-44    ---TCTTCTTTGCTTCTCTCAAAGCTTTCATGGTGTAGCC-AAAGTCCATATGAGTCTTTG
t6c20-45    ---TTCTTCTTTTTTAAAGCTTTCATGGTGTAGGC-AAAGTCCATATGAGTCTTTG
t6c20-46    ---TTCTTCTTTTTTAAAGCTTTCATGGTGTAGGC-AAAGTCCATATGAGTCTTTG
t6c20-47    ---CTTCTTCTTGCTTCTCTCAAAGCTTTCATGGTGTAA-CCAAAGTCCATATGAGTCTTTG
t6c20-48    ---CTTCTTCTTGCTTCTCTCAAAGCTTTCATGGTGTAG-CCAAAGTCGATATGAGTCTTTG
t6c20-49    ---CTTCTTCTTGCTTCTCTCAAAGCTTTCATGGTGTAG-CCTAAGTCCATATGAGTCTTTG
t6c20-5     ---CTTCTTCTTGCTTCTCTCAAAGCTTTCATGGTGTAGCC-AAAGTCCATATGAGTCTTTG
t6c20-50    ---CTTCTTCTTGCTTCTCTCAAAGCTTTCATGGTGTAG-CCTAAGTCCATATGAATCTTTG
t6c20-51    ---CTTCTTCTTGCTTCTCTCAAGGCTTTCATGGTGTAGTC-AAAATCCGTATGAATCTTTG
t6c20-52    ---CTTCTTCTTGCTTCTCTCAAAGCTTTCATGGTGTAA-CCAAAGTCCATATGAGTCTTTG
t6c20-53    ---CTTCTTCTTGCTTCTCTCAAAGCTTTCATGGTGTAA-CCAAAGTCCATATGAGTCTTTG
t6c20-54    ---CTTCTTCTTGCTTCTCTCAAAGCTTTCATGGTGTAR-CCAAAKTCCATATRAGTCTTTG
```

FIG. 23B-1F

```
GCTTTGTGTCTT---CTAACAAGGAAACATTACTTAGGTTTTTAA-------G--ATCAGCTTGCGGTTTGA
GCTTTGTGTCTT---CTAACAAGGAAACATTATTTAGGCTTTTAA-------G--ATCGGGTTACGGTTTAA
TCTTTGTGTCTT---CTAACAAGGATACAATTCTTACTCCTTAA-------G--ATCCGGTTGCGGTTTAA
GCTTTGTGTCTT---CTAACAAGGCAAACACTACTTAGGCTTATAA-----G--ATCGGGTTGCGGTTTAA
GTTTGTGTCTT----CTAACAAGGAAACACTACTTAGGCTTTTAA------G--ATCGGGTTGCGGTTAAA
GCTTTGTGTCTT---CTCACAAGGAAACACTACTTAGGCTTTTAA------G--ATCGGGTTGCGTTTTAA
GCTTTGTGTCTT---CTAACAAGGAAACACTACTTAGGCATTTAA------G--ATCGGGTTGCAGTTTAA
GCTTTGTGTCTT---CTAACAAGGAAACACTACTTAGGCTTTTAA------G--ATCGGGTTGCGGTAAAA
GCTTTGTGTCTT---CTAACAAGGAAACACTACTTAGGCTTTTAA------G--ATCAGATTGCGGTTTAA
GCTTTGTGTCTT---CTAACAAGGAAACACTACTTAGGCTTTTAA------G--ATCAGGTTGCTGTTTAA
GCTTTGTGTCTT---CTAACAAGGAAACACTACTTAGGCTCTCTTAA----G--ATCGGGTTGCGGTTTAA
GCTTTGTGTCTT---CTAACAAGGAAACACTACTTAGGCATTTAA------G--ATCAGGTTGCGGTTTAA
GCTTTGTGTCTT---CTAACAAGGATTCAATTCTTACGCCCTTAA------G--ATCAGGTTGCTGTTTAA
GCTTTGTGTCTT---CTAATAAGGATTCAATTCTTACGCCTTTTAA-----G--ATCGGGTTGCGGTAAAA
GCTTTGTGTCTT---CTAATAAGGAAACACTACTTAGGCTTTTAA------G--ATCCGGTTGCGGTTTAA
GCTTTGTGTCTT---CTAACAAGGAAACACTACTTAGGCTTATAA-----G--ATCAGCTTGCGGTTTAA
GCTTTGTATCTT---CTAACAAGGAAACACTACTTAGGCATTTAA------G--ATCCGGTTGTGGTTTAA
GCTTTGTGTTTT---CTAACAAGGAAACACTACTTAGGCATTTAA------G--ATTGGGTTGCAGTTTAA
GCTTTGTGTCTT---CTAACAAGGAAACACTACTTAGGCATTTAA------G--ATCGGGTTGTAGTTTAA
GCTTTGTGTCTT---CTAACAAGGATACAATTCTTACGCCTTTAA------G--ATCCAGTTGCGGTTTAA
```

FIG. 23B-2F

```
GTTGTTATACTCAATCACACACATGACAACAAGTCAT--ATTCGACTCCAAAACACTAACC    175
GTTGTTATACTCAATCATACACATGACAACAAGTCAT--ATTCGACTCCAAAACACTAACC    175
GTTCTTTACTCAATCATACACATGACATCAAGTCAT--ATTCGACTCCAAAACACTAAC      174
GTTCTTATACTCAATCATACACATGACATCAAGTCAT--ATTCGACTCCAAAACACTAACC    174
ATTCTTATACTCAATCATACACATGACATGAGATCAAGTCAT--ATTC-ACTCCAAAACACTAACC  174
GTTCTTATACTCAATCATACACATGACATCAAGTCAT--ATTCGACTCCAAAACACTAACC    175
GTTCTTATACTCAATCATACACATGACATCAAGTCAT--ATTC-ACTCTAAAACACTAACC    174
ATTCTTATACTCAATCATACACATGAGATCAAGTCAT--ATTC-ACTCCAAAACACTAACC    174
GTTGTTATACTCAATCATACACATGACATGACAAGTCCT--ATTCGACTCCAAA           165
GTTGTTATACTCAATCATACACATGACATCAAGTCCT--ATTCGACTCCAAA             165
GTTGTTTTCTCAATCATACATATGACATCAAGTAAT--ATTCGACTCAAAAACACTAACC     173
GTTGTTATACTCAATCATACACATGACATCAAGTCCT--ATTCGACTCCAAA             165
GTTGTTATACTCAATCATACACATGACATCAAGTCCT--ATTCGACTCCAAA             165
ATTCTTATACTCAATCATACACATGACATCAAGTCAT--ATTC-ACTCCAAAACACTAA      172
GTTCTTATACTCAATCATACACATGACATCAAGTCAT--ATTCGACTCCAAAACACTAACC    175
GTTCTTATACTCAATCATACACATGACATCAAGTCAT--ATTCGACTCCAAAACACTAACC    175
GTTCTTATACTCAATCATACACATGACATCAAGTCAT--ATTCGACTCCAAACAACTAACC    175
GTTCTTATACTCAATCATACACATGACATCAAGTCAT--ATTCGACTCCAAAACACTAACC    175
GTTCTTATACTCAATCATACACATGACATCAAGTCAT--ATTCGACTCCAAAACACTAACC    175
GTTCTTATACTCAATCATACACATGGCATCAAGTCAT--ATTC-ACTCTAAAACACTAACC    174
GTTCTTATACTCAATCATACACGACACATCAAGTCAT--ATTCGACTCCAAAACACTAACC    175
```

*FIG. 23B-3F*

```
t6c20-55   ----------CTTCTTCTTGCTTCTCTCAAAGCTTTCATGGTGTAG-CCCAAGTCCATATGAGTCTTTG
t6c20-56   ----------CTTCATCTTGCTTCTCTCAAGGCTTTCATGGTGTAGCC-AAAATCCGTATGAATCTTTG
t6c20-57   ----------CTTCTTCTTGCTTCTCAAAGCTTTCATGGTGTAG-CCAAATTCCATATGAGTCTTTG
t6c20-58   ------------------CTTTCATGGTGTAGGC-AAAGTCCATATGAGTCTATG
t6c20-59   ----------CTTCTTCTTGCTTCTGAAAGCTTTCATGGTGTAG-CCAAAGTCTATATGTGTCTTTG
t6c20-6    ----------CTTCTTTTGCTTCTCTCAAAGCTTTCATGGTGTAGCC-AAAGCCCATATGAGTCTTTG
t6c20-60   ----------CTTCTTCTTGCTTCTCTGAAAGCTTTCATGGTGTAG-CCAAAGTCTATATGTGTCTTTG
t6c20-61   ----------CTTCTTCTTGCATCTGAAAGCTTTCATGGTGTAG-CCAAAGTCTATATGAGTCTTTG
t6c20-62   ----------CTTCTTCTTGCATCTGAAAGCTTTCATGGTGTAG-CCAAAGTCTATATGAGTCTTTG
t6c20-63   ----------CTTCTTCTTGCTTCTCAAAGCTTTCATGGTGG-CCAAAGTCTATATGAGTCTTTG
t6c20-64   ----------CTTCTTCTTGCATCTGAAAGCTTTCATGGTGTAG-CCAAAGTCTATATGAGTCTTTG
t6c20-65   ----------CTTCTTCTTGCTTCTCATGTATTTCATGGTGTAGTC-AAAATCCGTATGAATCTTTG
t6c20-66   ----------CTTCTTCTTCTTGCTTCTCAATGATTTCATGGTGTAA-CCAAGTCCATATGAGTCTTTG
t6c20-67   ----------CTTCTTCTTGCTTCTCAAGGCTTTCACGGTGTAGTC-AAAATCCGTATGAATCTTTG
t6c20-68   ----------CTTCTTCTTGCTTATCAAAGCTTTCATGGTGTAG-CCAAAGTCCATATGAGTCTTTG
t6c20-69   ----------------------------------TCCATATGAGTCTTTG
t6c20-7    ----------CTTCTTCTTGCTTCTCTCAAAGCTTTCATGGTGTAGCC-AAAGTCCATATGAGTCTTTG
t6c20-70   ----------CTTCTTCTTGCTTCTCTCAAAGCTTTCATGGTGTAG-CCAAAGTCCGTATGATTCTTTG
t6c20-71   ------TT--------CTGAAAGCTTTCTCAAAGCTTTCATGGTGTAG-CCAAAGTCTATATGAGTCTTTG
t6c20-8    AAGCTTCTTGCTTCTCAAAGCTTTGATGGTGTAGCC-AAAGTCGTATGAGTCTTTG
t6c20-9    AAGCTTCTTTTAGCTTCTCAAAGCTTTCATGGTGTAGCC-AATGTCCGTATGAGTCTTTG
```

*FIG. 23B-1G*

```
GCTTTGTGTCTT--CTAACAAGGATACAATTCTTACGCCTTTAA-------G-ATCCAGATGCGGTTTAA
GCTTTGTGTATCTT--CTAAGAAGGAAACACTACTTAGGCTTATAA-----G-ATCGGGTTGCGGTTTAA
GCTTTGTGTCTT--CTAACAAGGATACAATTCTTACGCCTTTAA-------G-ATCCAGTTGCGGTTTAA
GCTTTGTGTCTT--CTAACAAGGAAACACTACTTAGGCTTTTAA------G-ATCCAGGTTGCGGTTTAA
GCTTTGTGTCTT--CTAACWCGGAAACACTACTTAGGCTTTTAA------G-ATCAGGTTGCGGTTTAA
GCTTTGTGTCTT--CTAACAAGGAAACACTACTTAGGCTTATAA------G-ATTGGGTTGCGGTTTAA
GCTTTGTGTCTT--CTAACTCGGAAACACTACTTAGGCTTTTAA------G-ATCAGGTTGCGGTTTAA
GCTTGGTGTCTT--CTAACACGGAAACACTACTTAGGCTTTTAA------G-ATCAGGTTGCGGTTTAA
GCTTTGTGTCTT--CTAACACGGAAACACAGTACTTAGGCTTTTAA----G-ATTAGGTTGCGGTTTAA
GCTTTGTGTCTT--CTAACACGGAAACACTACTTAGGCTTTTAA------G-ATCAGGTTGCAGTTTAA
GCTTGGTGTCTT--CTAACACGGAAACACTACTTAGGCTTTTAA------G-ATTAGGTTGCGGTTTAA
GCTTGGTGTCTT--CTAACAAGGAAACACTACTTAGGCTTTTAA------G-ATTAGGTTGCGGTTTAA
GCTTTGTATCTT--CTAACAAGGAAACACTACTTAGGCTTTTAA------G-ATCGGGTTGCGGTTTAA
GCTTTGTATGTT--CTAACAAGGAAACACTACTTAGGCTTTTAA------G-ATCGGGTTGCGGTTAAA
GCTTTGTATCTT--CTAACAAGGAAACACTACTTAGGCTTTATAA-----G-AT-----TTGCGGTTTAA
GCTTTGTGTCTT--CTAACAAGGAAACACTACTTAGGCCTTTAA------G-ATCCGGTTGCTGTTTAA
TCTTTGTGTCTT--CTAATAAGGATACAATTCTTACTCCTTTAA------G-ATCCGGTTGCGGTTTAA
GCTTTGTGTCTT--CTAACAAGGATACAATTCTTACGGCTTTTAA-----G-ATCAGCTTGCGGTTTAA
GCTTTGTGTCTT--CTAACACGGTAACACTACTTAGGCTTTTA-------AGATCGGGTTGCGGTTTAA
GCTTTGTGTCTT--CCAACAAGGAAACACTACTTAGGCTTTTAA------GGATAAAGTTGTGGTTTAA
TATTTGTATCTT--CTAACAAGGAAACACTACTTAGGCTTTTAA------G-ATCGAGTTGCGGTTTAA
```

*FIG. 23B-2G*

```
GTTCTTATACTCAATCATACACGACATCAAGTCAT--ATTCGACTCCAAAACACTAACC      175
GTTCTTATACTCAATCATACACGACATGACATTAAGTCAT--ATTCGACTCCAAAACAACTAACC  175
GTTCTTATACTCAATCATACACGACATGACATCAAGTCAT--ATTCGACTCCAAAACACTAACC   175
GTTGTTATACTCAATCATACACGACATGACATCAAGTCCT--ATTCAACTCCAAAACACTAACC   146
GTTCTTATACTCAATCATACACGACATGACATCAAGTCAT--ATTCGACTCCAAA           175
GTTGTTATAATGAATCTTACACGACAACAAGTCAT--ATTTGACTCCAAAACACTAACC        175
GTTCTTATACTCAATCATACACATGACATCAAGTCAT--ATTCGACTCCAAAACACTAACC      175
GTTGTTATACTCAATCATACACATGACAACAAGTCAT--ATTGACTCCAAAACACTAACC       175
GTTGTTATAATGAATCTTACACATGACAACAAGTCAT--ATTTGACTCCAAAACACTAACC      175
GTTGTTATAATGAATCTTACACATGACAACAAGTCAT--ATTTGACTCCAAAACACTAACC      175
GTTGTTATAATGAATCTTACACATGACAACAAGTCAT--ATTGACTCCAAAACACTAACC       175
GTTGTTATAATGAATCTTACACATGACAACAAGTCAT--ATTTGACTCCAAAACACTAACC      175
GTTCTTATACTCAATCATACACATGACATCAAGTCAT--ATTCGACGCCAAA               166
ATTCTTATACTCAATCATACACATGACATCAAGTCAT--ATTC-ACTCCAAAACACTAACC      174
GTTCTTATACTCAATCATACACATGACATCAAGTCAT--ATTCGACTCTAAACCACTAACC      171
GTTCTTATATTCAATCATACACATGACATCAAGTCAT--ATTCGACTCACAACACTAACC       175
GTTCTTTTACTCAATCATACACATGACATCAAGTCAT--ATTCGACTCCAAAACACTAAC       134
GTTGTTATACTCAATCATACACATGACATGACATCAAGTCAT--ATTCGACTCCAAAACACTAACC 175
GTTCTAATACTCAATCATACACATGACATTAAGTCAT--ATTC-ACTCCAAAACACTAACC      175
GTTCTTATAATGAATCTTACACATGGCATCAAGTCAT--ATTCGACTCAAAACACTAACC       163
GTTCTTATACTCAATCATACACATGACATCAAGTCAT--ATTCGACTCCAAAACACTAACC      179
GTTCTTATACTCAATCATACACATGACATCAAGTCAT--ATTCGACTCCAAAACACTAACC      178
```

FIG. 23B-3G

```
                     10        20        30        40        50        60
t25f15-1   ---------- ---------- ---------- ---------- CTTCTTCTTGCTTCTCAAAGCTTTGATGGTGTAGCCAAAGTCCGTATGAGTCTTTGG
t25f15-10  ---------- CTTCTTCTTGCTTCTCAAAGCTTTCATGGTGTAGCCAAAGTCCATATGAGTCTTTGA
t25f15-11  ---------- CTTCTTCTTGCTTCTCAAAGCTTTCATGGTGTAGCCAAAGTCCATATGAGTCTTTGG
t25f15-12  ---------- CTTCTTCTTGCTTCTCATAGCTTTCATGGCGTAGCCAAAGTCCATATGAGTCTTTGG
t25f15-13  ---------- CTTCTTCTTGCTTCTCAAAGCTTTTATGGTGTAGCCAAAGTCCACATGAGTCTTTGG
t25f15-14  AAGCTTCTTCTTGCTTCTCACAAAGCTTTGATGGTGTAGCTAAAGTCCGCATGAGTCTTTGG
t25f15-15  AAGCTTCTTCTTGCTTCTCAAAGCTTTCAAAGCTTTGATGGTGTTAACCAAAGTCCGTATGAGAATTGG
t25f15-16  AAGCTTCTTCTTGCTTCTCACAAAGCTTTGATGGTGTAGCGAAAGTCCGTATGATTCATTGG
t25f15-17  AAGCTTTTTCTTGCTTCTCTCAAAGCTTTAATGGTGTAACCAAAGTCCGTATGAATGTTTGG
t25f15-18  ---GCTTCTTCTTGCTTCTCCCAAAGTTTTGATGGTGTACCCAAAGTCCGTATGAGTCTTTGT
t25f15-19  ---------- ---------- ---------- --CCAAAGTCCACATGAGTCTTTAG
t25f15-2   ---------- CTTCTTCTTGCTTCTCAAAGCTTTCATCGTGTAGCCAAAGTCCGTATGAGTCTTTGG
t25f15-20  ---------- CTTCTTCTTGATTCTCAAAGCTTTTGATGGTGTAGCCAAAGTCCGTATGAGTCTTTGG
t25f15-21  AAGCTTCTTCTTGCTTCTCAAAGTTTGATGGTGTACCCAAAGTCCGTATGAGTCTTTGT
t25f15-22  ---TCTTCTTGCTTCTCGCAAAGTTTGTTGGTGTAGCTGAAGTCCGAAGTCCGTATGAGTCTTTGG
t25f15-23  AAGCTTCTTCTTGCTTCTCGAAACTTTGTTGGTGTAGCTGAAGTCCGAAGTCCGTATGAGTCTTTGG
t25f15-24  ---TTCTTCTTGCTTCTTAAAGTTTTAATGTGTAATCAAAATCTATGAGTCTTTGG
t25f15-25  ---------- ---------- ---------- TTGATGGTGTAGCCGAAGTCCGAAGTCCGTATGAGTATTGG
t25f15-26  AAGCTTCTTCTTGCTTTCAAAGCTTTCAAAGCTTTGATAGTGTAGCCAAAGTCCGTATGAGTATTGG
t25f15-27  AAGCTTCTTCTTGCTTTCACAAAGCTTTAATGGTGTAACCAAAGTCCGTATGAATGTTTGG
```

FIG. 23C-1A

```
CTTTGTATCTTCTAACAAGGAAACACTACTTAGGCTTTTAAGATCC--GGTTGCGGTTCTAGTTCTTATAC
         70        80        90       100       110       120       130
CTTTGTGTCTTCTAACAAGGATACACTACTTAGGCTTACAAGATCG--GGTTGYGGTTTAAGTTSTTATAC
CTTTGTGTCTTCTAATAAGGATACACTACTTAGGCTTACGCCCTTTAAGATCC--GGTTGCGGTTTAAGTTCTTATAC
CTTTGTGTCTTCTAACAATTCTTACGCCTTTTAAGATCG--GCTTGCGGTTTAAGTTCTTACAC
CTTTGTGTCTTCTAACAAGGACACACAATTCTTACGCCTTTTAAGATCC--GGTTGCGGTTTAAGTTCTTATAC
CTTTGTGTCTTCTAACAAGGAAACACTACTTAGGCTTTTAAGATCC--GGTTGTGGTTCTAGTTCTTATAC
CTTTGTATCTTCTAACAAGGAAACACTACTTGGGCTTTCAAGATCT--GGTTGTAGTTCGAGTTTTATAC
CTTTGTATCTTCTAACAAGGAAACACTACTTAGGCTTTTAAGATCC--GGTTGCAATTCTCGTCCTTATAC
CTTTGTATCTTCTAAAAACAAATACTACTTAGGCTTTTAAGATCC--GGTTGCGGTTCTAGTTCTTATAC
CTTTGTATCTTCTAACAAGGAAACACTACTTAGGATTTTAAGATCG--GGTTACAGTTCTAGTTTTTATAC
CTTTGTACCTTCTAACAAGGAAACACTACTTGGACTTTCAAGATCC--GGTTGCGGTTCGAGTTCTTATAC
ATTTGTATCTTCTAATAAGGAAACACTACTAATTGGGTTTTAAGATCC--GGTTGTGGTTCTAGTTCTTATAC
CTTTGTGTCTTCTAACAAGGAAACACTACTTGGGCCCTTTAAGATCC--GGTTGCGGTTTAAGTTCTTATAC
CTTTGTATCTTCTAACAAGGAAACACTACTTGGGCATTCAAGATCC--GATTGCGGTTGAGTATTATAC
ATTTGTATCTTCTAACAAGGAAACACTACTTGGGCTTCAAGATCC--GGTTGTGGTT--GAGTTCCTATAC
CTTTGTATCTTCTAACAAGGAAACACTACTAAGGCTTTTAAGATCG--GGTTGCAGTTCCAGTTTTTATAC
-TTTGTATCTTCTAACAAGGAAACACTACTTAGGCTTTTAAGATCT--GGTAGTGGTTCTAGTTCTTATAC
CTTTGTATCTTCTAACAAGGAAACACTACTTGGGCTTTCAAGATCT--GGTTACGGTTCTAGTTTTTATAC
CTTTGTATCTTCTAACAAAACAAACACTAGTTGGGCTTTCAAGATCC--GGTTGCGATTTGAGTTTTTATAC
CTTTGTATCTTCTAAA------TACTACTTAGGCTTTTAAGATCC--GGTTGCGGTTCTAGTTCTTATAC
```

FIG. 23C-2A

```
                     140            150            160            170            180
TC-AATCATACACATGACACATCAAGTCATATTTGACTCCAAAACACTAACC
TC-AATCATACACATGACACATCAAGTCATATTCGACTCCAAAAACACTAACC  175
TC-AATCATACACATGACACATCAAGTCATATTCGACTCCAAAAACACTAACC  175
TC-AATCATACACATGACACATCAAGTCATATTCGACTTTAAAACACTAACC   175
TC-AATCATACACATGACACATCAAGTCATAATCGACTCCAAAACACTAACC   175
TC-AATCGTACACATGACACATCAAGTCATATTTGACTTTAAAACACTAACC   177
TC-AATAATACACATGACACATCAAGTCATATTTGACTCTAAAACACTAAC    178
TA-AATCATAGACATGCCATCTTGTCATATTTGACTCCAAAACACTAACC     178
TCCA-TCATACACATGACACATCAAGTCATATTTGATTCCAAAACATTAACC   178
CC-AATCATACACATGACACATCAAGTCATATTTGACTCGAAAACACTAACC   178
TCAA-TCATACACATGAAATCTAGTCATATTTGACTCCAAAACAATAACC     176
TC-AATCATACACATGTCATCTAGTCATATTTGTCTCCAAAACACTAAC      140
TC-AATCATACACATGACACATCAAGTCATATTCGACTCTAAAACACTAAC    175
TC-AATCATACACATGACACATCAAGTCATATTCGACTCCAAAACACTAACC   175
TC-AATCATACACATGTCATCTAGTCATATTTGACTTTCCAAAACAATAACC   177
TC-AATCATACACATGCCATCAAGTCATATTTGACTTCCAAAACACCAACC    173
TCAA-TCATACACATGACATCTAGTCATATTTGACTCCAAAACACTAAC      179
TCAAATCATACATTACATCAAGTCATATTTGACCACCAAATATACTAAC      172
TC-AATCATATACATGACACATCAAGTCATATTTGACTCTAAAACACTAAC    172
TC-AATCATACACATGCAATCTAGTCAATCTCATATTGGACTCCAAAAACTAAC 152
TC-AATCATACACATGACACTCTAGTCATATTTGACTCCAAAA            170
CC-AATCATACACATGACACATCAAGTCATATTTGACTCGAAAACACTAACC   171
```

FIG. 23C-3A

```
t25f15-28  ----TTCTTCTTGCTTCTCAAAGCTTTGTTGGTGTAGCTGAAGTCCGTATGAGTCTTTGG
t25f15-29  AAGCTTCTTCTTGCTTCTCAAAGCTTTAATGGTGTAACCAAAGCCCGTATGAATGTTTGG
t25f15-3   ----CTTCTTCTTGCTTCTCAAAGCTTTCATGGTGTAGCCACAGTCCCATATGAGTCTTTGG
t25f15-30  ---------------------------------------------------------
t25f15-31  ---------------------------TTTGATGGTGTAGCCGAAATCCGTATGAGTCATTGG
t25f15-32  AAGCTTCTTCTTGATTCTCAATGCTTTAATAGTGTTACCAAAGTCCACATGCGTCTTTTG
t25f15-33  AAGCTTCTTCTTGCTTCTCACAAAGCTTTGATGGTGTAGCTAAAGTCCGTATGATTCATTGG
t25f15-34  --------------CTTTGATGGTGTAGCCGAAGTCCGTATGAGTCATTGG
t25f15-35  AAGCTTCTTCTTGCTTCTCAAAGCATTGATGGTGTAGCCGACGTTCGTATGAGAATTGG
t25f15-36  ----TTCTTGCTTCTCAAAGCTTTGACGGTGTAGCCGAAGTCCGTATGAGTAATTGG
t25f15-37  ---------CTT----------------------------------------------
t25f15-38  ------CTTCTTGTTTCTCAAAGCTTTGATAGTGAAGCCGAAGTCCGTATGAGTCATTAG
t25f15-39  AAGCTTCTTCTTGATTCCCAACGCTTTAATAGTGTTACCAAAGTCCACAACAATCTTTAG
t25f15-4   ----TTCTTCTTGCTTCTCAATGCTTTCATGGTGTAGCCAAAGTCTATATGAGTCTTTGG
t25f15-40  AAGCCTCTTCTTGCTTCTCAAAGCTTTGATAGTGTAGCTGAAATTCGTATGAGTCATTGG
t25f15-41  ----CTTCTTGCTTCTCAAAGCTTTAATGGTGTAACCGAAGTCCGTATGAGTCTTGGG
t25f15-42  ---------------------------------------------------------
t25f15-43  ---------------------------------------------------------
t25f15-44  --------------------GATGGTGTAGCCAAAGTCCGTATGAGTATTTGG
t25f15-45  ----TTCTTCTTGCTTCTCAAAGTTTTAATGGTGTAATCAAAATCTGTATTAGTCATTGG
t25f15-46  AAG-------------------------------TCCGTATGAGTCTTTGG
t25f15-47  AAGCTTCTTCATGCTTCCTAAGGCTTGATGGTGATGTCAAAGTCCGTATGAATCTTTTG
```

FIG. 23C-1B

```
CTTTGTATCTTCTAAAAGGGAAACACTAACTAGG-TTTTAAGATCG-GGTTGCAGTTCCAGTTTTTATAC
CTTTGTATCTTCTAAAAAATAAATACTACTTAGG-TTTTAAGATCC-GGTTGCGGTTATAATTCTTATAC
CTTTGTGTCTTCTAACAACGATACACTACTTAGGCTTACACTTTTAAGATCG-GGTTGCGGTTAAGTTGTTATAC
-TTTGTATCTTCTAACAAGGAAACACTACTTAGACTTTTAAGATCC-GGTTGTGGTTCTAGTTCTTATAC
CGTTGTATCTTCTAACAAGGAAACACTACTTGGGCTTTCAAGATCC-AGTTGCGGTTCGAGTTCTTGTAC
CTTTGTATCTTCTAACAAGGAAACACTACTTTGGGTTTTAAGATCC-AGTTAAGGTTCTAGTTCGTATAC
CTT-GTATCTTCTAACAAGGAAACACTACTTAGGCTTTAAAGATCC-GATTCGAATTCTTGTCCTGATAC
CGTTGTATCTTCTAACAAGAAACACTACTTGGGCTTTCAAGATCC-AGTTGCGGTTCGAGTTCTTGTAC
CTTTGTATCTTCTAACAAGGAAACACTATTTGGGCTTTCAAGATCC-GGCTGTGGTTTGAGTTCTTATAC
CGTTGCATCTTCTAACAAGGAAACACTACTTGGCTTTCAAGATCC-AGTTGTGGTTCGAGTTCTTGTAC
---TGTATGTTCTAACAAGGAAACACTATTTAGGCTTTCAAGATCT-GGTTGCCAATCTAGTTCTTATAC
CTTTGTCTGTTCTAACAAGGAAAAACACTATTTGGGCTTTCAAGATCC-GGTTGCCAATCATCTAGTTCTTATAC
CTTTGTATCTTTCTAACAAGGAAACACTACTTTGGGTTTTAAGATCC-GGTTGTGGTTCTAGTT---ATAC
CTTGTTTCTTCTAACAAGGATACAATTCTTACGCCTTTAAGATCG-GGTTGCGGTTTAAGTTCTTATAC
CTTTGTATGTTCTAACAAGGAAACACTATTTGGGCTTTCAAGATTA-GGTTGTAGTTCGAGTTCTTATAC
CTTTGTATCTTCTAACAAGGAAACACTACTACTT
---GTATCTTCTAAAAGAAATACTACTTAGGCTTTTTAAGATCC-GGTTGCGGTTCTACTTCTTATAC
CTTTGTATCTTCTAGCATGGAAAACACTAATTTTGCTTTTTGGGATCC-GTTTGTAGTTTAAGTTCTAATAC
CTTTGTATCTTCTAAAAAGAAACACTACTTCGGCATTCAAGATCC-GGTTGCAGTTTGAATTCTTATAC
CTTTGTATCTTCTAACAAGAAACACTATTTGGGCTTTCGGGATTA-GGTTGTAGTTCGAGTTCTTATAC
CTTTGTATCTTCTCGCATGGAAAACACTCTACTTTTCCTTTTCGGATCC-GTTTGCGGTTCAAGTTCTAATAC
TTTTGTATCTTCTAGCATGGAAAACACTACTT
```

*FIG. 23C-2B*

```
TCAA-TCATATACACATGACATCTAGTCATATATTTGACTCATATATTTGACTCCAAAAACACTAACC  173
CC-AATCATACACATGACATCAAGTCAAGTCATATATTTGACTCATATATTTGACTCCAAAAACACTAACC  177
TC-AATCATACACATGACATCAAGTCAAGTCATATATTTCGACTCATATATTTGACTCCAAAAACACTAACC  175
TC-AATCATACAGATTACATCAAGTCAAGTCATATATTTGACTCATATATTTGACTCTAAAACACTAAC  116
TC-AATCATACACATGACATCAAGTCTAGGCATATATTTGACTCATATATTTGACTCCAAAAACAATAACC  154
TC-AATCATACACATGACATCAAGTCAAGTCATATATTTGACTCATATATTTGACTCTAAAATACTAAC  177
TCCA-TCATACACATGACATCAAGTCAAGTCATATATTTGACTCATATATTTGACTCCAAAAACAATAACC  177
TC-AATCATACACATGCCATCTAGGCATATATTTGACTCATATATTTGACTCCAAAAC  148
TC-AATCATACAAATGACATCTGGTCATATATTTGACTCATATATTTGACTGAAAAAACACAAACC  178
TC-AATCATACACATGCCATCTAGGCATATATTTGACTCATATATTTGACTCTAAAACA  168
T-TAATCATATACACAGGACATCAATTCATATATTTCATATATTTGACTCCAAAAACACTAACC  118
T-AAATCATACACAGGACATCAATTCATATATTTCATATATTTGACTCCAAAAACACTAACC  172
TC-AATCATACACATGACATCAAGTCAAGTCATATATTTCGACTCATATATTTGACTCTAAAACACTAAC  174
TC-AATCATACACATGACATGACATCAAGTCATATATTTCGACTCATATATTTGACTCCAAAAACACTAACC  174
T-AAATCATACACATGTCGTCTGGACATATATTTGACTCATATATTTGACTCCAAAAACACTAACC  178
                                                                          88
CC-AATCAAAAACATGAAATCAAGTCATATATTTGATTCCAAAAAACTAACC  114
TT-AAACATACACATGACATAAAGTCATATATTTGACTCCAAAAACACTAACC  118
TC-AATCATA  111
T-AAATCATACACAAATGTCGTCTGGTCATATATTTGACTCCAAAAACACTAACC  174
TC-AACCATAGACATGACATCAATTTATATCTAACTCCAAAAACACAAACC  138
                                                                          91
```

*FIG. 23C-3B*

```
t25f15-48  AAGCTTCTTCATGCTTCCTAAGGCTTTGATGGTGATGTCGAAGTCCTTATGAATCTTTTG
t25f15-49  AAG---------------------------------------------TCCGTATGAGTCTTTGG
t25f15-5   ---CTTCTTCTTGCTTCTCAAAGTTTCATGGTGTAGCCAAAGTCAATATGAGTCTTTGG
t25f15-50  A-GCTTCTTCATGCTTCCTAAGGCTTTGATGGTGATGTCGAAGTCCTTATGAATCTTTTG
t25f15-51  ------------------------------------------------TATGAGTCTTTGG
t25f15-6   ---CTTCTTCTTGCTTTCTCAAAGCTTTCATGGTGTAGCCAAAGTCCATATGAGTCTTTGG
t25f15-7   ---TTCTTCTTGCTTTCTCAAAGCTTTCATGGTGTAGCCAAAGTCAATATGAGTCTTTGG
t25f15-8   ---CTTCWCTTGCTTCTCAAAGCTTTCATGGTGTAGCCAAAGTCCATATGAGTCTTTGG
t25f15-9   ---CTTCTTCTTGCTTCTCAAAGCTTTCATGGTGTAGCCAAAGTCCATATGAGTATTTGG
```

*FIG. 23C-1C*

```
CTTTGTATCTTCTAGCATGGAAACACTACTT-----------------CCTTTTGGATCC-GTTTGCGGTTCAAGTTCTAATAT
CTTTGTATTTCTGGCATGGAAACACTACTT-----------------CCTTTTGGATCC-GTTTGCGGTTCAAGTTCTAATAT
CTTTGTCTTCTAACAAGGATACACTACTTAGGCTTATA-GATCA-GGTTGCGGTTTAAGTTCTTATAC
CTTTGTATCTTCTAGCATGGAAACACTACTT
CTTTGTATCTTCTAGCATGGAAACACTACTTTTCCTTTTCAGATCC-GTTTGCGGTTCAAGTTCTAATAT
CTTTGTCTTCTAACAAGGATACAATTCTTACGCCTTTAAGATCC-GGTTGCGGTTTAAGTTCTTATAC
CTTTGTCTTCTAACAAGGATACACTACTTAGGCTTACAAGATCC-GGTTGCGGTTTAAGTTCTTATAC
CTTTGTCTTCTAACAAGGATACACTACTTAGGCTTACAAGATCG-GGTTGCGGGTTAAGTTGTTATAC
CTTTGTCTTCTAACAAGGATACAATTCTTACGCCTTTAAGACCG-GGTTGAGGTTTAAGTTCTTATAC
CTTTGTCTTCTAACAAGGATACATCTCTTACGCCTTTAAGATCT-GGTTGCGGTTTAAGTTCTTATAC
```

FIG. 23C-2C

```
TC-AACCATAGACACATCACATCACTTTATATTTAACTCCAAAACACAAACC      91
TC-AATCATACACATGACATCAAGTCATATTCGACTCCAAAACACTAACC       138
                                                          174
TC-AACCACAGACAGGACATCAATTTATATTTAACTCCAAAACA              90
TC-AATCATACACATGACATCAAGTCATATTCGACTTTAAAACACTAACC       125
TC-AATCATACACATGACATCAAGTCATATTGACTCCAAAACACTAACC        175
TC-AATCATACACATGACATCAAGTCATATTCGACTTTGACTCCAAAACACTAACC 174
TC-AATCATACACATGACATCAAGTCATATTCGACTCCAAAACACTAACC       175
TC-AATCATACACATGACATCAAGTCATATTCGACTTTAAAACACTAACC       175
```

FIG. 23C-3C

```
                   AAGCTTCTTATTGCTTCTCTCAAAGCTTTGATGGTGTAGCCGAAGTCCGTATGAGTCTTTGG
                            10        20        30        40        50        60
f21i1-37   AAGCTTCTTCTTGCTTCTCTCAAAGCTTTGATGGTGTAGCCGAAGTCCGTATGAGTCTTTGG
f21i1-71   AAGCTTTTATTGCTTCTCTCACTGCTTTGATGGTGTAGCCGAAGTCCGTATGAGTCTTAGG
f21i2      AAGCTTCTTTTGCTTTCTCAAAGCTTTGATAGTGTAGCCGAAGTCCGTATGAGTCTTTGG
f21i2-1    ----TTCTTATTGCTTCTCTCAAAGTTTTGATGGTGTAGCCGAAAATCCGTATGAGTCTAT
f21i2-10   AAGCTTCTTCTAGCTTCTCTCAAAGTTTTGATGGTGTAGCCGAAGTCCGTATGAGTCTTTGG
f21i2-100  AAGCTTCTTATTGCTTCTCTCAATATTTCATGGTGTAGCCGAAGTCCGTATGAGTCTTTGG
f21i2-101  -----------------------------------------TATGAGTCTTTGG
f21i2-102  AA------------------------------------------------------
f21i2-103  ------------CTTCTGTGCTTCTCTTAAAGCTTTGATGGTGTAGCCGATGTCCGTATGACTCTTTGG
f21i2-104  ------------CTTCTGTGCTTCTCTTAAAGCTTTGATGGTGTAGCCGATGTCCGTATGACTCTTTGG
f21i2-105  AAGCTTCTTATTGCTTCTCTCAAAGCTTTGATGGTGTAGCCGAAGTCTGTATGAATTTTTGG
f21i2-106  AAGCTTCTTCTTGCTTCTCTCAAATGCTTTGATGGTGTAGCCGAACTCTATATGAGTCTTTG
f21i2-107  AAGCTTCTTATTGTTTCTCAAAACTTTTATGGTGTTACCGGTGTTACCAAAGTCCGTGAATCTTCGT
f21i2-108  AAGCTTCTCATGCTTTCTCAAAGCATTGATGGTGAAGCCAAAGTCCGTGAGTATTTGG
f21i2-109  AAGCTTTTTCTTGCTGTCTTCAAAGCTTTGTTGGTGTTGCCAAAGTCCGTAGCCGTGAATCTTCGG
f21i2-11   AAGCTTCTTATTACTTCTCTCAAAGCTTTGATGGTGTAGCCGTAGCCGAAGTCCGTATGAGTCTTTGG
f21i2-110  A-GCTTCTTCATGCTTCTTTAATGCTTTATATGCTTATATGCTGTAGCCGTATATGAGTCTTTGG
f21i2-111  AAGCTTCTTGTTCTTGCTTTCTTAATGCTTTCATGGTGTAGCCGAAGTCCGTATGAGTCTAAGG
f21i2-112  ----------------------------------TATGAGTCTTTGG
f21i2-113  ------TCTTGTTGCTTCTTAAAGCTTTGATGGTGTAGCCGAAGTCTGTATGAGTTTTTGG
```

*FIG. 23D-1A*

```
CTTTGTATCTTCTAA-CAAGGAAACACTACTTT--------AGCTTTTGGGAACCGGTTGCGGTTCTAGTTC
CTTGTCTCTTCTAA-CAAGGAAACACTACTTT--------ACCTTTTGGGATCCGGTTGCGGTTCTAATTC
CGTTGTATCTTCTAA-TAAGGAAACACTACTTT--------AGCTTTTGGGAAACCAGTTGCGGGTTCTAGTTC
CTTTGTATCCTTCTAA-CAACGAAGCAATACTTT--------AGCTTTTCGGAACCGGTTGCGGTTCTATTCC
CTTTGTATCTTCTAA-CAAGGAAACACTACTTT--------AGCTTTTGGGAACCAGTTGCGGGTTTTAGTTC
CTTTGTATCTTCTAA-TAAGGAAACACTATTTT--------AGCTTTTGGGAACCGGTTGCGGTTATAGTTC
CTTTGTATCTTCTAA-CAAGGAAAAAATACTTT--------ATCTTTTGGGAACCGACTGCGATTCCAGTTC
CTATGTATCTTCTAA-CAAGGAAATACTACTTT--------AGCTTTTGGGAACCGGTTCCGGTTCTAGTTC
------CAAGAAAACAC-------TACTTAGGCTTTTAAGATCTTGTTGCGGTTCTAGTTC
TTTTGTATCTTCAAA-CAAGGAAACATTACTACTTT--------AGCTTTTGGGAATTGGTTGCGGTTCTAGTTC
CTTTGTATCTTCTAG-AAGGGAAACACACAACTTT--------AGCTTTTGGGAATCAGTTGTGGTTCTAGTTC
CTTTGTATCTTCTAA-CAAGGAGAGATACTTT--------AGGCTTCAAGATCTAGTTAAGATTCTACTTC
CTTTGTATCTTCTAA-CAAGGAAATAC--------AAGTTTAGCTTCTCGGGATCCGGTTGCAGTTCTAGTTC
CTTTGTATCTTCTAA-CAAGGAAACACTACCTT--------ACCTTTTGGGAACCGATTGCGGTTCTAGTTC
CTTTCTATCTTCTAA-CAAGGAAACACAC-------TAATTTAGCTTTTGGGATCTTATTGCGCTTCTAGTTC
ATTTGTATCTTCAAA-CCAGGAAAC--------GGCTTTTGGGAACCAGTTGCGGTTCTAGTTC
CTTTGTATCTTGTAA-CAAGGAAACACTACTTT--------AGCCTTTGGGAAACCGGTTGCGGTTCTAGGTC
CTTTGTATCTCCTAA-CAAGGAAAACACAACTTT--------AACTTTTCGGAACCGGTTGTGGTTCTAGGTC
CTTTGTATCTTTTAA-CAAGGAAAACACTAATTT--------ACATTTTGGGATCCTTTGCGTTTCCGGTTCTAGTTC
TTATGTATTTTCTAA-CAAGGAAAACACTACTTT--------AGCTTTTGGGATCCGGTTGCGGTTCTATATC
CTTTGTATCTTCTAG-AAGGGAAACATTACTTT--------AGCTTTTGGGAAGATGTTGCGGTTCTAGTTC
                70          80          90          100         110         120         130
```

*FIG. 23D-2A*

```
TTATACTCAATCATACACACATGACACATCTAGTCATATTTGACTCCAAAACACTAACC       173
              140       150       160       170       180
TCATACTCAATTATACAAATGACACATCTAGTCATATTTGACTCCAAGACAC              178
TTATCCCATCATACACACATGACACATCTAGTCATATTTGACTCCAAAATACTAACC         159
TTATACTCAATCATACACACATGACACATCTAGTCATATTTGACTCGTCATATT            174
TTATGCTCAATCATACACACATGACACATCAAGTCATATTTGACTCCAAAACACTAACC       174
TTATACTCAATCATACACACATGACACATAGTCATATTTGAATCCAAAACACT             175
TTATACTCCATCATACACACATGACACATCTAGTCATATTTGACTCTAAAACACTA          131
TTATACTCAATCATACAAATGACACATCTATTCATATTTGTCTCCAAAACACTAACC         103
TCATACTCAATCATACACACATGACACATGAGATCAAGTTATATTTGACTCCCAAACTAA      155
TTATACTCAATGATACACACATGACACATCCTGTAATATTTGACTCTAAAATACTAACC       174
TTATACTTAATCAAACACACATAACACATGACACATAAACATTTGACTCCAAAAAACTAAC     174
TTATACTCACTCAAACACACACATGACACATGACCTCTAGTCGTCATATTTGACTCTGAAACAATAACC 178
TTATACTCAATCATACACACATATGACACATGACCCTCTAGTCATCATATTTGAATCCAAAACAGTAACC 178
TTATACTCAATCATACAATACTATACACATGACACATGACATAGTCTTATTTGACTCCAAAACACTAACC 178
TAATACTCAATCATACACACATGACACATGACATAGTCTAGTCATATGTGACACCAAAACACTAACC  178
TTATACTCAATCATACACACATGACACATAGTACAAGTAGTCGTATGTGGCTTCAAAACACTAACC   178
TTATACTCAATCATCCACATATAAATGACACATCCAGTAGTCATATTTGACTCCAAAAACACTAACC  178
TTATACTCAATCATATAAATGACATCTAGTCATATATTTGACTGGAAAACACTAACC         177
TTATACTCAATCATACACACATAACATGACATCTAGTCATATTTGACTCCAAGACAC         173
TTATACTCAATCAAACACACATAACACATCTTGTCTTATTTGACTCTTTGACTCCAAAACACTAA 129
TTATACTCAATCATACACACATAACACATAACATCTTGTCTTATTTGACTCCAAATACTAACC   173
```

```
ATTTGTATCTTTTAT-AAAGGAAACATTACTTT----------CGCTTTTGGGAATTGGTTGCGGTTCTAGTTC
ATATGCATCTTCTAA-CAAGGAAACACGTCTT----------TCGCTTTTAAGATCCGGTTGCGGATTCTAGTTC
CTTTGTATCTTCTAA-CAAGAAAACACTACTTT---------AGCTTTTGGGAACCAGTTGCAGTTCCTAGCTG
CTTTGTATCTTCAAA-CAAGGAAACACTACTTT---------AGCTTTTGGGAATCAGTTGCGGTTCTAGTTC
CTTTGTATCTTCTAA-TAGGGAAAACATAACTTT--------AGCAATTGGGAATCGGTTGCCGTTCTAGTTC
CTTTGTATCTTCTAA-CGAGGAAACCCTACTTT---------AAGTTTTGGAACCGGTTGCGGTTCTAGTTC
CTTTGTATCTTCTAA-CAAGGAAACACTACTTT---------AGCCCCTGGGAACCAGTTGCGGTTTAGTTC
CTTTGTTCCTCTAA-CAAGGAAGCAATACTTT----------AGCTTTTCGGAACCGGTTGCGGTTCTAGTCC
CTTTGTATCTTCTAA-CAAGGGTACAC----TAATTAAGATTTGGGATCCGGTTGCGGATTTAGTTC
TTTTGTATCTTCTAA-CAAGAAAACATTACTTT---------AGCTTTGGGAATTGGTTACGGTTCTAGTTC
CTTTGTATCTTCTAA-CAAGGAAACATTACTTT---------AGCTTTTAGGAATCGGCTGCGGTTCTAGTTC
----------------------------------------------------TTGCGGTTTTAGTTC

CTTTGTATCTTCTAA-CAAGGAAACATTACTTA---------AGCTTT
CTTTGTATCTTCTAA-CAAGGAGAACTACTT-----------AGGCTTT
CGTTGTATCTTCTGA-CAAGGAGAATACTACTT---------AGGCTTTCAAGATCCAGTTGAGATTCTAGTTC
CTTTGAATCTTCTAA-TAAGGAAACACAACTTT---------AACTTTTGGAACCGGTTGTGGTTCTAGGTC
GTTTGTATCTTCTAA-CAAGGAAACAC---------------TTCTTAAGGTTTTAAGATCCGGTTGCGGTTCTAGTTC
CTTTGTATCTTCTAA-CAAGGAAACAC---------------TACTTTAGCTTTTAGGATCTGTTGCGGATTCTAGTTC
CTTTGTATCTTCTAA-CAAGAAAACACTAAATT---------TGCTTTTGGGAACCAGTTGCGGTTCTAGTTT
CTTTGTCTCTTCTAA-CTACGAAACATTACTTT---------ACCTTTTGGAATCCGATAGCGGTTCTAGTTC
----------------CAC-----------TACTTAGGCTTTTAAGACCCGGTTGCAGTTCTAGTTC
CTTTGTATCTTCTAG-AAGGGAAATATTACTTT---------AGCTTTTGGGAAGATGTTGCGGTTCTAGTTC
```

*FIG. 23D-2B*

```
TTATACTCAATGATTCACACATGACACATCATGTAATATTTGACTTCAAAATACTAACC    176
ATATACTCAAACATACACATACACATGATATCTAGACATATTTGACTTCCCAAACACTAA   176
TTAAACTCAATCGTACACATGACACATCTAGTCATATATTTAACTCCAAAACACTAACC    168
TTATACTCAATCATACACACGACAT                                      144
TTATACTCAATCATACACATGACACATCTAGTCATATTTGATTCCAAAACACTAACC      175
TTATAGTCAATCATACACATGACACATCTTGTCATACTTGACTTGACTTCCAAAACATTAACC 175
TTATACTCAATCATCCACATTACACATCTAGTCATATTTGACTTCCAAAA             170
TTATACTCAATCATACACATGAAATCTCGTCATATT                           159
TTATAATCAATCATACACATGACCCTCCAGTCATATTTGAATCCAAAACAGTAACC       175
TTATACTCAATGATACACATGACATCCTGTAATATATTGACTCTAAAATACTAACC       155
CTATACTCAATCATACACATGACATAGTCATACATGACTCTGAAACACTAACC          118
TTATACTCAATATACACATGACACATCTAGTCATGTCATATTTGACTCCAAAATACTAACC  70
                                                               98
                                                               98
TTATACTCAACCATACACACAGGACATATCGTCATGTCAGTCTGAAACACTAACC        178
TTATAGTCAATCATATAAAGACATCTAGTCATATTGACTCATCTGAAAAACACTAACC     178
TTATACATAATGTTACACATGAGAGATCTAGTCATATAGATACCAAAACATTAACC       178
TTATACTCAATCATACACATGACCCTCTAGTCATATCTGAATCCAAAAACAGTAACC      178
TAATACTCAATACTACACATGACATGACATAGTCTTTTGACTCCAAACACTAAC         177
TTATACTCAATCATACACATGACACATCTAGTCATATTGACTCCAAGACAC            173
TTATACTCAATCATACAAATGACACATCTACTCATATTTGACTCCAAAACACTAACC      96
TTATACTCAATCAAACACATAACACATCTTGTCTTATTTGACTCCAAAATACTAACC      167
```

*FIG. 23D-3B*

```
f21i2-134  ------------------------------------------------------------TATGAGTCTTTGG
f21i2-135  AAGCTTCTTATTGCTTTTCCAAGCTTTGATGGTGTAGCCGAAGTCCGTATGAGTCTTTTG
f21i2-136  ------------------------------------------------------------
f21i2-137  ---CTTCTGTGCTTCTTAAAGCTTTGATTGTGTACCCAAAGTCCGTATGAGGTTTTG
f21i2-138  ---TTCTTGCTTTTTAATGCTTTCATGGTGTAGCCGAAGTCCGTATGAGTCTTTGG
f21i2-139  -----------------TTTGATGGTGTAGCCGAAATCCGTATGAGTCTTTGG
f21i2-14   AAGCTTCTTATTGCTTCTCAAAGCTTTGATGGTGTAGCTGAGTGAATTCCATATGATTCTTTGG
f21i2-140  ------T-CTTGCTTCTCAATGCTTTGATGGTGTAACCGAAGTCTGTATGAGTCTTTGG
f21i2-141  AAGCTTCTTATTGCTTCTCAAAGATTTGATGGTGTAGCTGAGTCTGAACTCTGTATGAATCTTTTG
f21i2-142  ----TTGCTTCTTAAAGCTTTGATGGTGTAGCCGAAGTCTGTATGAGTTTTTGG
f21i2-143  ----TTGCTTCTTAAAGCTTTGATGGTGTAGCCGAAGTCCGTATGACGTTTGG
f21i2-144  -----------CTTTGATGGTGTAGCCGAAGTCCGTATGAGTCTTTGG
f21i2-145  ------------------------------------------------------------
f21i2-146  AAGCTTCTTCTTGCTTCTCAATGCTTTGATGGTGTAGACGAAGAAGTCCTTATGAGTTTTTG
f21i2-147  AAGCTTCTTATTGCTTCTCAAAGCTTTGATGGTGTAGCCGAAGTCTGTATGAGTCTTTGG
f21i2-148  AAGCTTCTTATTGCTTCTCAAAGCTTTGATGGTGTAGCCGAAGTCCGTATGAGTCTTTGG
f21i2-149  -----------------TATGAGTCTTTGG
f21i2-15   A-GCTTCTTATTGCTTCTCAAAGCTTTGATGGTGTGGCTGAAGTCCATATGATTCTTTTG
f21i2-150  AAGCTTCTTCTTGCTTCTCAATGCTTTGATGGTGTAGCCTAACTCCGTATGAGGTTTTGG
f21i2-151  ---CTTTGATGGTGTAGCCGAAGTCCGTATGAGTCTTTGG
f21i2-152  AAGCTTCTTATTGCTTCTCAAAATTTCATGGTGTAGGCGAAGACCGTATGAGCCTTTGG
f21i2-153  ---CTTCTTATTGCTTCTCAAAGATTTAATGGTGTAGCCGAACTCTGTATGAATCTTTTG
```

FIG. 23D-1C

```
CTTTGACTCCTCTAA-CAAGGAAACAC-----TACATAGACTTTTAAGATCCAGTTGTGGTTCTACTTC
CTTTGTATCTTCTAA-CAAGGAAACAATACTT------------------------------------
TTTGTATCTTCTAG-AAGGGAAACATTACTTT-----AGCTTTTGGAAAAATGTTGCGGTTCTAGTTC
CTTTATCTTCTAA-CAAGAAATCTCTACTT-------AGGATTTTAAGTTCTTGTTGGGGTTCTAGTTC
CTTTGT-ATCTTTAA-CAAGGAACCACTACTT-----AGCTTTTGAGAACCGATTGCGGTTCTATTTC
CTTTGTAACTTCTAA-CAAGGAAAACACTACTT----AGCTTTTGGGAAACGATTGCGGTTCTAGTTC
CTTTGTATCTTCTAA-CAAGATAACACTACTT-----AGGATTTTAAGATCTTGCTGGGCTTCTAGTTC
CTTTGTATCTTCTAA-CAAGGAGATATTATTT-----AGGCTTTCAAGATCCAGTTGAGATTCTAGTTC
CTTTGTATCTTCTAG-AAGGGAAACATTACTTT----AGCTTTTGGGAAGATGTTGTGGTTCTAGTTC
CTTTGTATCTTCTAG-AAGGGAAACATTACTTT----AGCTTTTGGGAAGATGTTGCGGTTCTAGTTC
CTTTGTATCTTTGAA-CAAGGAAACACTACTTT----AGCTTTTGGGAATCGGTTGCGGTTCTAATTC
---------------------------------------------TTGCGGTTTTAGTTC
TTTTGGATATTCGAA-TAGGGAAACACTACTTTTACTTAACCTTTTGGGATCTTGTTGCGGTTCTAGTTC
-TTTGTATTTTCTAA-CAAGGAAACACTACTTT----AGCTTTTTGGATCCGATTGCAGTTCTAGTTC
CTTTGTATCTTCTAA-CA--------------------------------------------------
CTTTGTATTTTCTAA-CAATGAAATACAACTTT----AGTTTTTGGTATCCGGTTGCGGTTCTAGTTC
CTTTGTATCTTCTAA-GAAGGAAACACTACTTT----AGCTTTTGGAAAATGGGTTCGATTCTAGTTC
TTTTGGATCTTCTAA-TAGGGAAACACTACTTT----AGCTTTTGGGATCCGGTTGAAGTTCTAGTTC
-TTTGTCTCTTCTAA-CAAGGAAACACTACTTT----ACATTTTGGTTCCTTTGCGGTTCTAGTTC
CTTTGTTTCTTCTAA-CAAGGAAACACTACTTT----ACCTTTTGGAACCAGTTGCGGTTCTAGTTC
CTTTGTATCTTCTTA-CAAGGAGATACTATTT-----AGGCTTTCAAGATCCAGTTGAGATTCTAGTTC
```

FIG. 23D-2C

```
TTATACTCATTCATATACACATGACATCTAGTCATATTTGACACCAAAACCCTAACC        131
TTATACTCAATCATCCACATGACATCTAGTCATATTTGACTCCAAAA                   91
TTATACTCAATCAAACACATAACATCTTGTCTTATTTGACTCCAAAATACTAACC           63
TAATATAAAATCATACACATGACAT----------------------CAAGT             175
TTATACTCAGTCATACACAGGACATCTAGTTATATTTGACTCCAAAACACTAACC           146
TTATACTCAATCATACACATGACATTTAGTCATATTTGACTCCAAAA                   153
TAATATTCATCATACGCATGACAT----------------------CAAGT              170
TTATACTCAATCATACACATGACACATGTAGTCATATTTGACT                       145
TTATACTCAATCATCAAACAACATAACATCTTGTCTTATTTGACTCCAAAATACTAACC      164
TTATACTCAATCAAACACACATAACATCTTATCTTATTTGACTCCAAAATACTAACC         168
TTATAGTCAATCAATGATACACATGACACATCTGTAATATTTGACTTTAAAATACTAACC     168
TTATACTCAAATTACACATGACATCTAGTCATATTTGACTCCAAAATACTAACC           155
TTATACTCAATCATACACATGACATCTAGTCATTTTTACTCTAAAACACT                70
TTATACTCAATCATCCTACACATCTAGTTATAATTGACTCCTTAACACTAACC            180
TTATACTCAATCATATACACATGACACATGTAGTCATACT                          177

TTATACTCAATCATACACATGACATGACATGACATCTAGTCAT                       77
TTATACTCAATCATACACATGACATGACATCTAGTCATATTTGACTCCAAAACACT          109
TTATACTCAATCATCATCCACATTACATC                                     173
TTATACTCTATCAATACAAATGACATCTAGTCATATTTGACTCCAAGACAC               149
TTATACTCAATACACATACACATGACAT                                      149
TTATACTCAATCATACACATGACATGACATGTAGTCATATT                         148
TTATACTCAATCATACACATGACACATGACATGTAGTCATATT                       156
```

*FIG. 23D-3C*

```
f21i2-154  AAGCTTCTTCTTGCTTCTCATAGATTTGATGGTGTAGCCGAAGTCCGTATAAGTCTTTGG
f21i2-155  AAGCTTCGTCTTGCTTCTCAAAGATTTGATGGTGTAGCCGAAGTCCGTATAAGTCTTTGG
f21i2-156  ----------TTGCTTCTAAAAGCTTTGATGGTGTAGCAGAAGTACGTATGAGTCTTTGG
f21i2-157  AAGCTTCTTATTGCTTCTAAATATTTCATGGTGTAGCCGAATTCCGTATGAGTCTTTGG
f21i2-158  ----------TGCTTCTCAAAGCTTTGATGGTGTA-CCAAACTCCGTATGAGTCTTTTG
f21i2-159  AAGCTTCTTCTAGCTTCTCAAACATTTGATGGTGTAGCAAAAGTTTGTATGAGTCTTTGG
f21i2-16   ----------TTCTTATTGCTTCTCTCATAGCTTTGATGTTGTAACCAAAGTCCGTATGATTCTTTGG
f21i2-160  AAGCTTCTTATTGCCTCACACAAAGCTTTGATGGTGTAGCCGAAGTCGGTATGAGTCTTTGG
f21i2-161  ----------CTTTGATGGTGTAGCCGAAGTTTGTATAAGTCTTTGG
f21i2-162  AAGCTTCTTCTTGCATCTCAAAGATTTGATGGTCTAGCGAAAGTGCGTATAAGTCTTTGG
f21i2-163  AAGCTTCTTCTTGCTTCTAAAGATTTGATGGTGTAGCCGAAGTCGGTATAAGTCTTTGG
f21i2-164  AAGCTTCGTCTTGATTCTCAAACCTTTGATGGTGTAGCAGAAGTTCTATGTGTCTTTGT
f21i2-165  AAGCTTCTTATTGCCTCACCAAAGCTTTGATGGTGTAGCCGAAGTCGGTATGAGTCTCTGG
f21i2-166  ----------TTTGATGGTGTAGCCGAAGTCCATATGAGTCTTTGG
f21i2-167  ----------GCTTCTCAAAGCTTTGATGGTGTAGCCGAAGTCCGTATGAGTCTTTGG
f21i2-168  AAGCTTCTTATTGTTTCTCAAAGAATTGATGGTGTAGCCGAAGTCCGTATGACTCTTTGG
f21i2-169  ----------TG
f21i2-17   ----------CTTCTTCTTGCTTCTCAACGCTTTGATGGTGTAGCCGAACTCCGTATGAGTCTTTTG
f21i2-170  AAGCTTCTTCTTAGCTTCTCAAAACTTTAATAGTGTAGCTGAAGTCCGTATGAGTCTTTGG
f21i2-171  ----------CTTCTGTTGCTTCTTAAAGCTTTGATGGTGTAGCAGAAGTCTGTATGAGTTTTGG
f21i2-172  ----------GCTTCTCAAAGCTTTAATAGTGTAGCCGAAGTCCGTATGAGTCTTTGG
f21i2-173  ----------
```

```
                                                              100
TTATACTTAAACATACACATTACAT                                     148
TGTTACTCAATCGAACACATGACACATCTAGTCATATATTGACTCCAAAA            160
                                                               91
                                                               86
                                                               90
TTATACTCAATCATACACACATGACACATCTAGTCATATATTTGACTCCAAAACACTAA   172
TTATACTCAATCATGATACACATGACACATGATATCCTGTAATATTTCACTCTAAAATACTAACC  177
TTATACTCAATCATAAACATAACATCTAGTCATATTTGACT                     141
GTATACTCAATCATACACATGACATC                                    149
TTATACTCAA                                                    133
                                                               88
TTATACTCAATGATACACATGA                                        144
                                                               67
                                                               79
                                                               91
TTATACGCAATCATACACATGACATCTAGTTGTATTTGAATCCTAAACACTAA         69
TTATACTCAATCATACACATGACATATAGTCATATTTGACTCTGAAACACTAACC      175
                                                              116
TTATGCTCAAACACACATAACATATTGTCTTATTTGACTCCAAATACTAA           173
----------------------------------------------C                77
TTATCCTCAATCATATAACTGACATCTAGTCATAGTTGACTACAAAACACTAACC      113
```

```
TTATATAGAATCATACATATGACCTCTAGCCATATTTGACTTCCAAAAACACTAAC        69
CTCTACTCAATCATACACATGACACATGACATCTAGTTTTTATTTTATTCCAAAAGCGCTAACC    117
                                                                 67
                                                                 69
TTATACTCAATCATACACATGACACATGACATCTAGTCATATTTGACTCCAAAAAACTAAC    154
TTATACTCAATCATACACATGACACATGACATCTAGTCATATTTGACTCCAAAA           166
TTATACTCAATCATCCACACATGACACATGACATCTAGTCATATTTGACTCCAAAACACTAAC  177
TTATACTCAATCATACACATGACACATGACATCTAGTCATATTTGACTTGTCATATTTGACTCCAAAACATTAACC 178
TTATACTCAATCATACACATGACACATGACATCTAGTCATATTTGACTCCAAAACACTAACC   178
TTATACTCAATCATACACATGACACATGACATCTAGCCATATTTGATTCCGAAAAACTAACC   178
TTATACTCAATCATACACATGACACATGACATCTAGTCTTATTTGACTCCAAAATACTAACC   178
TTATACTCAATACTACACATGACACATGACATCTAGTCATATTTGACTCCAAAACACTAACC   178
TTATACTCAATCATACACATGACACATGACATCTAGTCATATTTGACACAAAAACACTAACC   178
TTATACTCAATCATACACATGACACATGACATCTAGTCATATTTGACTCCAAAAACATTAACC  178
TTATAATCAATCATACACATGACACATGACATCTAGTCATACTTGACTCCAAAAACATTAACC  173
TTATACTCAATCATACACATCCACACATGACACATGACATCTAGTCATATTTGACTCCCACAAC 177
TTATACTCAATCATACACATGACACATGACATCTAGTCATATTTGACTCCAAAAAACTAACC   176
TTATACTCAATCATCATACACATTGACACATGACATCTAGTCATATTTGTCTCCAAAACACTAA 175
TTATACATAATCATACACATGACACATGACATCTAGTCAAATTATATTTAACTCCAAAAACTAACC 168
TTATACACATAATCATACACATGACACATGACATCTAGTACATCATATTTCATATTTGACTCCAGAACACTAACC 175
TTATACTCAATCATACACATGAAATGTAGTCAGACATCTAGTCATTTTTGACTCCAAAGCACTA 178
TTATACTCAATACTACACACATGACACATATAGTCTTTTTGACTCCAAAAACACTAACC      178
```

*FIG. 23D-3E*

```
f21i2-34  AAGCTTCTCTTATTGCTTCTCAAAATTTGATGGTGTACACGAAGTCCGTATGAGTCTTTGG
f21i2-35  -------TTCTTGCTTATTGCTTCTCAAAGCTTTGATGGTGTAGCCGAAGTCTGTATGAGTCTTTGG
f21i2-36  AAGCTTCTCTTATTGCTTCTCAAAACTTTATGGTGAAGCCAAAGTCCCTATGAGTATTTGG
f21i2-38  AAGCTTCTCTTATTGCTTTCCAAGCTTTGATGGTGTAGCCGAAGTCTGTATGAGTCTTTTG
f21i2-39  AAGCTTCTCTTATTGCTTCTCAAAACTTTGATGGCTTAGCCGAAGTCCGTATGAGTCTTTGG
f21i2-4   A-GCTTCTCTTATTGCTTCTCAAAGCTTTGATGGTGTAGCTTAGCTGAAGTCCTTATGATTCTCTGG
f21i2-40  -------TTCTTCCTGCTTCTCAAAGCTTTGATGGTGAAGCCGAAGTCCGTATGAGTCATTGT
f21i2-41  AAGCTTGTCTTATTGCTTCTCAAAATTTGATGGTGTAGCCGAAGTCCGTATGAGTCTTTGG
f21i2-42  AAGCTTCTCTTCTTGTTCTCAAATATTAATGGTGTAGCCAAAGTCCATATAAGTCTTTGG
f21i2-43  AAGCTTCTCTTATTGCTTCTCAAAACTTTAATGGTGTAGCCGAAGTCAGTATGAGTCTTTGG
f21i2-44  AAGCTTCTCTTATTGCTTCTCATAGCTTTGATGATGTAGCTTGAATTCCATATGATTCTTTGG
f21i2-45  AAGCTTCTTATTGCTTCTTAAAACTTTTATGGTGAAGCCAAAGTCCGTATGAGTATTTGT
f21i2-46  ---CTTCTTGTTGCTTCTTAAAGCTTTGATGGTGTAGCCAAAGTCCGTATGAGTCTTTGG
f21i2-47  AAGCTTCTCTTATTGCTTCTCATAGCTTTGATGGTGAAGTCGAAGTTCGTATGAGTCTTTGG
f21i2-48  AAGCTTTTCTTATTGCTTCTCAAAGCTTTGATGGTGTAGTTGAAGTCGAAGTCCATATGAGTCTTTGG
f21i2-49  AAGCTTCTCTAGTTTCTTCTCAAAGATTTGATGGTTTGATGGTGTAGCCGAAGTCCATATGAGTCTTTGG
f21i2-5   AAGCTTCTCTTTCTTCTTCTCAAAGCTTTGATGGTGTAGGCGAAGTCCGTATGTGTCTTTGG
f21i2-50  AAGCTTCTTATTGCTTCTCAGAACTTGGATGGCTTAGCCGAAGTCCGTATGAGTTTTAG
f21i2-51  AAGCTTCTCTTATTGCTTCTCAAAACTTTCATGGTGTAGCCGAAGTTCGTATGAGTCTTTGG
f21i2-52  AAGCTTTTCTTATTGCTTCTCAAAGATTGTGTAGCCGAAGTCCGTATGAGTCTTAGG
f21i2-53  AAG----------------------TCCATATGAGTCTTTGG
f21i2-54  AAGCTTTTTATTGCTTCTCAAAGCTTTGATGGTGTAGCCGAAGTCCGTATGAGTCTTAGG
```

FIG. 23D-1F

```
CTTTGTATCTTCTAA-CAAGGAAACATAACTTT--------AGCTATTGGGAATCGGTTGCCATTCTAGTTC
CTTCGTATCTTTTAAACAAGGAAACACTACTT--------AGGCTTTAAGATTCGGTTGCGGTTCTAGTT-
CTTTGTATCTTCTAA-CAAGGAAACACTACTTG--------AACCTTTGGGAACCGGTTCCGGTTCTAGTTC
CTTTGTATCTTCTAA-CAAGGAAGCACTACTTT--------AGCTTTTTGGAACTGGTTGTGGTTCTAGTTC
CTTTGTATCTTCTAA-CAGG-AAACAATACTTT--------TGCTTTTGGGAACCGGTTACGGTTCTAGTCC
CTTTGTATCTTCTAA-CAAGGAAACACTACTTT--------AGCTTTTGGGAAACGGTTGCGGTTCTAGTTC
CTTCGTATCGTCTAA-CAAGGAAACACTACTTT--------AGCTTTTGG-AACCGTTTGCGGTTCTAGTTC
CTTTGTATCTTCTAA-CAAGGAAACATTACTTT--------AGCTAGTGGGAATCGGTTGCGGTTCTAGTTC
ATCTGCATCTTCTAA-CAAGGAAAACACTTTTT--------TGTCTTTTAAGATCCGGTTGCGGTTTAGTTC
CTTTGTATCTTTTAT-AAGGGAAAACTCTACTTT--------AGCTTTTGGGAACCGATTGCGGTTCTAGTTC
CTTTGAATCTTCTAA-CAAGGAAACACTACTTT--------AGCTTTTGGGAAGCAGTTGCGGTTCTAGTTC
CTTCTTATCTTCTAG-AAGGGAAAACACAACTTT--------ACGTTTTGGGAACAGGTTGTTGCGGTTCTAGTTC
CTTTGTATCTTCTAA-CAAGGAAACACAACTTT--------AGCTTTTGGGAAGATGTTGCGGTTCTAGTTC
CTTCGAATCTTCTAA-CAAGGAAACACTACTTT--------AGCTTTTGGGAAGCAGTTGCGGTTCTAGTTC
CTTTGTATCTTCTAA-TAAGGAACCACTACTTT--------AGCTTATGGAAACTAGTTGCGGTTTAGTTC
CTTTGTATCTTCTAA-TAAGGAAACACTATTT---------TTCTTAGGCTTTTAAGATCCGGTTGCGCTTCTAGTTC
ATTTGTATCTTCTAA-CAAGGAAAACAC---------AGTTTTTAGGAATCAGTTGCGGTTCTAGTTC
CTTTGTATCTTTTGA-CAAGGAAACATTACTTT--------TGCTTTTGGGAACCGGTTGCGGTTCTAGTTC
CTTTGTATCTTCTAA-TAAGGAACCACTACTTT--------AGCTTTTGTAAACCAGTTGCGGTTCTAGTTC
CTTTGTATCTTCTAA-CAAGGAAATATTACTTT--------AGCTTTTGGGAACCTAGTTGGTGCGGTTCTAGTTC
CTTTGTATCTTCTAA-TAAGGAACCACTACTTT--------AGCTTTTGGGAAACCAGTTGCGGTTCTAGTTC
```

*FIG. 23D-2F*

```
TTATACTCAATCATCATACACATGACATCTAGTCATATTTGACTCCAAAACACTAACC   178
TTATATTCAATCATCATACACATGACATCAAATCATATTTGACTCCAAAACACTAACC   171
TTATACTCAATCATCATACACATAACATAGTCATATTTGAATCCAAAACACTAACC     178
TTATACTCAATCATCATAGACATGACATCTAGTCATATTTGTCTCCGAAACACTAAC    177
TTATAAACAATCATCCACATGACATGACATCAAGTCATATTTGACTCCAAAATACTAACC 177
TTATACTCAATCATCATACACATGACATGACATCTAGTCATATTTGACTCCAAAACATTAACC 177
TTATACTCAATCATCATACACATGACATCTAGTCATATTTGACTCCAAAAAACTAACC   173
TTATACTAAAACATCATACACATGACAACTAGTCAAGTTATATTTGACTCCCAAAACACTAA 176
TTATACTCAATCATACACATGACATGACATCTAGTCATATTTGACTCCAAAACCCTAACC 176
TTATACTCAGTCATCCACATAGTCATGACATCTAGTCATATTTGACTCCAAAACACTAACC 178
TTATACTCAATCATCATACACATGACATCTTGTCATACTTGTCATATTTGACTCCAAAACATTAACC 178
TTATACTCAATCATCAAACATACACATGACATCTTGTCATACTTGACTCCTAAAACATTAACC 178
TTATATTCAATCAATGATACACATGACATGCCATATCATGAATCATATTTGAATCCAAGCACT 174
TTATACTCAAAACATACACATGACATCTAGTCATGACATCTAGTCATATTTGACACCAAAACACTAACC 178
TTATACTCAATCGTACACTACACACATGACATGACATCTAGTCATATTTGACTCCGAAAACTAACC 174
TTATACTCCATCATACACACAAATGACATCTAGTCATCTTATTTGACTCCAAATTACTAACC 178
TAATACTCCATCATCATACAAATGACATCTAGTCATTCCATATTTCACTCCAAAACACTAACC 138
TTATACTCCATCATAGACACATGACATCTAGTCATATTTGACTCCAAAATACTAACC   178
```

```
CTTTGTATCTTCTAA-CAAGGAAAACATAACTTT--------AGCTATTGGGAATCGGTTGCCATTCTAGTTC
CTTTTTATCTTCTAA-CAAGGAATCACTACGTC--------AGCTTTTGGGAAGCAATTGCGGTTCTAGTTC
CTTTGTCTCCTTCTAA-CAAGGAAAACACAACTTT--------AACTTTTGGGAACCGGTTGTGGTTCTAGTTC
CTTTGTCTCTTCTAA-CTACGAAAACATTACTTT--------ACCTTTTGGAATCCGATAGCGGTTCAAGTTC
CTTTGTATCTTCTAA-CAAGGAAAACAC-------TAATTTAGCTTTTGGGATCTGTTGCGGTTCTAGTTC
CTTTGTATCTTCTAA-CAAGGAAAACACTACTTT--------AGCTTTTGGGAAGCGGTTGCGGTTCTAGTTC
CTTTATATCTTCTAA-CAAGGAAAACAC-------TAATTTAGCTTTTGGGATCTGGTTGCGATTCTAGTTC
CTTTGTATCTTCTAA-CAAGGAAAACATTAATTT--------AGCTTTTGGGAATTAGTTGCGGTTCTAGTTC
CTTTCTATCTTCTAA-CAAGGGAAACACTACTTT--------ACCTTTTGGGAACCGGTTGCGGTTCTAGTTC
CTTTGT-TCTTCAAA-CAAGGAAAACATTACTTT--------AGCTTTTGGGAATCGGTTGCGGTTCTAGTTC
CTATGTATCTTCTAA-CAAGGAAAATACTACTTT--------AGCTTTTGGGAATTGGTTGCGGTTCTAGTTC
CTTTGTATCTTCTAA-CAAGGAAAACATAACTTT--------AGCTATTGGGAATCGGTTGCCGTTCTAATTC
CTTTGTATCTTCTAA-CAGGGAAAACACTACTTT--------AGCTATTGGGAATCGGTTGCCGTTCTAGTTC
ATTTGTAACTTCAAA-CAAGGAAAACACTACTTT--------GGCTTTTGGGAACCAGTTGCTTTCTAGTTC
CTTTGTATCCTCTAA-CAAGGAAAACACTACTTT--------AGCCTTTTAAGATCCGTTGTAGTTCTAGTTC
CTTTGTATCTTCTAA-CAAGGAAAACACTACTTT--------AGCTTTTGGGAAACGGTTGCGATTCTAGTTC
CATTGTATCTTCAAA-CAAGGAAAACAATACTTT--------ATCTCTTGGGAACCAGTTGCGGTTCTAGTTC
CTTTGTATCTTCAAA-TAAGGAACCACACACTTT--------AGCTTTTAGGAACTAGTTGCGGTTCTAGTTC
CTTTCTATCTTCTAA-TAAGGAACCAACACTTT--------AGCTTTTGGAAACTAGTTGCGGTTCTAGTTC
CTTTGTATCTTCTAA-CAAGGCAACACTACTTT--------GGCTTTTGGGAACCGGTTGCGATTCTAGTTC
CATTGTATCTTCTAA-TAAGGAACCACTAGTTT--------AGCTTATGGGAAACCAGTTGCGGTTTAGTTC
```

*FIG. 23D-2G*

| | |
|---|---|
| TTATACTCAATCATACACATGACACATCTAGTCATATTTGACTCCAAAACACTAACC | 178 |
| TTATACTCAATCATCCACACATGACACATCTAGTCATATTTGACTCCAAACACTAAC | 177 |
| TTATACTCAATCATCATATAAATGACACATCCAGTCATATTTGACTCGAAAAACACTAACC | 177 |
| TTATACTCAATCATACACACATGATATCTAGTCATATTTGACTCCAAAACACTAACC | 176 |
| TTTTACTCAATCATACACAAATGACATCAAGTTATATTTGACTCCCAAACACTAA | 176 |
| TTATATTCAATCATACACATGACACATCTAGTCATATTTGACTCCCAAACACTAAC | 177 |
| TTATACTTAATCATACACACATGAACTCTAGTCATATTTGAATCCAAAACAGTAACC | 175 |
| TTATACTCAATCATACACACATGACACATCTAGTCATATTTGATTCCGAAAACTAACC | 175 |
| TTATACTCAATCATACTACACATGACACATCTAGCCATATTTGACTCCAAAACACTAACC | 178 |
| TTATACTCAATACTACACATGACATATAGTCTTATTTGACTCCAAAACACTAACC | 154 |
| TTATACTCAATCATACACACATGACACATCTAGTCGTATTTGACTCCAAAACACTAACC | 138 |
| TTATACTCAATCATATAAATGACACTACTCATATTTGACTCCAAAAACTAACC | 178 |
| TTATACTCAATCATACACATGACACATCTAGTCATATCTGACTCCAAAACACTAACC | 178 |
| TTATACTCAATCATACACAAGTAGTCATCTATTCATATTTCACTCCAAAACACTAACC | 178 |
| TAATACTCAATCATACAAATGACCCTGAAGTCATAGTTGACTCCAAAACATTAACC | 138 |
| TTATACTCAATCATACACATGACACATCTAGTCATCATGACTCCAAAACACTAACC | 178 |
| TTATACTTACTCAATCATACACACATGACATTACATCTAGTCATATTTGACTCCGAAAAACTAACC | 175 |
| TTCTACTCAATCATACACACATGACACATCTAGTCATATATGACTCCGAAACACTAACC | 178 |
| TTATATTCGATCATATGACACATCTAGTCATATTTGACTCCAAAATACTAACC | 178 |
| TTATATTCAATCATACTACACATGACACATCTAGTCATATTTGACTCTTATTTGACTCCAAAACACTAACC | 178 |
| TTATACTCAATCATACACACTAGACATCTAGTCATATTTGACTC | 165 |

FIG. 23D-3G

```
f21i2-76  AAGCTTCTTATTTCTTCTCAATGCTTTGATGGTGTAGCCGAAGTCCGTATGAGTTTTGG
f21i2-77  A-GCTTCTCATGCTTCTCTAAAAGCTTTATGGTGTAGCAAAAGTCCGTATGAGTCTTGG
f21i2-78  --------------------------------------------TATGAGTCTTTGG
f21i2-79  ------------CTTCTTATTGCTTCTCAAAGCTTTGATGGTGTAGCCAAAGTCCGTATGAGTCTTTGG
f21i2-8   ------------CTTCTTATTGCTTCTCAAAGCTTTGATGGTGTAGCGTGTGAAGTCCTTATGAGTCTTTGG
f21i2-80  ----------------------------CTTTGATGGTATAGCCGAAGTCCGTATGAGTCTTTGG
f21i2-81  AAGCTACTTCTTGCTTCTCAATGCTTTGATGATGTAGCCGAAGGCCGTATGAGTTTTGG
f21i2-82  AAGCTTCTTCTTGCTTGCTTCTCAAAGCGTTGATGGTGTAGCGTAGCCGAATTTATATGAATCTTTG
f21i2-83  AAGCTTCTTCTTGCTTCTCAAAGCTTTGATAGTGTTGCCATAGTCCGTGTGAATCTTCGG
f21i2-84  ---CTTCCCTTGCTTCTCAAAGCTTTGATGGTGTA-CCAAACTCCGTATGAGTCTATTG
f21i2-86  --------GCTTCTCAAAGCTTTCATGGGTTAGCGTAGCCGAAGTCCGTATGAGTCTTTGG
f21i2-87  AAGCTTCTTATTGCTTCTCAAAACTTTGATGGTGTAGCCAAACGCCGTATGAATCTTTTG
f21i2-88  AAGCTTCTTCTTGCTTGCTTCTCACTAAGCTTTGATGGTGTAGCGTAGCCGAAGTCCGTATGTGTGTTCCG
f21i2-89  AAGCTTCTTATTGCTTCTCAAACCTTTGATGGTGTAGAGGAAGTCCGAAGTCCGTTGG
f21i2-9   AAGCTTCTTATTGCTTCTCAAAGCTTTGATGGTGTAGCCAAAATCCGTAAGAGTCTTTGG
f21i2-90  AAGCTTCTTATTGCTTCTCAAAACTTTATGGTGTAGCGAAGCCAAAGTCCGTTTGAGTCTTTGG
f21i2-91  AAGCTTCTTATTGCTTCTCAAAATTTCATGGTGTACCCAAAGTCTGTTTGAGTCTTTGG
f21i2-92  AAGCTTCTTATTGCTTCTCAAACCTTTGATGGTGTAGTGTCGAACTCTGTATGAGTCTTTG
f21i2-93  A-GCTTCTACATGCTTCTCAAAGCTTTATGGTGTAGCCAAAGTCCGAACGAGTCTTGG
f21i2-94  AAGCTTCTTATTGCTTCTCAAAATTCGATGGTGTATCCGAAGACCGTATGAGTCTTTGG
              10        20        30        40        50        60
```

*FIG. 23D-1H*

```
CTTTGTCTCTTCTCTAA-CAAGGAAAACACTACTTT---------ACCTTTTCGGATCCGATTGCCGGTTCTAATTC
CTTTGTATCTCCTAA-CAAGGAAAACACAACTTT---------AACTTTTGGGAACCGTTTGTGTGTTCTAGGTC
CTTTGTATCCCTCTAA-TAAGAAAAACAC---------TACTTAGGCTTTTAAGATCCAGTTGTGGTTCTACTTC
CTTCGTATCTTCCAA-CAAGGAAACATTACTTT---------AGCTTTTTGGGAATCGGTTGAGGTTCTATTTC
CTTTGTATCTTCTAA-CAAGGAAAACACTACTTT---------AGCTTTTTGGGAAACGGTTGCGATTCTAGTTC
TTTTGGATCTTCTAA-CTTGGAAAACACTACTTT---------AGCTATTGGGAACCTGTTGCGGTTCTAGTTC
TTTTGGATCTTCTAA-TAAGGAAAACACTACTTT---------AGCTTTTTGGGGATCCGGTTGCGGTTCTAGTTC
CTTTGTATCCCTCTAA-CAAGGAAAACACTACTTT---------AGCCCTTTTAAGATTCGTTTGTAGTTCTAGTTC
CTTTGTATCTTCTAA-CAAGTAAAACAC---------TACTTTAGCTTTAGCTTTTTTGGGATCCAGTTGTGGTTCTACTTC
CTTTGTATCTTCTAA-CAAGGAGATACTACTT---------AGGCTTTCAAGATCCAGTTGAGATTCTAGTTC
CTTTGTATCTTCTAG-TAAGGAACCACTACTTT---------AGCTTATGGAAACCAGTTGCGGTTTAGTTC
CTTTGTATCTTCTAACAAGGAAAACACTACTTTGTTAGCTTTGGGAATCAGTTGCGGTTCTAGTTCTTATACT
CTTTGTATCTTCTAACAAGGAGATACTACTTAAGCTTTCAAGATCTAGTTGAGATTCCAGTTCTTATACT
CTTTGTATTTTCTAACAAGGAGAAAACACTTCTGGGGTTTATGATCCGGTTGCGGTTCTAGTTCTTATACT
CTTTGTATCTTCTAACAAGGAAAATATTACTTTAACTTTGGGAATCGGTTGCGGTTATAGTTCTTATACT
CTTAGTATCTTCTAACAAGGAAACATTACTACTCTAGCTTTTAACTTTGGGAATCGGCTGCGGTTCTAGTTCCTATACT
CTTTGTATCTTCTAACAAGGAAACACTACTTTTTGGGTTTGCTTTTAGGCTTTGCGATTCTAGTTCTTATACT
CTTTCTATCTTCTAACAAGGAAAACACTACTACTTGGGAACCGGTTGCGGTTCTAGTTCTTATATT
CTTTGTATGTTCTAACAAGGAGAAAACACTACTTAGGCTTTCAAGATCAAGTTGATATTCTAGTTCTTATACT
CTTTGTATCTCCTAACAAGGAAAACACACAACTTTAACTTTTGGGAACCGGTTGGGGTTGCCGTTCTAGTTCTTATACT
CTTTGTATCTTCTAACAAGGAAACATAACTTTAGCTATTGGGAATCGGTTGCCGTTCAAGTTCTTATGCT
         70          80          90         100         110         120         130
```

FIG. 23D-2H

```
TTATACTCTATCATACAAATGACATCTAGTCATATTTGACTCCAAGACAC              173
TTATACTCAATCATATAAATGACATCTAGTCATATTTGACTCTAAAACACTAACC         177
TTATACTCAATCATACACATGCCATCTAGTCATATTTGACACCAAACACTAACC          131
TTATACTCAATGATACACATGACATCTAGTCATATTTGACTCCAAAATACTAACC         155
TTATACTCAATCATACACATGACATCTAGTCATATTTGACTCCGAAAAACTAACC         175
TTATACTCAATCATCGAACACATGACATCTAGTCATATTTGAGTCCAAAAACTAACC       155
TTATACTCAATCATCATTACACATGACCTGAAGTCATAGTTTATAATTGACTCTTAAACTAACC 178
TTATACTTAATCATACAAATGACCTCATAGTCATGACTCCCAAAACATTAACC           178
TTATACTCAATCATACACATGACATGACCTCTAGTCATATGAATCCAAAACACTAACC      178
TTATACTCAATCATACACATGACATGACATAGTCATATTTGACTCTGAAACTAACC        174
TTATACTCAATCATACACATAACATCTAGTCATCAGATTTGACTCCAAAATACTAACC      166
CAATCATACACATGACATCTAGTCATATTTGACTCCAAAACACTAACC 140          150          160          170

TAATCGTACACATGACGTAGTCATATTTGACTCTGAAACACGAACC                  178
CAATGATACACAAAACATCTAGTCATATTTCACTCCAAAAACAGTAACC               178
CAATCATACACATGACACCTAGTAATATATTGAATCCAAAGCACTAACC               178
CAATCATACACATGACATCTAGTCATAATATTTGACTCCAAAACACTAAC              177
CAATCATACAGATGACATAGTCATACTTTATTTGACTCCAAAACACTAACC             178
CAATCATACACATGACATACTTTTATTTGACTCCAAAATACTAACC                  178
CAATCATACACATGACATCTAGTCATGTAGTCATCTAGTCATATTTGACTCCAAAATACTAACC 178
CAATCATACACATGACATCTAGTCATATTTGACTCTGAAACAATAACC                178
CAATCATAAATGACATCTAGTCATATTTGACTCGAAAAGCACTAACC                 177
CAATCATACACATGACATCTAGTCAT-TTTGACTCCAAAACACTAACC                177
```

*FIG. 23D-3H*

```
f21i2-95   AAGCTTCTTATTGCTTTTCCAAGCTTTTGATTGTGTAGCCGAAGTCCGTATGAGTCTTTGG
f21i2-96   AAGCTTCTTCTTGCTGCTCAATTCTTTGATAGTGTAGCCGAAGTTGTATGAGTCTTTGG
f21i2-97   ------------------------------------------------TATGAGTCTTTGG
f21i2-89   AAGCTTCTTCTTACTTCTCAAAGATTTGATGGTGTAGCCGAAGTCCGTATAAGTCTTTGG
f21i2-99   AAGCTTCTTCTTGCTTCTCAAAGCATTGATGGTGTAGCCGAAAGTCCGTATGAATCTTTGG
f6h8-1     AAGCTTCTTCTTGCTTCTCTTAAAACTTTGATGGTGTAGCCGAAGTCCGTATGAGTCTTTGG
f6h8-10    AAGCTTCTTATTGCTTCTCAAAACTTTGATGGTGTAGCCGAAGTCCGTATGAGTCTTTGG
f6h8-100   AAGCTACTTATTGCTTCTCAAAACTTTGATGGTGTAGCCAAAGTCCGTATGAGTCTTTGG
f6h8-101   AAGCTACTTATTGCTTCTCAAAACTTTGATGGTGTAGCCAAAGTCCGTATGAGTCTTTGG
f6h8-102   AAGCTACTTATTGCTTCTCAAAACTTTGATGGTGTAGCCAAAGTCCGTATGAGTCTTTGG
f6h8-103   AAGCTACTTATTGCTTCTCAAAACTTTGATGGTGTAGCCAAAGTCCGTATGAGTCTTTGG
f6h8-104   ---CTTCTTCTTGCTTCTCTTAAAGCTTTGATGGTGTAGCCAAAGTCCGTATGAGTTTTTAG
f6h8-105   AAGCTTCTTATTGCTTCTCAAAATTTGATGGCTTAGCGTGTAGCGAAGTCCGTATGAGTCTTTGG
f6h8-106   AAGCTTCTTATTGCTTCTCAAAATTTTGATGGTGTACACGAAGTCCGTATGAGTCTTTGG
f6h8-107   AAGCTTCTTATTGCTTCTCAAAATTTTGATGGTGTAGCCGAAGTCCGTATGAGTCTTTGG
f6h8-108   AAGCTTCTTATTGCTTCTCAGAACTTGGATGGCTAGCCGAAGTCCGTATGAGTTTTTAG
f6h8-109   ---CTTCTTGTTGCTTCTCTTAAAGCTTTGATGGTGTAGCCAAAGTCCGTATGAGTTTTGG
f6h8-11    AAGCTTCTTATTGCTTCTCAAAACTTTGATGGTGTAGCCGAAGTCCGTATGAGTCTTTGG
f6h8-110   AAGCTTCTTATTGCTTCTCAAAATTTGATGGTGTACACGAAGTCCGTATGAGTCTTTGG
f6h8-111   ---CTT---------------TGATGGTGTAGCTGAAGTCCATATGATTCTTTTG
f6h8-112   AAGCTTCTTATTGCTTCTCAAAATTTGATGGTGTAGCCGAAGTCCGTATGAGTTTTTAG
f6h8-113   AAGCTTCTTATTGCTTCTCAAACATTAATGGCTTAGCCGAGTCCGGATGAGTTTTAG
```

FIG. 23D-1I

```
CTTTGTATCTTCTAACAAGGAAAACACTACTTTAGCTATTGGGAACCGATTGCGGTTCTAGTTCTTATACT
CTTTGTCTCGTCTAACAAGGAAAACTCTACTTTACCTTTTGGGATCCGGTTGCGGTTCTAGTTCTAATTCTTATACT
CTTTGTATTTCTAACAAGGAAAACACTACTTTAGCTTTTGGGATCAGTTTGCGGTTCTAGTTCTTATACT
ATCTGCATCTTCTAACAAGGAAAACATTTCTTTGGCTTTTAAGATCCGGTTCCGGTTCTAATTCTTATACT
CTTTGTATCTTCTAACAAGGAAAACACTACCTTAAGCTTTAAGATCAGGTTGCGGTTTTGCTTCTTATACT
CTTTGTATCTACTAACAAGGAAAACACTACGCATTAAGATCAGGTTGCGGTTCTAGTTCTTATACT
CTTTGTAGCTTCTAACAAGGAAAACACTACTTTAGCTTTTGGGAAACGGTTGCGGTTCTAGTTCTTATACT
CTTTGTAGCTTCTAACAAGGAAAACACTACTTTAGCTTTTGGGAAACGGTTGCGGTTCTAGTTCTTATACT
CTTTGTATCTTCTAACTAGGAAGAAAACATTACTTTAGCTTTTGGGAACCAGTTGCAGTTCTAGTTCTTATACT
CTTTGTATCTTCTAACTAGGAAGAAAACATTACTTTAGCTTTTGGGAACCAGTTGCAGTTCTAGTTCTTATACT
CTTTGTATCTTCTAACTAGGAAAACATTACTTTAGCTTTTGGGAACCAGTTGCAGTTCTAGTTCTTATACT
CTTTGTATCTTCTAACTAGGAAAACATTACTTTAGCTTTTGGGAACCAGTTGCAGTTCTAGTTCTTATACT
CTTTGTATCTTCTAACTAGGAAGGAAAACATTACTTTAGCTTTTGGGAACCAGTTGCAGTTCTAGTTCTTATACT
CTTTGTATCTTCTAACAAGGAAAACAACAACTTACTTTAGCTTTTGGGAAAATGTTGCGGTTCTAGTTCTTATACT
CTTTGTATCTTCTAACAAGGAAAACATAACTTTAGCTTTTGGGAATCAGTTGTGTTGCCATTCAGTTCTTAAAGTTCTTATACT
CTTTGTATCTTCTAACAAGGAAAACATAACTTTAGCTTTTGGGAATCGGTTGCCGGTTCTAGTTCTTATTCT
CTTTGTATCTTCTAACAAGGAAAACATAACTTTAGCTTTTGGGAATCGGTTGCGGTTCTAGTTTTTATACT
CTTTGTATCTTCTAACAAGGAAAACATAACTTTAGCTTTTAGTTTTTAGCTTTTGGGAATCAGTTGCGGTTCTAGTTCTTATACT
ATTTGTATCTTCTAACAAGGAAAACACAACTTACTTTAGCTTTTGGGAAGATGTTGCGGTTCTAGTTCTTATACT
CTTTGTAGCTTCTAACAAGGAAAACACAACTTACTTTAGCTTTTGGGAAAACGGTTGCGGTTCTAGTTCTTATACT
CTTTGTATCTTCTAACAAGGAAAACACTACTTAACTACTTTAGCTTTTGGGAAACGGTTGCCATTCAGTTCTTATACT
CTTTGTATGTTCTAACAAGGAAAACACTACTTTAGCTTTTGGGAAACGGTTGCCGGTTCTAATTCTTATACT
CTTTGTATCTTCTAACAAGGAAAACACTACTTTAGCTTTTTGGGAAACGGTTGTGGTTAAAGTTCTTATACT
CTTTGTATCTTCTAACAAGGAAAACATTACTTTAGCTTTTTGGGAATCAGTTGTGGTTCAGTTCTTATACT
CTTTGTATCTTCTAACAAGGAAAACATTAATTAGCTTTTCGGAATTTAGTTGCGGTTCTAGTTCTTATACT
```

*FIG. 23D-21*

```
CA-TCATACAAATGACATCTATTCATATTTCACTCCAAAACACTAACC      177
CAATCATACAAATGACATCTAGTCATATTTGACTCATATTTGACTCCAACACAC 173
CAATCAT-CACATGACCCTCTAGTCATATTTGACTCCAAAACACTAA        128
CAAACATACACATGACATCTAGACATATTTGACTCCCAAACACTAA         176
---------------------------------------------C        131
CAATCATACACATGACATCTAGTCATATTTGACTCCAAAACACTAACC       178
CAATCATACACATGACATCTAGTCATATTTGACTCCAAAACACTAACC       178
CAATCATCCACATGACCCTCTAGTCATATGTGACTCCAAAC              171
CAATCATCCACATGACCCTCTAGTCATATGTGACTCCAAAAC             171
CAATCATCCACATGACCCTCTAGTCATATGTGACTCCAAAAC             171
CAATCAAACATAACATAACATCTTGTCTTATTTGACTCCAAAATACTAACC    175
TAATCATACACATAACATCTTGTCTTATTTGACACCAAAATACTAACC       178
CAATCATACACATGACATCTAGTCATATTTGACTCCAAAACACTAACC       178
CAATCATACACATGACATCTAGTCTCTTTTTTGACTCCAAAACACTAACC     178
CAATCATACACATGACATCTAGTCATATTTGACTCCAAAACACTAACC       178
CAATCGTACACATGACATCTAGTCATATTTGACTCCGAAAAACTAACC       178
CAATCAAACACATAACATCTAGTCATATTTGACTCCCAAAAACTAAC        174
CAATCATACACATGACATCTAGTCATATTTGACTCCAAAACACTAAC        177
CAATCATACACATGACATCTAGTCATATTTGACTCCAAAACACTAACC       178
CAATCATACACATGACAT-CAGTCATATTTGACTCCAAAA               146
TAATCATACACATAACATCTTGTCTTATTTGACACCAAAATACTAACC       178
CAATCATACACATGACATCTAGCCATATTTGATTCCGAAAACTAACC        178
```

*FIG. 23D-3I*

```
f6h8-114  AAGCTTCTTATTGCTTCTCAAAATTTTGATGGTGTACACGAAGTCCGTATGAGTCTTTGG
f6h8-115  AAGCTTCTTATTGCTTCTCAAAAATTTTGATCCTGTACACGAAGTCCGTATGAGTCTTTGG
f6h8-116  ------------------------------TTTGATGGTGTAGCCGAAGTCCGTATGAGTCTTTGA
f6h8-117  ------------------------------TTTGATGGTGTAGCCGAAGTCCGTATGAGTCTTTGA
f6h8-118  AAGCTTCCTATTGCTTCTCAAAACATTAATGGCTTAGCCGAAGTCCGTATGAGTTTTTAG
f6h8-119  AAGCTTCTTATTGCTTCTCAAAATTTTGATGGTGTACACGAAGTCCGTATGAGTCTTTAG
f6h8-12   AAGCTTCTTATTGCTTCTCAAAACTTTGATGGTGTAGGTGTAGCCGAAGTCCGTATGAGTCTTTGG
f6h8-120  AAGCTTCTTATTGCTTCTCAAAATTTTGATGGTGTACACGAAGTCCGTATTAGTCTTTGG
f6h8-121  AAGCTTCTTATTGCTTCTCAAAATTTCATGGTGTAGCCGAAGTCCGTATGAGTCTTTGG
f6h8-122  AAGCTTCTTATTGCTTCTCAAAATTTCATGGTGTAGCCGAAGTCCGTATGAGTCTTTGG
f6h8-123  AAGCTTCTTATTGCTTCTCAAAATTTTGATGGCTTAGCCGAAGTCCGTATGAGTTTTTAG
f6h8-124  AAGCTTCTTATTGCTTCTCAAAATTTTGATGGTGTACACGAAGTCCGTATGAGTCTTTGG
f6h8-125  AAGCTTCTTATTGCTTCTCAAAACATTAATGGCTTAGCCGAGTCCGTATGAGTTTTTAG
f6h8-126  ------------------------------TTTGATGGTGTAGCCGAAGTCCGTATGAGTCTTTGA
f6h8-127  AAGCTTCTTATTGTTTCTCAAAACTTTTATGGTGAAGCCAAAGTCCGTATGAGTATTTGT
f6h8-128  AAGCTTCTTATTGATTCTCAAAATTTGATGGTGTACACGAAGTCCGTATGAGTCTTTGG
f6h8-129  AAGCTTCTTATTGCTTCTCAAAATTTGATGGTGTACGAAGTCCGAAGTCCGTATGAGTCTTTGG
f6h8-13   AAGCTTCTTATTGCTTCTCAAAACTTTGATGGTGTAGCCGAAGTCCGTATGAGTCTTTGG
f6h8-130  ---CTT---------TGATGGTGTAGCTGAAGTCCGAAGTCCGTATGAGTCTTTG
f6h8-131  AAGCTTCTTCTAGTTTCTCAAAGATTTCATGGTGTAGCCGAAGTCCGTATGAGTCTTTGG
f6h8-132  AAGCTTCTTCTAGTTTCTCAAAGATTTGATGGTGTAGCCGAAGTCCATATGAGTCTTTGG
f6h8-133  ---CTTCTTGTTGCTTCTTAAAGCTTTGATGGTGTAGCCAAAGTCCGTATGAGTTTTTGG
```

```
CAATCATACACATGACATGACATCTAGTCATATTTGACTCCAAAACACTAACC      178
CAATCATACACATGACATGACATCTAGTCATATTTGACTCCAAAAAACTAACC      178
CAATCATACACATGACATGACATCTAGTCATATTTGACTCCAAAA              146
CAATCATACACATGACATGACATCTAGTCATATTTGACTCCAAAA              146
CAATCATACACATGACATGACATCTAGCCATATTTGATTCCGAAAAACTAACC      178
CAATCATACACATGACATGACATCTAGTCATATTTGACTCCAAAACACTAACC      178
CAATCATACACATGACATGACATCTAGTCATATTTGACTCCAAAACACTAAC       177
CAATCATACACATGACATGACATCTAGTCATATTTGACTCCAAAACACTAACC      178
CAATACACATGACATGACATATAGTCATATTTGACTCCAAAACACTAACC         178
CAATACACATGACATGACATATAGTCTTTTTTGACTCTTTTTGACTCCAAAACACTAACC  178
TAATCATACACATGACATGACATCTAGTCATATTTGACTCTAAAA              170
CAATCATACACATGACATGACATCTAGTCATATTTGACTCCAAAACACTAACC      178
CAATCATACACATGACATGACATCTAGCCATATTTGATTCCGAAAAACTAACC      178
TAATCATACACATGACATGACATCTAGTCATATTTGACTCCAAAA              146
CAATCATACACATGACATGACATCTTGTCATACTTGACTCCAAAACATTAACC      178
CAATCATACACATGACATGACATCTAGTCATATTTGACTCCAAAACACTAACC      178
CAATCATACACATGACATGACATCTAGTCATATTTGACTCCAAAACACTAACC      178
CAATCATACACATGACATGACATCTAGTCATATTTGACTCCAAAACACTAACC      178
CAATCATACACATGACAT-CAGTCATATTTGACTCCAAAA                   146
CAATCATACACATGACATGACATAGTCTTATTTGACTCCAAATTACTAACC        178
CAATCATACACATGCCATATAATCATATTTGAATCCAAAGCACT               174
CAATCAAACACATAACATCTTGTCATATTTGACTCCAAAAACTAAC             174
```

*FIG. 23D-3J*

| | |
|---|---|
| f6h8-134 | AAGCTTCTTATTGCTTCTCTCAAAATTTTGATGGTGTACACGAAGTCCGTATGAGTCTTTGG |
| f6h8-135 | ---CTTCTTGTTGCTTCTCTTAAAGCTTTGATGGTGTAGCCAAAGTCCGTATGAGTTTTTGG |
| f6h8-136 | AAGCTTCTTATTGCTTCTCTCAAAACATTAATGGCTTTGATGGTGTAGCCGAGTCCGTATGAGTCTTTGG |
| f6h8-137 | AAGCTTCTTATTGCTTCTCTTCATAGCTTTGATGGTGTAGCTGAAGTCCATATGAGTCTTTGG |
| f6h8-138 | AAGCTTCCTATTGCTTCTCTCAAAACATTAATGGCTTTGATGGTGTAGCCGAAGTCCGTATGATTCTTTAG |
| f6h8-139 | AAGCTTCTTATTGCTTCTCTTCAAAGCTTTGATGGTGTAGCCGAAGTCCGAATGAATCTTTGG |
| f6h8-14  | AAGCTTCTTATTGCTTCTCTCAAAACTTTGATGGTGTAGCCGAAGTCTGTATGAGTCTTTGG |
| f6h8-140 | AAGCTTCTTATTGCTTCTCTCAAAATTTCATGGTTTGATGGCTTAGCCGAAGTCCGTATGAGTCTTTGG |
| f6h8-141 | AAGCTTCTTATTGCTTCTCTCAAAATTTTGATGGCTTTGATGGTGTAGCCGAAGTCCGTATGAGTTTTTAG |
| f6h8-142 | ---CTTCTTGTTGCTTCTCTTAAAGCTTTGATGGTGTAGCCAAAGTCCGTATGAGTTTTTGG |
| f6h8-143 | ---CTTCTTGTTGCTTCTCTTAAAGCTTTGATGGTGTAGCCAAAGTCCGTATGAGTTTTTGG |
| f6h8-144 | ---CTTCTTGTTGCTTCTCTTAAAGCTTTGATGGTGTAGCCAAAGTCCGTATGAGTTTTTGG |
| f6h8-145 | ---CTTCTTGTTGCTTCTCTTAAAGCTTTGATGGTGTAGCCAAAGTCCGTATGAGTTTTTGG |
| f6h8-146 | AAGCTTCTTATTGCTTCTCAAAACATTAATGGCTTTGATGGTGTAGCCGAAGTCCGTATGAGTTTTTAG |
| f6h8-147 | ---CTTCTTGTTGCTTCTCTTAAAGCTTTGATGGTGTAGCCAAAGTCCGAAGTCCGTATGAGTTTTTGG |
| f6h8-148 | ---CTTCTTGTTGCTTCTCTTAAAGCTTTGATGGTGTAGCCAAAGTCCGTATGAGTTTTTGG |
| f6h8-149 | ---CTTCTTGTTGCTTCTCTTAAAGCTTTGATGGTGTAGCCAAAGTCCGTATGAGTTTTTGG |
| f6h8-15  | AAGCTTCTTATTGCTTCTCTCAAAACTTTGATGGTGTAGCCGAAGTCCGTATGAGTCTTTGG |
| f6h8-150 | ---CTTCTTGTTGCTTCTCTTAAAGCTTTGATGGTGTAGCCAAAGTCCGTATGAGTTTTTGG |
| f6h8-151 | ---CTTCTTGTTGCTTCTCTTAAAGCTTTGATGGTGTAGCCAAAGTCCGTATGAGTTTTTGG |
| f6h8-152 | ---CTTCTTATTGCTTCTCTCAAAACATTATTGGCTTTGATGGCTTAGCCGAAGTCCGTATGAGTTTTTAG |
| f6h8-153 | ---CTTCTTATTGCTTCTCTCAAAAATTTGATGGTGTAGCTTAGCCGAAGTCCGTATGAGTTTTTAG |
| f6h8-154 | ---CTTCTTGTTGCTTCTTAAATCTTTGATGGTGTAGCCAAAGTCCGTATGAGTTTTTGG |

```
CAATCATACACATGACATCTAGTCATATTTGACTCCAAAAACACTAACC  178
CAATCAAACACATAACATCTTGTCATATTTGACTCCAAAAAACTAAC    174
CAATCATACACATGACATCTAGCCATATTTGATTCCGAAAAACTAACC   178
CAAACATACACATGACATCTTGTCATACTTGACTCCTAAAACATTAACC  178
CAATCATACACATGACATCTAGCCATATTTGATTCCGAAAAACTAACC   178
CAATCATACACATGACATCTAGTCATATTTGATTCCGAAAAACTAACC   177
CAATCATCCACATGACATCTAGTCATATTTGACTCCCAAAACTAAC     178
CAATCATACACATGACATCTAGTCATATTTGACTCCAAAACACTAACC   177
CAATACTACACATGACATAGTCTTTTTGACTCCAAAACACTAAC       171
CAATCATCCACATGACCCTCTAGTCATATGTGACTCCAAAA------C   175
CAATCAAACACATAACATCTTGTCTTATTTGACTCCAAAATACTAACC   175
CAAACAAACACATAACATCTTGTCTTATTTGACTCCAAAATACTAACC   175
CAATCAAACACATAACATCTTGTCTTATTTGACTCCAAAATACTAACC   175
CAATCAAACACATAACATCTTGTCTTATTTGACTCCAAAATACTAACC   175
CAATCATACACATGACATCTAGCCATATT                      159
CAATCAAACACATAACATCTTGTCTTATTTGACTCCAAAATACTAACC   175
CAATCAAACACATAACATCTTGTCTTATTTGACTCCAAAATACTAACC   175
CAATCAAACACATAACATCTTGTCTTATTTTACTCCAAAATACTAACC   175
CAATCATACACATGACATCTAGTCATATTTGACTCCAAAACACTAACC   178
CAATCAAACACATAACATCTTGTCTTATTTGACTCCAAAATACTAACC   175
CAATCAAACACATAACATCTTGTCTTATTTGACTCCAAAATACTAACC   175
CAATCAAACACATAACATCTTGTCTAGCCATATTTGATTCCGAAAAACTAACC 175
TAATCATACACATAACATCTTGTCTTATTTGACACCAAAATACTAACC   175
CAATCAAACACATAACATCTTGTCTTATTTGACTCCAAAATACTAACC   175
```

```
TAATCATACACATAACATCTTGTCTCTTATTTGACACCAAAATACTAACC  175
CAATCAAACACATAACATCTTGTCTCTTATTTGACTCCAAAATACTAACC  175
CAATCAAACACATAACATCTTGTCTCTTATTTGACTCCAAAATACTAACC  175
CAATCAAACACATAACATCTTGTCTCTTATTTGACTCCAAAATACTAACC  175
CAATCAAACACATAACATCTTGTCTCTTATTTGACTCCAAAATACTAACC  175
TAATCATACACATAACATCTTGTCTCTTATTTGACACCAAAATACTAACC  175
CAATCATACACATGACATCTAGTCATATTGACTCCAAAACACTAACC     178
CAATCAAACACATAACATCTTGTCTCTTATTTGACTCCAAAATACTAACC  175
CAATCAAACACATAACATCTTGTCTCTTATTTGACTCCAAAATACTAACC  175
CAATCAAACACATAACATCTTGTCTCTTATTTGACTCCAAAATACTAACC  175
CAATCAAACACATAACATCTTGTCTCTTATTTGACTCCAAAATACTAACC  175
CAATCATACACATGACATCTAGTCATATTGACTCCAAAAACACTAACC    178
CAATACTACACATGACATCTAGTCATATAATCTTTTTGACTCCAAAACACTAACC  178
CAATACTACACATGACATCTAGTCATATAATCTTTTTTGACTCCAAAACACTAACC 178
CAATCATACACATGACATCTAGTCATATTGATTCCGAAAAACACTAACC   178
CAATCAAACCCATAACATCTAGTCATATTGACTCCCCAAAAACTAAC     174
CAATCATACACATTACACTCTAGTCATATTTGATTCCAAAACACTAACC   178
CAATCATACACATGACATCTAGTCATATTGACTCCAAAACACTAACC     178
CAATCATACACATGACAAGTAGTCATATCTGACTTCAAAACACTAACC    178
CAATCAAACACATAACATCTTGTCATATTGACTCCAAAAACTAAC       174
CAATCATACACATGACATCTAGCCATATTTGATTCCGAAAACTAACC     150
CAATCATACACATGACATCTAGCCATATTTGATTCCGAAAACTAACC     150
CAATCATACACATGACATCTAGCCATATTTGATTCCGAAAACTAACC     178
```

```
CTTTGTATCTTCTAACAAGGAAACATTAATTTAGCTTTTTGGGAATTAGTTGCGGTTCTAGTTCTTATACT
CTTTGTATCTTCTAACAAGGAAACACTACTTTTGCTTTTTGGGAACCAGTTGCGGTTCTAGTTCTTATACT
CTTTGTATCTTCTAACAAGGAAACAATACTACTTTATCTCTTGGGAACCAGTTGCGGTTCTAGTTCTCTACT
CTTTGTATCTTCTAACAAGGAAACACTACTACTTTTTTCTTTGGGAACCAGTTGCGGTTCTAGTTTTTATACT
CTTTGTATCTTCTAACAAGGAAACACTACTACTTTTTGCTTTTGGGATCCAGTTGTGGTTCTAGTTCTTATACT
CTTTGTAGCTTCTAACAAGGAAACACTACTACTTTAGCTTTTTGGGAAATGGTTGCGGTTCTAGTTCTTATACT
CTTTGTATCTTCTAACAAGGAAACACTACTACTTTAGCTTTTTGGGATCCAGTTGGTTCTAGTTTTTATACT
CTTTGTATCTTCTAACAAGGAAACACTAACTTTAGCTATTGGGAATCGGTTGCCATTCTAGTTCTTATATT
CTTTCTATCTTCTAACAAGGCAACACTACTTTGGCTTTTGGGAACCGGTTGCGATTCTAGTTCTTATATT
CTTTGTATCTTCTAACAAGGAAACACTACTACTTTTGCTTTTTGCTTTTGGGATCCAGTTGTGGTTCTAGTTTTTATACT
CTTTGTATCTTCTAACAAGGAAACATAACTTTAGCTATTGGGAATCGGTTGCCATTCTAGTTCTTATACT
CTTTGTATCTTCTAACAAGGAAACACTACTTTTGCTTTTTGGGATCCAGTTGTGGTTCTAGTTCTTATACT
CTTTGTATCTTCTAACAAGGAAACACTACTTTAATTAGCTTTTTGGGAATTAGTTGCGGTTCTAGTTCTTATACT
CTTTGTATCTTCTAACAAGGAAACATTAATTAGCTTTTTGGGAATTAGTTGCGGTTCTAGTTCTTATACT
CTTTGT-TCTTCAAACAAGGAAACATTAATTAGCTTTTTGGGAATTAGTTGCGGTTCTAGTTCTTATACT
CTTTGTATCTTCTAACAAGGAAACATTAATTAGCTTTAGCTTTTTGGGAATCGGTTGCGGTTCTAGTTCTTATACT
CTTTGTAGCTTCTAACAAGGAAACATTAATTACTTTAGCTTTTTGGGAAACGGTTGCGCGTTCTAGTTCTTATACT
CTTTGTATCTTCAAACAAGGAAATATTACTTTAGTTTTTGGGAATCGGTTGCGGTTCTAGTTCTTATATT
CTTTGAATCTTCTAACAAGGAAACACTACTTTTGCTTTTTGGGAAGCAGTTGCGGTTCTAGTTCTTATACT
CTTTGTATCTTCTAACAAGGAAACACTACTTTTGCTTTTTGCTTTTTGGGAACCAGTTGCGGTTCTAGTTTTTATATT
CTTTGTATCTCCTAACAAGGAAACACAACTTAACTTAACTTTAGCTTTTTGGGAACCGGTTGTGGTTCTAGGTCTTATACT
CTTTGTATCTTCAAACAAGGAAACATTACTTAGCTTTTTGGGAATCGGTTGCGGTTCTACTTCTTATACT
```

FIG. 23D-2M

```
CAATCATACACACATGACACATCTAGCCCATATATTTGATTCCGAAAAACTAACC   150
CAATACTACACACATGACACATAGTCTTTTTGACTCCAAAACACTAACC          178
CAATCATACACACATGACACATAGTCATATTTGACTCCGAAACACTAACC         178
CAATCATACACACATGACACATAGTCTTTTTTGACTCCAAAACACTAACC         178
CAATCATACACACATGACACATATAATCTTTTTTGACTCCAAAACACTAACC       178
CAATCATACACACATGACACATAGTCATATTTGACTCCAAAACACTAACC         178
CAATCATACACACATGACACATAATCTTTTTTGACTCTAAAACACTAACC         178
CAATCATACACACATGACACATCTAGTCATATTTGACTCCAAAACACT           174
CAATCATACTACACATGACACATCTAGTCTTATTTGACTCCAAAACACTAACC      178
CAATACTACACACATGACACATAGTCATATTTGACTCCAAAACACTAACC         178
CAATCATACACACATGACACATAATCTTTTTTGACTCCAAAACACTAACC         178
CAATCATACACACATGACACATAATCTTTTTTGACTCCAAAACACTAACC         178
CAATCATACACACATGACACATCTAGCCCATATTTGACTCCAAAACACTAACC      150
CAATCATACACACATGACACATCTAGCCCATATTTGATTCCGAAAACTAACC       178
CAATCATACACACATGACACATCTAGTCTAGTCGTATTTGACTCCAAAACACTAACC  154
CAATCATACACACATGACACATCTAGCCCATATTTGACTCCAAAA              150
CAATCATACACACATGACACATCTAGTCATATTTGACTCCAAAA               170
CAATCATACACATATAAATGACACATCTAGTCATATTTGACTCCAAAA           146
CAATCATCCACACATGACACATCTAGTCATATTTGACTCCAAAACACTAAC        134
CAATACTACACACATGACACATAGTCTTTTTTGACTCCAAAACACTAACC         178
CAATCATACACACATGACACATCTAGTCATATTTGACTCTAAAACACTAACC       177
CAATCATACACACATGACACATC-AGTCATATTTGACTCCAAAA               145
```

```
f6h8-195  ---------------------------------CTTCTTGTTGCTTTCTTAAAGCTTTGATGGTGTAGCCAAAGTCCGTATGAATTTTGG
f6h8-196  ---------------------------------CTTCTTATTGCTTTTCAAAACATTGATGGCTTAGTCGAAGTCCGTATGAGTTTTAG
f6h8-197  ---------------------------------CTTCTTGTTGCTTTCTTAAAGCTTTGATGGTGTAGCCAAAGTCCGTATGAGTTTTGG
f6h8-198  ---------------------------------------------------------------------------------------------
f6h8-199  ---------------------------------CTTTGATGGTGTAGCCAAAGTCCGTATGAGTTTTGG
f6h8-2    AAGCTTCTTATTGCTTTCTTAAAGCTTTGATGGTGTAGCCGAAGTCCGTATGAGTCTTTGG
f6h8-20   ---TTCTTATTGCTTCTCAAAGTTTTGATGGTGTAGCCAAATCCGTATGAGTCTCTAT
f6h8-200  ---CTTCTTGTTGCTTTCTTAAAGCTTTGATGGTGTAGCCAAAGTCCGTATGAGTTTTGG
f6h8-201  ---CTTCTTGTTGCTTTCTTAAAGCTTTGATGGTGTAGCCAAAGTCCGTATGAGTTTTGG
f6h8-202  AAGCTTCTTATTGCTTCTCAAACCTTTGATGGTGTAGAGGAAGTCCGTATGAGTCGTTGG
f6h8-203  AAGCTTCTTATTGCTTCTCAAAATTTCATGGTGTACCCAAAGTCTGTTTGAGTCTTTGG
f6h8-204  AAGCTTCTTATTGCTTCTCAAAATTTCATGGTGTAGCCAAAGTCCGAAGTGAGTCTTTGG
f6h8-205  AAGCTTCTTATTGCTTCTCAAAATTTCATGGTGTAGCCAAAGTCCGAAGTCAGTCTTTGG
f6h8-206  AAGCTTCTTATTGCTTCTCAAAATTTCATGGTGTAGCCAAGTCCGAAGTCCGAAGTCTTTGG
f6h8-207  AAGCTTCTTATTGCTTCTCAAAATTTCATGGTGTAGCGCAGCCAAGTCCGAAGTCCGAAGTCTTTGG
f6h8-208  AAGCTTCTTATTGCTTCTCAAAATTTCATGGTGTAGCCAGCCAAGTCCGAAGTCCGAAGTCTTTGG
f6h8-209  AAGCTTCCTATTGCTTCTCAAACATTAATGGCTTAAGGTGTAGCCGAAGTCCGTATGAGTTTTAG
f6h8-21   AAGCTTCTTATTGCTTCTCAAAATTTGATGGTGTAGCCGAAGTCCGTATGAGTCTTTGG
f6h8-210  AAGCTTCTTATTGCTTCTCAAAATTTCATGGTGTAGCCGAAGTCCGTATGAGTCTTTGG
f6h8-211  AAGCTTCTTATTGCCTTCTTCTCAAAACTTTGATGGTGTACACGAAGTCCGTATGATTCTTTGG
f6h8-212  AAGCTTCTTATTTCTTCTCAAAACTTTGATGGTGTAGCCGAAGTCCGTATGAGTCTTTGC
f6h8-213  AAGCTTCTTATTGCTTCTCAAAATTTCATGGTGTAGCCGAAGTCCGTATGAGTCTTTGG
```

```
CTTTGTATCTTCTAGAAGGGAAACACAACTTTAGCTTTTTGGGAAGATGTTGCGGTTATAGTTCTTATACT
CTTTGTATCTTCAACAAGGAAACACAATTAATTAGCTTTTTGGGAATTAGTTGCGGTTCTAGTTCTTATACT
CTTTGTATCTTCTAGAAGGGAAACACAACATTAGCTTTTTGGGAAGATGTTGCGGTTATAGTTCTTATACT
CTTTGTATCTTCCAACAAGGAAACACAACATTACTTAGCTTTTTGGGAATCGGTTCTATTCTTATACT
CTTTGTATCTTCTAGAAGGGAAACACAACTTACTTAGCTTTTTGGGAAGATGTTGCGGTTCTTCTTATACT
CTTTGTATCTTCTAGAAGGGAAACACAACACTACTTAGCTTTTTGGGAAGATGTTGCGGTTCTAGTTCTTATACT
CTTTGTAGCTTCTAACAAGGAAACACTACTTTAGCTTTTTGGGAAACGGTTGCGGTTCTAGTTCTTATGCT
CTTTGTATCTTCTAACAAGGAAACACACTACTTTAGCTTTTTGGGAACCAGTTGCGGTTTAGTTCTTATACT
CTTTGTATCTTCTAGAAGGGAAACACAACACTTTAGCTTTTTGGGAAGATGTTGCGGTTATAGTTCTTATACT
CTTTGTATCTTCAAACAAGGAAATATTACTTTAACTTTTTGGGAATCGGTTGCGGTTATAGTTCTTATACT
CTTAGTATCTTCTAACAAGGAAACACTACTTTTGCTTTTTGGGAACTGGTTGCGGTTCTAGTTCTTATACT
CTTTGTATGTTCTAACAAGGAAACACTACTTTTGCTTTTTGGGATCCAGTTGTGGTTCTAGTTTTATACT
CTTTGTATCTTCTAACAAGGAAACACTACTTTTGCTTTTTGGGAACCAGTTGCGGTTCTAGTTTTATACT
CTTTGTATCTTCTAACAAGGAAACACTACTTTTGCTTTTTGGGAACCAGTTGCGGTTCTAGTTTTATACT
CTTTGTATCTTCTAACAAGGAAACACTACTTTTGCTTTTTGGGAACCAGTTGCGGTTCTAGTTTTATACT
CTTTGTATCTTCTAACAAGGAAACACTACTTTTGCTTTTTGGGAACAAGTTGCGGTTCTAGTTTTATACT
CTTTGTATCTTCTAACAAGGAAACACTACTTTTGCTTTTTGGGAACCAGTTGCGGTTCTAGTTTTATACT
CTTTGTATCTTCTAACAAGGAAACACATAATAACTTTAGCTTTTTGGGAACCAGTTGCGGTTCTAGTTTATACT
CTTTGTATCTTCTAACAAGGCAACATTAATTAGCTTTTTGGGAATTAGTTACGGTTCTAGTTCTTATACT
CTTTGTAGCTTCTAACAAGGAAACACTACTTTAGCTTTTTGGGAAAACGGTTGCGGTTCTAGTTCTTATACT
CTTTGTATCTTCTAACAAGGAAACATAACTTTTGCTTTTTGGGAACCAGTTGCGGTTCTAGTTTTATACT
CTTTGTATCTTCTAACAAGGAAACACTACTTTTAGCTATTGGGAACCATTCGGTTCTAGTTCTTATACT
CTTTGTATCTTCTGCTAACAGGAAACATAACTTACTTTGCTTTTTGGGAACCAATTGCGGTTATAGTTTTTATACT
CTTTGTATCTTCTAACAAGGAAACACTACTTTTGCTTTTTGGGAACCAGTTGCGGTTCTAGTTTTATACT
```

*FIG. 23D-2N*

```
CAATCAAACACATAACATCTTGTCTTATTTGACTCCAAAATACTAACC    175
CAATCATAAACATGACATCTAGTCATATTTGACTCCCAAAAACTAACC    175
CAATCAAACACATATCATCTTGTCTTATTTGACTCCAAAATACTAACC    175
CAATGATACATATGACATCCTGTAATATTTGACTCCAAAATACTAACC    155
CAATCAAACACATAACATCTTGTCTTATTTACTCCAAAATACTAACC     175
CAATCATACACATGACATCTAGTCATATTTGACTCCAAAATACTAACC    178
CAATCATAGACATGACATCAAGTCATATTTGACTCCAAAACACTAACC    174
CAATCAAACACATACATATCTTGTCTTATTTGACTCCAAAATACTAACC   175
CAATCAAACACATATCATCTTGTCTTATTTGACTCCAAAATACTAACC    175
CAATCATACACATGACACCTAGTAATATTTGAATCCAAAGCACTAACC    178
CAATACTACACATGACATATACTTTTATTTGACTCCAAAATACTAACC    178
CAATACTACACATGACATATATTCTTTTTTGACTTTACTCCAAAACACTAACC 178
CAATCATACACATGAGATATAGTCTTTTTTTACTCCAAAACACTAACC    178
CAATACTACACATGAGATATAGTCGTTTTTTTTTGACTCCAAAACACTAACC 178
CAATACTACACATGACATAGTCTTTTTTTTGACTCCAAAACACTAACC    178
CAATCATACACATGACATCTAGCCATATTTGATTCCGAAAAACTAACC    178
CAATCATACACATGACATCTAGTCATATTTGACTCCAAAACACTAACC    178
CAATACTACACATGACATCTTTTTACTCCAAAACACTAACC           178
CAATCATACACATGACATCTAGTCATATTTGACTCCAAAACACTAACC    178
CAATACTACACATGAGATATAGTCTTTTTTTACTCCAAAACACTAACC    178
```

```
CAATCAAACACATAACATCTTGTCTTATTTGACTCCAAA             166
CAATCATACACATGACATCTAGCCATATTTGATTCCGAAAAACTAACC    178
CAATACTACACATGAGATAGTCTTTTTACTCCAAAACACTAACC        178
CAATCATACACATGACATCTAGCCATATTTGATTCCGAAAAACTAACC    150
CAATCATACACATGACATCTAGTCAT-TTTGACTCCAAAACACTAACC    177
CAATTATCCACTTGACATCTAGTCATATTTGACTCTAAAACACTA       171
CAATCATACACATGACATCTAGTCATATTTGACTCCAAAACACTAACC    178
CAATCATACACATGACA                                    147
CCATCATACACATGACATCTAGTCATATTTGACTCTAAAACACTA       175
CAATGATACACATGACATCCTGTAATATTTGACTCTAAAATACTAACC    155
CAAACACATAACATACATCTTGTGTTATTTGACTCCAAATACTAACC     175
CAATACTACACATGACATATCTTTTTTGACTTCAAAACACTAACC       178
CAATACTACACATGAGATATAGTCGTTTTTACTCCAAAACACTAACC     178
CAATACTACACATGAGATATAGTCGTTTTTTACTCCAAAACACTAACC    178
CAATACTACACATGAGATATAGTCTTTTTTTTACTCCAAAACACTAACC   178
TAATCAAACACATAACATCTAGTCATATTTGACTCCAAAAACACTAAC    174
CAATACTACACATGACATCTAGTGTTTTTTGACTCCAAAACACTAACC    178
CAATCATACATGACATCTAGTCATATTTGACTCCAAAACACTAACC      174
CAATACTATACATGACATATAGTCTTATTTGACTCCAAAACACTAACC    178
CAATCATATAAATGACATCCAGTTATATTTGACTGGAAAACACTAACC    177
CAATACTACACACGACATATAGTCTTTTTTGACCCCAAAACACTAAC     177
```

FIG. 23D-30

```
              AAGCTTCTTATTGCTTCTCAAAACTTTGATGGTGTAGCCGAAGTCCGTATGAGTCTTTGG
                       10        20        30        40        50        60
f6h8-232      AAGCTTCTTACTGCTTCTCAAAATTTCATGGTGTAGCCGAAGTCCGTATGAGTCTTTGG
f6h8-233      AAGCTTCTTATTGCCTTCTCACACAAAGCTTTGATGGTGTAGCCGAAGTCGGTATGAGTCTTTGG
f6h8-234      ----TTCTTATTGCTTCTCCAAGCTTTGATGGTGTAGCCGAAGTCCGTATGTGTATTTAG
f6h8-235      ----GCTTCTTAAATGCTTCTCCAAAACTTTATGGTGTAGCCGAAGTCCGTATAAGTCTTTGG
f6h8-236      ----CTTCTTATTGCTTCTCAAAATTTGATGGTGTATCCGAAGTCTGTATGAGTTTTTGG
f6h8-237      ----------------CTTTGATGGTGTAGCCGATGTCCGTATGAGCCTTTGG
f6h8-238      AAGCTTCTTATTGCTTCTCCATAGCTTTGATGGTGTAGCTGAAGTCCATATGAGTCTTTGG
f6h8-239      ---CTTCTTATCGCTTCTCAAAATTTCATGGTGTAGCCGAAGTCCGTATGAGTCTTTAG
f6h8-24       AAGCTTATTATTGCTTCTCAAAATTTTCATGGTGTAGCCGAAGTCCGTATGAGTCTTTGG
f6h8-240      AAGCTTCTTATTGCTTCTCAAAATTTCATGGTGTAGCCGAAGTCCGTATGTGTCTTTGG
f6h8-241      ------T-GCTTCTTAAAGCTTTGATGGTGTAGCCGAAGTCCTTATGACTTTTTGG
f6h8-242      ----CTTCTTGTTGCTTCTTAAAGCTTTGATTGTGTACCAAAGTCCGTATGAGTTTTTTG
f6h8-243      AAGCTTCTTATTGCCCTTCTCACAACAAAGCTTTGATGATGTAGCCGAAGTCCGTAGTGAGTCTTTCA
f6h8-244      AAGCTTCTTATTGCTTCTCAAAATTTCATGGTGTTGCCGAAGTCCGTATGTGTCTTTGG
f6h8-245      AAGCTTCTTATTGCCCTCACAAAAGCTTTGATGGTGTAGCCGAAGTCGGTATGAGTCTTTGG
f6h8-246      ----------TTGCTTCTTAAAGCTTTGATGGTGTAGCCGAAGTCCGTATGACGTTTCTTTGG
f6h8-247      ----CTTTGATGGTGTAGCCGAAGTCCGTATGAGTCTTTGG
f6h8-248      AAGCTTCTTATTGCTTCTCAATATTTCATGGTGTTGCCGAAGTCCGTAAGAGTCTTTGG
f6h8-249      AAGCTTCTTATTGCTTCTCAAAATTTGATGGTGTAAACGAAGAAGTCCGTATGAGTCTTTGG
f6h8-25       AAGCTTCTTATTGCTTCTCAAAATTTGATGGTGTACACGAAGTCCGAAGTCTTTGG
```

*FIG. 23D-1P*

```
ABCDGTATCTTCTAACAAGGAAACATTACTTTAGC---TTTTGGGAATCGGTTGCGGTTCTA-GTTCTTAT
       70        80        90       100       110       120       130
CTTTGTATCTTCTAACAAGGAAACACTACTTTTGC---TTTGGGAACCAGTTGCGGTTCTA-GTTTTTAT
CTTTGTATCTTCTACAAACAAG-AAACATTACTTTAGC---TTTGGGAATCGGTTGCGGTTCTA-CTTCTTAT
CTTTGTATCTTCAAACAAGGAAACATTACTTTAGC---TTTGGGAATCAGTTGCGGTTCTA-GTTCTTAT
ATTTGTATCTTTTATAAGGAAACATTACTTTCGC---TTTGGGAATTGGTTGCGGTTCTA-GTTCTTAT
CTTTGTATCTTCTAATAGGGAAACATAACTTTAGC---AATTGGGAATCGGTTGCCGTTCTA-GTTCTTAT
TTTTGTATCTTCAAACAAGGAAACATTACTTTAGC---TTTGGGAATTGGTTACGGTTCTA-GTTCTTAT
CTTTGAATCTTCTAATAAGGAAACACAACTTTAAC---TTTTGGGAACCGGTTGTGGTTCTAGGT-CTTAT
CTTTGTATCTTCTAGAAGGGAAACACACACTTTAGC---TTTGGGAATCAGTTGTGGTTCTA-GTTCTTAT
CTTTGTATCTTCTAGAAGGGAAACACACACTTTAGC---TTTGGGAATCAGTTGTGGTTCTA-GTTCTTAT
CTTTGTAGCTTCTAACAAGGAAACACACTACTTTAGC---TTTCGGGAAACGGTTGCAGTTCTA-GTTCTTAT
CTTTGTATCTTCTAACAAGGAAACACACACTAAATTTGC---TTTGGGAACCAGTTGCGGTTCTA-GTTTTAAT
CTTTGTATCTTCTAGAAGGGAAATATTACTTTAGC---TTTGGGAAGATGTTGCGGTTCTA-GTTCTTAT
TTTTGTATCTTCTAGAAGGGAAACATTACTTTAGC---TTTGGGAAAAATGTTGCGGTTCTA-GTTCTTAT
CTTTGTATCTTCTAACAAGGAAAACACTAAATTTGC---TTTGGGAACCAGTTGCGGTTCTA-GTTTTTAT
CTTTGTATCTTCAAACAAG-AAACATTACTTTAGC---TTTGGGAATCGGTTGCGGTTCTA-GTTCTTAT
CTTTGTATCTTCTTAGAAGGGAAACATTACTTTAGC---TTTGGGAAGATGTTGCGGTTCTA-GTTCTTAT
CTTTGTATCTTCTAACAAGGAAACATTACTTTAGC---TTTGGGAATCGGTTGCGGTTCTA-GTTCTTAT
CTTTGTATCTTCTTGAACAAGGAAACATTACTTTAGC---TTTGGGAATCGGTTGCGGTTCTA-ATTCTTAT
CTTTGTATCTTCTAACAAGGAAACACAACTTTAGC---TTTGGGAACCGGTTGCGGTTCTA-GTTCTTAT
CTTTGTATCTTCTAACAAGGAAACA
CTTTGTAGCTTCTAACAAGGAAACACTACTTTAGC---TTTGGGAAACGGTTGCGGTTCTA-GTTCTTAT
```

FIG. 23D-2P

```
ACTCAATCATACACACATGACACATCTAGTCATATTTGACTCCAAAACACTAACC
        140       150       160       170       180
ACTCAATACTACACACGACACATATAGTCTTTTTGACCCCAAAACACTAAC        177
ACTCAATGATACACACATGATATCTAGTCATATTTGACTCCAAAACACTAACC       177
ACTCAATCATACACACGACAT                                       144
ACTCAATGATTCACATGACATCATGTAATATATTTGACTTCAAAATACTAACC       176
ACTCAATCATACACATGACACATCTAGTCATATTTGATTCCAAAACACTAACC       175
ACTCAATGATACACATGACATCCCTGTAATATATTTGACTCTAAAATACTAACC      155
AGTCAATCATATAAAGACATCTAGTCATATTTGACTCGAAAACACTAACC          178
ACTTAATCAAACACATAACATCTAGTCATATTTGACTCCAAAAACACTAAC         174
ACTCAATCATACACATGACATCTAGTCATATTTTTTGACTCCAAAACACTAACC      178
ACTCAATACTACACACATGACATAGTCTTTTTGTCTTATTGACTCCAAAACACTAACC  177
ACTCAATCAAACACACATAACATCTTGTCTTGTTTATTTGACTCCAAAATACTAACC   167
ACTCAATCAAACACACATAACATCTTGTCTTATTTGACTCCAAAATACTAACC       175
ACTTAATGATACACATGACATCTTGTAATATATTTGACTCTAAAATACTAACC       178
ACTCAATACTACACACATGACATATAGTCTCTTTTTTTACTCCAAAACACTAAC      177
ACTCAATGATACACACATGATATCCTGTAATATTTGACTCTAAAATACTAACC       177
ACTCAATCAAACACACATAACATCTTATCTTATTTGACTCCAAAATACTAACC       168
AGTCAATGATACACACATAACATCCCTGTAATATTTGACTCCAAAACACTAACC      155
ACTCAAT                                                     134
                                                             85
ACTCAATCATACACACATGACATCTAGTCATATTTGACTCCAAAACACTAACC       178
```

*FIG. 23D-3P*

```
f6h8-250  AAGCTTCTTATTGCCTCACAAAGCTTTGATGGTGTAGCCGAAGTCGGTATGAGTCTTTGG
f6h8-251  AAGCTTCTTATTGCCTCTCAAAATTTGATGGTGTACACGAAGTCCGTATGAGTCTTTGG
f6h8-252  AAGCTTCTTATTGCCTCACAAAGCTTTGATGGTGTAGCCGAAGTCGGTATGAGTCTTTGG
f6h8-253  AAGCTTCTTATTGCCTCACAAAGCTTTGATGGTGTAGCCGAAGTCGGTATGAGTCTTTGG
f6h8-254  AAGCTTCTTATTGCCTTCTCAAAATTTCATGGTGTTGCCGAAGTCCGTATGTGAGTCTTTGG
f6h8-255  AAGCTTCTTATTGCCTCACAAAGCTTTGATGGTGTAGCCGAAGTCGGTATGAGTCTTTGG
f6h8-256  AAGCTTCTTATTGCCTCACAAAGCTTTGATGGTGTAGCCGAAGTCGGTATGAGTCTTTGG
f6h8-257  AAGCTTCTTATTGCTTCTCAAAATTTGATGGTGTACACGAAGTCCGTATGAGTCTTTGG
f6h8-258  AAGCTTCTTATTGCTTCTCAAAAGCTTTGATGGTGTAGCCGAAGTCTGTATGAGTCTTTGG
f6h8-259  AAGCTTCTTATTGCCTCACAAAGCTTTGATGGTGTAGCCGAAGTCGGTATGAGTCTTTGG
f6h8-26   AAGCTTATTATTGCCTCTCAAACTTTGATGGTGTAGCCGAAGTCTGTATGAGTCTTTGG
f6h8-260  AAGCTTCTTATTGCTTCTCAAAATTTCATGGTGTAGGCGAAGACCGTATGAGCCTTTGG
f6h8-261  AAGCTTCTTATTGCTTCTCTAAATATTTCATGGTGTAGCCGAATTCCGAATTCCGAGTTTGG
f6h8-262  ---CTTCTGTTGCTTCTTAAAGCTTTGATGGTGTAGCCGAAGTCCGTACGAGTTTTGG
f6h8-263  ---------------CTTTGATGGTGTAGCCGAAGTCGGTATGAGTCTTTGG
f6h8-264  AAGCTTCTTATTGCCTCACAAAGCTTTGATGGTGTAGCCGAAGTCGGTATGAGTCTTTGG
f6h8-265  AAGCTTCTTATTGCCTCACAAAGCTTTGATGGTGTAGCCGAAGTCGGTATGAGTCTTTGG
f6h8-266  AAGCTTCTTATTGCCTCACAAAGCTTTGATGGTGTAGCCGAAGTCGGTATGAGTCTTTGG
f6h8-267  ---------------CTTTGATGGTGTAGCCGAAGTTGTATAAGTCTTTGG
f6h8-268  AAGCTTCTTATTGCCTCACAAAGCTTTGATGGTGTAGCCGAAGTCGGTATGAGTCTTTGG
f6h8-269  AAGCTTCTTATTGCCTCACAAAGCTTTGATGGTGTAGCCGAAGTCGGTATGAGTCTTTGG
f6h8-27   AAGCTTATTATTGCTTCTCAAAACTTTGATGGTGTAGCCGAAGTCTGTATGAGTCTTTGG
```

```
f6h8-270  AAGCTTCTTATTGCCTCACAAAGCTTTGATGGTGTAGCCGAAGTCGGTATGAGTCTTTGG
f6h8-271  AAGCTTCTTATTGCCTCACAAAGCTTTGATGGTGTAGCCGAAGTCGGTATGAGTCTTTGG
f6h8-272  AAGCTTCTTATTGCCTCACAAAGCTTTGATGGTGTAGCCGAAGTCGGTATGAGTCTTTGG
f6h8-273  AAGCTTCTTATTGCCTCACAAAGCTTTGATGGTGTAGCCGAAGTCGGTATGAGTCTTTGG
f6h8-274  AAGCTTCTTATTGCCTCACAAAGCTTTGATGGTGTAGCCGAAGTCGGTATGAGTCTTTGG
f6h8-275  AAGCTTCTTATTGCCTCACAAAGCTTTGATGGTGTAGCCGAAGTCGGTATGAGTCTTTGG
f6h8-276  AAGCTTCTTATTGCCTCACAAAGCTTTGATGGTGTAGCCGAAGTCGGTATGAGTCTTTGG
f6h8-277  AAGCTTCTTATTGCCTCACAAAGCTTTGATGGTGTAGCCGAAGTCGGTATGAGTCTTTGG
f6h8-278  AAGCTTCTTCTCAAAACTTTAATAGTGTAGCCGAAGTCCGTATAAGTCTTTGG
f6h8-279  AAGCTTCTTATTGCCTCACAAAGCTTTGATGGTGTAGCCGAAGTCGGTATGAGTCTTTGG
f6h8-28   A-GCTTCTTATTGCCTCTCAAAGCTTTGATGGTGTAGCTGAAGTCCTTATGATTCTCTGG
f6h8-280  AAGCTTCTTATTGCCTCACAAAGCTTTGATGGTGTAGCCGAAGTCGGTATGAGTCTTTGG
f6h8-281  AAGCTTCTTATTGCCTCACAAAGCTTTGATGGTGTAGCCGAAGTCGGTATGAGTCTTTGG
f6h8-282  --GCTTCTTATTGCCTCACAAAGCTTTGATGGTGTAGCCGAAGTCGGTATGAGTCTTTGG
f6h8-283  ------------------------------------------T---------------
f6h8-284  ---CTTCTTGTTGCTTCTTAAGCTTTGATGGTGTAGCAGAAGTCTGTATGAGTTTTTGG
f6h8-285  AAGCTTCTTATTGCCTCACAAAGCTTTGATGGTGTGCGAAGTCGGTATGAGTCTTTGG
f6h8-287  ---CTTCTTCTTGCTTCTCAAAGCTTTGATGGTGTAGCCAAAGTCGTATGAGTCTTTGA
f6h8-29   AAGCTTCTTATTGCCTCTCAAAGCTTTGATGGTGTAGCTGAATTCCATATCTTTGG
f6h8-3    AAGCTTCTTATTGCCTCTCAAAACTTTGATGGTGTAGCCGAAGTCCGTATGAGTCTTTGG
f6h8-30   ---CTTCTTATTGCTTCTCAAAGCTTTGATGGTGTAGCTGAAGTCCTTATGATTCTTTGG
f6h8-31   ---------------------CTTTGATGGTGTAGCAGAAGTCCATATGATTCTTTTG
```

```
CTTTGTATCTACAAACAAG-AA-CATTACTTTAGC---TTTTGGGAATCGGTTGCGGTTCTA-GTTCTTAT
CTTTGTATCTACAAACAAG-AAACATTACTTTAGC---TTTTGGGAATCGGTTGCGGTCCTA-GTTCTTAT
ATTTGTATCTACAAACAAG-AAACATTACTTTAGC---TTTTGGGAATCGGTTGCGGTTCTA-GTTCTTAT
CTTTGTATCTACAAACAAG-AAACATTACTTTAGC---TTTTGGGAATCGGTTGCGGTTCTA-GTTCTTAT
ATTTGTATCTACAAACAAG-AAACATTACTTTAGC---TTTTGGGAATCGGTTGCGGTTCTA-GTTCTTAT
ATTTGTATCTACAAACAAG-AAACATTACTTTAGC---TTTTGGGAATCGGTTGCGGTTCTA-GTTCTTAT
ATTTGTATCTACAAACAAG-AAACATTACTTTAGC---TTTTGGGAATCGGTTGCGGTTCTA-GTTCTTAT
ATTTGTATCTACAAACAAG-AAACATTACTTTAGC---TTTTGGGAATCGGTTGCGGTTCTA-GTTCTTAT
CTTTGTATCTACAAACAAG-AAACATTACTTTAGC---TTTTGGGAATCGGTTGCGGTTCTA-GTTCTTAT
CTTTGTATCTTCTAACACAGAAACATTACTTTAGC---TTTTGGGAATTGGTTGCGGTT
CTTTGTATCTTCTAACAAGAAACATTACTTTAGC---TTTTGGGAATCGGTTGCGGTTCTA-GTTCTTAT
CTTTGTATCTTCTAACAAGAAACATTACTTTAGC---TTTTGGGAAACGGTTGCGGTTCTA-GTTCTTAT
TTTTGTATCTTCTAACAAGAAACATTACTTTAGC---TTTTGGGAATCGGTTGCGGTTCTA-GTTCTTAT
CTTTGTATCTTCTAACAAG-AAACATTACTTTAGC---TTTTGGGAATCGGTTGCGGTTCTA-GTTCTTAT
CTTTGTATCTACAAACAAG-AA-CATTACTTTAGC---TTTTGGGAATCGGTTGCGGTTCTA-GTTCTTAT
CTTTGTATCTTCTAACAAG-AAACATTACTTTAAC---TTTTAGGAACCGGTTGTGATTCTAGGT-CTTAT
----ATCTTCTAACAAGGAAAACAATACTTTAAC---TTTTGGGAAGATGTTGCGGTTCTA-GTTCTTAT
CTTTTATCTTCAAGAAGTGAAACAAACACTATTTAGC---TTTTGGGAATCGGTTGCGGTTCTA-GTTCTTAT
ATTTGTATCTACAAACAAG-AAACATTACTTTAGC---TTTTGGGAATCGGTTGCGGTTCTA-ATTCTTAT
CTTTGTATCTTCTAACAAGGAAACACTACTTTGGGC---ATTTAAGATTCGGTGTGGTTCTA-GTTCTTAT
CTTTGTATCTTCTAACAAGGAAACACTACTTTAGC---TTTTGGGAAACGGTTGCGGTTCTA-GTTCTTAT
CTTTGTAACTTCTAACAAGGAAAACACTACTTTAGC---TTTTGGGAAACGGTTGCGGTTCTA-GTTCTTAT
CTTTGTAGCTTCTAACAAGGAAAACACTACTTTAGC---TTTTGGGAAACGGTTGCGGTTCTA-GTTCTTAT
CTTTGTATCTTCTAACAAGGAAAACACTACTTTAGC---TTTTGGGAAACGGTTGCGATTCTA-GTTCTTAT
CTTTGTATGTTCTAACAAGGAAAACACTACTTTAGC---TTTTGGGAAACGGTTGCGGTTCTA-GTTCTTAT
```

```
ACTCAATGATACACATGATATCCTGTAATATATTTCACTCTAAAATACTAACC  176
ACTCAATGATACACATGATATCCTGTAATATATTTGACTCTAAAATACTA     174
ACTCAATGATACACATGATATCCTGTAATATATTTGACCCTAAAATACTAACC  177
ACTCAATGATACACATGATATCCTGTAATATATTTGACCCTAAAATACTAACC  177
ACTCAATGATACACATGATATCCTGTAATATATTTCACTCTAAAATACTAACC  177
ACTCAATGATACACATGATATCCTGTAATATATTTCACTCTAAAATACTAACC  177
ACTCAATGATACACATGATATCCTGTAATATTTCACTCTAAAATACTAACC    177
ACTCAATGATACACATGATATCCTGTAATATTTCACTCTAAAATACTAACC    176
ACTCAAT-ATACACATGATATCCTGTAATATTTGACTCTAAAATACTAACC    116
ACTCAAT-ATACACATGATATCCTGTAATATTTGACTCTAAAATACTAACC    176
ACTCAATCATACACATGACATGACATCTAGTCATATTTGACTCATATTTGACTCTAAAATACTAACC 177
ACTCAAT-ATACACATGATATCCTGTAATATATTTGACTCTAAAATACTAACC  176
ACTCAATGATGCACATGATATCCTGTAATATTTCACTCTAAAATACTAACC    176
ACTCAAT-ATACACATGATATCCTGTAATATATTTGACTCTAAAATACTAACC  174
CCTCAATCATATAACTGACATCTAGTCATAGTTCATAGTTGACTACAAAACACTAACC 113
GCTCAATCAAACACATAACATATGTCTTATTTGACTCCAAAATACTAA       173
ACTCAATGATACACATGA                                     144
ACTCAATCATACACATGACATGACATCTAGTCATATATTTAACTCCAAAACACTAACC 175
ACTCAATCATACACATGACATGACATCTAGTCATATTTGACTCCAAAA       170
ACTCAATCATACACATGACATGACATCTAGTCATATTTGACTCCAAAACACTAACC 178
ACTCAATCATACACATGACATGACATCTAGTCATATTTGACTCCGAAAAACTAACC 175
ACTCAATCATACACATGACATCAAGTCATATATTTGACTCCAAAA          147
```

FIG. 23D-3R

```
f6h8-32   AAGCTTCTTATTGCTTCTCAAAGCTTTGATGGTGTAGCTGAATTCCATATGATTCTTTGG
f6h8-33   AAGCTTCTTATTGCTTCTCAAAGCTTTGATGGTGTAGCTGAATTCCATATGATTCTTTGG
f6h8-34   AAGCTTCTTATTGCTTCTCAAAGCTTTGATGGTGTAGCTGAATTCCATATGATTCTTTGG
f6h8-35   ---CTTCTTATTGCTTCTCAAAACTTTGATGCCTTAGCCGAAGTCCGTATGCGTTTTTAG
f6h8-36   AAGCTTCTTATTACTTCTCAAAGCTTTGATGGTGTAGCCGAAGTCCGTATGAGTCTTTGG
f6h8-37   AAGCTTCTTATTGCTTCTCAAAGCTTTGATGGTGTAGCCGAAGTCCGTATGAGTCTTTGG
f6h8-38   AAGCTTCTCTAGCTTCTCAAAGCTTTGATGGTGTAGCCGAAGTCCGTATGAGTCTTTGG
f6h8-39   AAGCTTCTTATTGCTTCTCAAAGTTTTGATGGTGTAGCTTGAATTCCATATGATTCTTTGG
f6h8-4    AAGCTTCTTATTGCTTCTCAAAACTTTGATGGTGTAGCCGAAGTCCGTATGAGTCTTTGG
f6h8-40   AAGCTACTTATTGCTTCTCAAAATTTGATGGTGTAGCCCAAAGTCCGTATGAGTCTTTGG
f6h8-41   AAGCTTCTTATTGCTTCTCAAAATTTGATGGCTTAGCCGAAGTCCGTATGAGTCTTTAG
f6h8-42   A-GCTTCTTATTGCTTCTCAAAATTTGATGGTGTGGCTTAGCCGAAGTCCGTATGAGTCTTTG
f6h8-43   AAGCTTCTTATTGCTTCTCAAAATTTTGATGGCCTTAGCCGAAGTCCGTATGAGTTTTTAG
f6h8-44   ---CTTCTTATTGCTTCTCAAAGCTTTGATGGTGTAGCCGAAGTCCCATATGATTTGTGG
f6h8-45   AAGCTTCTTATTGCTTCTCAAAATTTCATGGTGTAGCCGAAGTCCGTATGAGTCTTTGG
f6h8-46   --------------------------------TTTGATGGTGTAGCCGAAGTCCGTATGAGTCTTTGG
f6h8-47   AAGCTTCTTATTGCTTCTCAAAACTTTCATGGTGTAGCCGAAGTCCGTATGAGTCTTTGA
f6h8-48   --------------------------------TTTGATGGTGTAGCCGAAGTCCGTATGAGTTTTAG
f6h8-49   AAGCTTCTTATTGCTTCTCAAAACATTAATGGCTTAGCCGAAGTCCCATATGAGTTTTAG
f6h8-5    AAGCTTCTTATTGCTTCTCAAAACTTTGATGGTGTAGCCGAAGTCCGTATGAGTCTTTGG
f6h8-50   --------------------------------TTTGATGGTGTAGCCGAAGTCCGTATGAGTCTTTGA
f6h8-51   AAGCTTCTTATTGCTTCTCAAAACATTAATGGCTTAGCCGAAGTCCCAAAGTCCGTATGAGTTTTTAG
```

FIG. 23D-1S.

```
CTTTGTAACTTCTAACAAGGAAACACTACCTTTAGC---TTTTGGGAAACGGTTGCGGTTCTA-GTTCTTAT
CTTTGTAACTTCTAACAAGGAAACACTACTTTAGC---TTTTGGGAAAAGGTTGCGGTTCTA-GTTGTTAT
CTTTGTAACTTCTAACAAGGAAACACTACTTTAGC---TTTTGGGAAACGGTTGCGGTTCTA-GTTGTTAT
CTTTGTATCTTCTAACAAGGAAACACATTACTTTAGC---TTTTAAGAATCAGTTGCGGTTCTA-GTTCTTAT
CTTTGTATCTTGTAACAAGGAAACACTACTTTAGC---CTTTGGGAAACCGGTTGCGGTTCTA-GTTCTTAT
CTTTGTATCTTCTAACAAGGAAACACTACTTTAGC---CCTTGGGAACCAGTTGCGGTTCTA-GTTCTTAT
CTTTGTATCTTCTAATAAGGAAACACTATTTTAGC---TTTTGGGAACCGGTTGCGGTTCTA-GTTCTTAT
CTTTGTAACTTCTAACAAGGAAACACTACTTTAGC---TTTTGGGAAACGATTGCGGTTCTA-GTTCTTAT
CTTTGTAGCTTCTAACTAGGAAACACTACTTTAGC---TTTTGGGAAACCGGTTGCGGTTCTA-GTTCTTAT
CTTTGTATCTTCTAACAAGGAAACATTACTTTAGC---TTTTGGGAACCAGTTGCAGTTCTA-GTTCTTAT
CTTTGTATCTTCTAACAAGGAAACATTACTTTAGC---TTTTGGGAATCAGTTGTGGTTCTA-GTTCTTAT
CTTTGTATCTTCTAACAAGGAAACATTACTTTAGC---TTTTGGGAAAATGGTTCGATTCTA-GTTCTTAT
CTTTGTATCTTCTAAGAAGGAAACATTACTTTAGC---TTTTGGGAATCAGTTGTGGTTCTA-GTTCTTAT
CTTTGTATCTTCTAACAAGGAAACACACCTTTAGC---TTTTGGGAAACGGTTGCGGTTCTA-GTTCTAAT
CTTTGTATCTTCTAACAAGGAAACATAACTTTAGC---TATTGGGAATCGGTTGCCATTCTA-GTTCTTAT
CTTTGTATCTTCAAACAAGGAAACATTACTTTTGC---TTTTGGGAATCGGTTGCGGTTCTA-GTTCTTAT
CTTTGTATCTTCTGACAAGGAAACACTACTTTTGC---TTTTGGGAACCGGTTGCGGTTCTA-GTTCTTAT
CTTTGTATCTTCAAACAAGGAAACATTACTTTAGC---TTTTGGGAATCGGTTGCGGTTCTA-GTTCTTAT
CTTTGTATCTTCTAACAAGGAAACATTAATTAGC---TTTTGGGAATTAGTTGCGGTTCTA-GTTCTTAT
CTTTGAGCTTCTAACAAGGAAACACTACTTTAGC---TTTTGGGAAACGGTTGCGGTTCTA-GTTCTTAT
CTTTGTATCTTCTAACAAGGAAACACTACTTTAGC---TTTTGGGAAACGGTTGCGGTTCTA-GTTCTTAT
CTTTGTATCTTCAAACAAGGAAACATTAATTTAGC---TTTTGGGAATTAGTTGCGGTTCTA-GTTCTTAT
```

FIG. 23D-2S

```
ACTCAATCATACACACATGACACATCTAGTCATATTTGACTCCAAAA              170
ACTCAATCATACACACATGACACATCTAGTCATATTTGACTCCAAAA              170
ACTCAATCATACACACATGACACATCTAGTCATATTTGACTCCAAAA              170
ACTCAATCATACACACATGACACATCTAGTCATATTTGACTCCAAAAAACTAACC      175
ACTCAATCATCCACACATGACACATCTAGTCATATTTGACTCCAAAAAACTAACC      178
ACTCAATCATCCACATTACACATCTAGTCATATTTGACTCCAAAA                170
ACTCAATCATACACACATGACATAGTCATATTTGAATCCAAAACACT              174
ACTCAATCATACACACATGACACATTTAGTCATATTTGACTCCAAAA              170
ACTCAATCATACACACATGACACATCTAGTCATATTTGACTCCAAAACACTAACC      178
ACTCAATCATACACACATCCACACATGACATCTAGTCATATGTGACTCCAAAACACTAAC 177
ACTCAATCATACACACATGACACATCTAGTCATATTTGACTCCAAAAAACTAAC       177
ACTCAATCATACACACATGACACATCTAGTCATATTTGACTCCAAAACACT          173
ACTTAATCATACACACATGACACATCTAGTCATATTTGACTCCAAAAAACTAAC       177
ACTTAATCATACACACATGACACATCTAGTCATATTTGACTCCAAAAAACACTA       172
ACTCAATCATACACACATGACACATCTAGTCATATTTGACTCCAAAAAACACTAACC    178
ACTCAATCATACTACACATGACACATCTAGTCATAGTCTTATTTGACTCCAAAATACTAACC 146
ACTCAATCATACACACATGACACATCTAGCCATATTTGATTCCGAAAAAACTAACC     178
ACTCAATCATACACACATGACACATCTAGTCATATTTGACTCCAAAACACTAACC      146
ACTCAATCATACACACATGACACATCTAGTCATATTTGACTCCAAAAAACACTAACC    178
ACTCAATCATACACACATGACACATCTAGCCATATTTGACTCCAAAA              178
ACTCAATCATACACACATGACACATCTAGCCATATTTGATTCCGAAAAAACTAACC     146
ACTCAATCATACACACATGACACATCTAGCCATATTTGATTCCGAAAAAACTAACC     178
```

*FIG. 23D-3S*

```
f6h8-52  AAGCTTCTTATTGCTTCTCAAAGCATTGATGGTGTAGCCGAAGTACGTAATGAGTCTTCGG
f6h8-53  AAGCTTCTTATTGCTTCTCAAAAATTTTGATGGTGTAGCCGAAGTCCGTATGAGTCTTTGG
f6h8-54  ------------------------------TTTGATGGTGTAGCCGAAGTCCGTATGAGTCTTTGG
f6h8-55  ----TTCTTATTGCTTCTCAAAGTTTTGATGGTGTAGCCGAAATTCGTATGAGTCTCTAG
f6h8-56  AAGCTTCTTATTGCTTCTCAAAACATTAATGGCTTAGCCGAAAGTCCGTATGAGTTTTAG
f6h8-57  ------------------------------TTTGATGGTGTAGCCGAAAGTCCGTATGAGTCTTTGA
f6h8-58  AAGCTTCTTATTGCTTCTCAAAATTTTGATGGTGTAGCCGTTTGAGACTTGG
f6h8-59  AAGCTTCGTATTGCTTCTCAAAAATTTTGGTGGTGTATCCGAAGTCCGTATGAGTCTTTGG
f6h8-6   AAGCTTCTTATTGCTTCTCAAAACTTTGATGGTGTAGCCGAAGTCCGTATGAGTCTTTGG
f6h8-60  ------------------------------TTTGATGGTGTAGCCGAAGTCCGTATGAGTCTTTGA
f6h8-61  AAGCTTCTTATTGCTTCTCAAAACATTAATGGCTTAGCCAAAGTCCGTATGAGTTTTAG
f6h8-62  AAGCTTCTTATTGCTTCTCAAAACATTAATGGCTTAGCCGAAGTCCGTATGAGTTTTAG
f6h8-63  AAGCTTCTTATTGCTTCTCAAAATTTGATGGCTTAGCCGAAGTCCGTATGAGTTTTAG
f6h8-64  AAGCTTCTTATTGCTTCTCAAAATTTGATGGCTTAGCCGAAGTCCGTATGAGTCTTTGG
f6h8-65  AAGCTTCTTATTGCTTCTCAAAATTTGATGGTGGCTTAGCCGAAGTCCGTATGAGTCTTTGG
f6h8-66  AAGCTTCTTATTGCTTCTCAAAATTTGATGGCTTAGCCGAAGTCCGTATGAGTTTTAG
f6h8-67  AAGCTTCTTATTGCTTCTCAAAATTTTGATGGCTTAGCCGAAGTCCGTATGAGTTTTAG
f6h8-68  AAGCTTCTTATTGCTTCTCAAAATTTTGATGGCTTAGCCGAAGTCCGTATGAGTTTTAG
f6h8-69  ----CTTCTTATTGCTTCTCAAAATTTTGATGGCTTAGCCGAAGTCCGTATGAGTTTTAG
f6h8-7   AAGCTTCTTATTGCTTCTCAAAATTTTGATGGTGTAGCCGAAGTCCGTATGAGTTTTAG
f6h8-70  ----CTTCTTATTGCTTCTCAAAATTTTGATGGCTTAGCCGAAGTCCGTATGAGTTTTAG
f6h8-71  AAGCTACTTATTGCTTCTCAAAACTTTGATGGTGTAGCCAAAGTCCGTATGAGTCTTTGG
```

*FIG. 23D-1T*

```
CTTTGTATTTCTAACAAGGAAACACTACTTTAGA---TTTTGGGAACCGGTTGTAGTTCTA-GTTCTTAT
CTTTGTATCTTCTAACAAGGAAACATAACTTTAGC---TATTGGCAATCGGTTGCCGTTCTA-GTTCTTAT
CTTTGTATCTACTAACAAGGAAACACTACTTTAGG---TTTTGGGAATCGGTTGCGGTTCTA-GTTCTTAT
CTTTGTATCTTCTAACAAGGAAACACTACTTTAGC---TTTTGGCAACCGGTTGCGGTTCTA-GTTCTTAT
CTTTGTATCTTCTAACAAGGAAACACATTAATTTAGC---TTTTGGGAATTAGTTGCGGTTCTA-GTTCTTAT
CTTTGTATCTTCAAACAAGGAAACACATTACTTTAGC---TTTTGGGAATCGGTTGCGGTTCTA-GTTCTTAT
CTTTGTGTCTTCTAACAAGGAAACACTACTTTAGC---TTTAGGAACCAGTTGCGGTTATA-GTTCTTAT
CTTTGTATCTTCTAACAAGGAAACACTACTTTAGC---TTTTGGGAATCGGTTGCCGTTCTA-GTTCTTAT
CTTTGTATCTTCTAACAAGGAAACACTACTTCGGC---TATTGGGAAACGGTTGCGGTTCTA-GTTCTTAT
CTTTGTAGCTTCTAACAAGGAAACACTACTTTAGC---TTTTGGGAAACGGTTGCGGTTCTA-GTTCTTAT
CTTTGTATCTTCTAAACAAGGAAATATTACATTAAGG---TTTTGGGAATTAGTTGCGGTTCTA-GTTCTTAT
CTTTGTATCTTCTAACAAGGAAACACATTAATTTAGC---TTTTGGGAATTAGTTGCGGTTCTA-GTTCTTAT
CTTTGTATCTTCTAACAAGGAAACACTACTTTAGC---TTTTGGGAATCAGTTATGGTTCTA-GTTCTTAT
CTTTGTATCTTCTAACAAGGAAACACTACTTTAGC---TTTTGGGAATCAGTTATGGTTCTA-GTTCTTAT
CTTTGTATCTTCTAACAAGGAAACACTACTTTAGC---TTTCGGGAACCGGTTGCGGTTCTA-GTTCTTAT
CTTTGTATCTTCTAACAAGGAAACACTACTTTAGC---TTTTGGGAATCAGTTATGGTTCTA-GTTCTTAT
CTTTAAATCTTCTAACAAGGAAACACTACTTTAGC---TTTTGGGAATTAGTTGCGGTTCTA-GTTCTTAT
CTTTGTATCTTCTAACAAGGAAACACTACTTTAGC---TTTTGGGAATCAGTTATGGTTCTA-GTTCTTAT
CTTTGTATCTTCTAACAAGGAAACACTACTTTAGC---TTTTGGGAATCAGTTATGGTTCTA-GTTCTTAT
CTTTGTATCTTCTAACAAGGAAACACTACTTTAGC---TTTTGGGAATCAGTTGTGTTAAA-GTTCTTAT
CTTTGTAGCTTCTAACAAGGAAACACTACTTTAGC---TTTTGGGAATCAGTTGTGTTAAA-GTTCTTAT
CTTTGTATCTTCTAACAAGGAAACACTACTTTAGC---TTTTGGGAAACGGTTGCGGTTCTA-GTTCTTAT
CTTTGTATCTTCTAACAAGGAAACACTACTTTAGC---TTTTGGGAATCAGTTGTGGTTAAA-GTTCTTAT
CTTTGTATCTTCTAACAAGGAAACACTACTTTTTC---TTTTGGGAACCAGTTGCGGTTCTA-GTTTTAT
```

FIG. 23D-2T

```
ACTCAATCATACACACATGACATCTAGTCATCATATTTGACTCCAAAACACTAACC    178
ACTCAATCATACACACATGACATCTAGTCATCATATTTGACTCCAAAACACTAACC    178
ACTCAATCATCATACACATGACATCTAGTCATCATATTTGACTCCAAAA           146
ACTCAATCATCATACACATGACATCTAGTCATCATATTTGACTCCAAAA           166
ACTCAATCATACACACATGACATCTAGTCATCATATTTGATTCCGAAAACTAACC     178
ACTCAATCATACACACATGACATCTAGTCATCATATTTGACTCCAAAA            146
AATCAATCATACACACATGACATCTAGTCATCTAGTCATATTTGACTCCAAAACATTAACC    178
ACTCAATCATACACACATGACATCTAGTCATCATATTTGACTCCAAAACACTAACC    178
ACTCAATCATACACACATGACATCTAGTCATCATATTTGACTCCAAAACACTAACC    178
ACTCAATCATACACACATGACATCTAGTCATCATATTTGACTCCAAAAACTAACC     154
ACTCAATCATACACACATGACATCTAGCCATCATATTTGATTCCGAAAAACTAACC    178
ACTCAATCATACACACATGACATCTAGCCATCATATTTGATTCCGAAAAACTAACC    178
ACTTAATCATACACACATGACATCTAGTCATCATATTTGACTCCAAAAAACTAAC     177
ACTTAATCATACACACATGACATCTAGTCATCATATTTGACTCCAAAAAACTAAC     177
ACTTAATCATCCACACATGACATCTAGTCATCATATTTGACTCCAAAAAACTAAC     177
ACTTAATCATACACACATGACATCTAGTCATCATATTTGACTCCAAAAAACTAAC     177
ACTTAATCATACACACATGACATCTAGCCATCATATTTGATTCCGAAAAACTAAC     177
ACTTAATCATACACACATGACATCTAGCCATCATATTTGACTCCAAAAAACTAAC     177
ACTTAATCATACACACATGACATCTAGTCTTATTTGACACCAAAATACTAACC       175
ACTCAATCATACACACATGACATCTAGTCTTATTTGACACCAAAAACACTAACC      178
ACTTAATCATACACACATGACATCTAGTCTTATTTGACACCAAAAACACTAACC      175
ACTCAATACTACACACATGACATATAGTCTTTTTTGACTCCAAAACACTAACC       178
```

```
CTTTGTGTCTTCAAACAAGGAAACATTACTTTAGC---TTTTGGGAATCGGTTGCGGTTCTA-GTTCTTAT
CTTTGTATCTTCAAACAAGGAAATATTACTTTAGG---TTTTGGGAAACGGTTGCGGTTCTA-GTTCTTAT
CTTTGTATCTTCTAACAAGGAAAGAAACATTAATATAGC---TTTTGGGAATTAGTTGCGGTTCTA-GTTCTTAT
CTTTGTATCTTCTAACAAGGAAACACTACTTTGC---TTTTGGGAACCAGTTGCGGTTCTA-GTTTTTAT
CTTTGTATCTTCTAACAAGGAAACATAACTTTAGC---TATTGGGAATCGGTTGCCATTCTA-GTTCTTAT
CTTTGTATCTTCTAACAAGGAAACACTACTTGAAC---CTTTGGGAACCGGTTCCGGTTCTA-GTTCTTAT
CTTTGTATGTTCTAACAAGGAAACACTACTTTAGC---TTTTGGGAAACGGTTGCGGTTCTA-GTTCTTAT
CTTTGTATCTTCTAACAAGGAAACATTAATTTAGC---TTTTGGGAATTAGTTGCGGTTCTA-GTTCTTAT
CTTTGTAGCTTCTAACAAGGAAACACTACTTTAGC---TTTTGGGAAACGGTTGCGGTTCTA-GTTCTTAT
CTTTGTATCTTCTAACAAGGAAAGAAACATAACTTTAGC---TTTGGGAATCGGTTGCAATTCTA-GTTCTTAT
CTTTGTATGTTCTAACAAGGAAACACTACTTTAGC---TTTTGGGAAACGGTTGCGGTTCTA-GTTCTTAT
CTTTGTATCTTCTAACAAGGAAACATAACTTTAGC---TATTGGGAAATCGGTTGCCATTCTA-GTTCTTAT
CTTTGTATCTTCTAACAAGGAAACATAACTTTAGC---TATTGGGAATCGGTTGCCATTCTA-GTTCTTAT
CTTTGTATCTTCTAACAAGGAAACACTACTTTTGC---TTTTGGGAACCAGTTGCGGTTCTA-GTTTTTAT
CTTTGTATCTTCTAACAAGGAAACACTACTTTAGC---TTTTGGGAAACGGTTGCGGTTCTA-GTTCTTAT
CTTTGTATCTTCAAACAAGGAAACATTAATTTAGC---TATTGGGAATCGGTTGCCATTCTA-GTTCTTAT
CTTTGTATCTTCTAACAAGGAAACATAACTTTAGC---TATTGGGAATCGGTTGCCATTCTA-GTTCTTAT
CTTTGTGTCTTCTAACAAGGAAACACTACTTTAGC---TTTTGGGAATCGGTTGCGGTTCTA-GTTCTTAT
CTTTGTCTTCAAACAAGGAAACATTACTTTAGC---TTTTGGGAAACGGTTGCGGTTCTA-GTTCTTAT
CTTTGTAGCTTCTAACAAGGAAACACTACTTTAGC---TTTTGGGAAATCGGTTGCGGTTCTA-GTTCTTAT
CTTTGTATCTTCTAACAAGGAAACATTACTTTAGC---TTTTGGGAATCAGTTATGTTCTA-GTTCTTAT
```

*FIG. 23D-2U*

```
ACTCAATCATACACACATGACACATCTAGTCATATTTGACTCCAAAA                              146
ACTCAATCATACACACATGACACATCTAGTCATATTTGACTCCAAAA                              146
ACTCAATCATACACACATGACACATCTAGTCATATTTGACTCCAAAACACTAACC                      150
ACTCAATCATACACACATGACACATCTAGTCATATTTGACTCCAAAACACTAACC                      178
ACTCAATCATACCCATGACACATAGTCTTTTTGACTCATATTGACTCCAAAACACTAACC                 178
ACTCAATCATACACATGACACATAGTCATATTGACTCATATTGACTCCAAAACACTAACC                 178
ACTCAATCATACACATAACACATAGTCATATTGAATCATATTGACTCCAAAA                         146
ACTCAATCATACACACATGACACATCA-ATCATATTTGACTCCAAAA                              178
ACTCAATCATACACACATGACACATCTAGCCATATTGATTCCGAAAAACTAACC                       178
ACTCAATCATACACACATGACACATCTAGTCATATTGACTCCAAAACACTAACC                       178
ACTCAATCATACACACATGACACATCTAGTCATATTTGACTCCAAAACACTAACC                      178
ACTCAATCATACACACATGACACATCA-GTCATATTTGACTCCAAAA                              146
ACTCAATCATACACACATGACACATAGTCTTTTTTGACTCATATTGACTCCAAAACACTAACC              178
ACTCAATCATACACACATGACACATCTAGTCATATTTGACTCCAAAACACTAACC                      178
ACTCAATCATACACACATGACACATCTAGTCATATTTGACTCCAAAACACTAACC                      178
ACTCAATCATACACACATGACACATCA-GTCATATTGACTCCAAAA                               146
ACTCAATCATACACACATGACACATCTAGTCATATTTGACTCCAAAACACTAACC                      178
ACTCAATCATACACATACACATGACACATCTAGCCATATTGATTCCGAAAAACTAACC                   178
ACTCAATCATACACACATGACACATCTAGTCATATTTGACTCCAAAACACTAACC                      178
ACTCAATCATACACACATGACACATCTAGTCATATTTGACTCCAAAA                              146
ACTCAATCATACACACATGACACATCTAGTCATATTGACTCCAAAACACTAACC                       178
ACTTAATCATACACACATGACACATCTAGTCGTATTCATATTGACTCCAAAAAACTAAC                  177
```

FIG. 23D-3U

```
f6h8-92   AAGCTTCTTATTGCTTCTCTCAAAAATTTGATGGCTTAGCCGAAGTCCGTATGAGTTTTTAG
f6h8-94   AAGCTTCTTATTGCTTCTCTCAAAAATTTGATGGCTTAGCCGAAGTCCGTATGAGTTTTTAG
f6h8-95   --GCTTCTTATTGCTTCTCTCAAAAATTTGATGGCTTAGCCGAAGTCCGTATGAGTCTTTAG
f6h8-96   --GCTTCTTATTGCTTCTCTCAAAAATTTGATGGTGTACACGAAGTCCGTATGAGTCTTTAG
f6h8-97   AAGCTTCTGTTATTGCTTCTCTCAAAAATTTGATGGTGTACACGAAGTCCGAGTGAGTCTTTGG
f6h8-98   AAGCTTCTTATTGCTTCTCTCAAAACATTAATGGCTTAGCCGAAGTCCGTATGAGTTTTTAG
f6h8-99   AAGCTACTATTGCTTCTCTCAAAACTTTGATGGTGTAGCCAAAGTCCGTATGAGTCTTTGG
xf6h8-93  AAGCTTCTTATTGCTTCTCTCAAAACTTTGATGGCTTAGCCGAAGTCCGTATGAGTCTTTGG
```

FIG. 23D-1V

```
CTTTCTTATCTTCTAACAAGGAAACATTACTTTAGC---TTTTGGGAATCAGTTATGGTTCTA-GTTCTTAT
CATTGTATCTTCTAACAAGGAAACATTACTTTAGC---TTTTGGGAATCAGTTATGGTTCTA-GTTCTTAT
CTTTGTATCTTCAAACAAGGAAACATTACTTTAGC---TTTTGGGAATCAGTTGCCATTCTA-GTTCTTAT
CTTTGTATCTTCAAACAAGGAAACATAACTTTAGC---TATTGGGAATCGGTTGCCATTCTA-GTTCTTAT
CTTTGTATCTTCAAACAAGGAAACATAACTTTAGC---TATTGGGAATCGGTTGCCATTCTA-GTTCTTAT
CTTTGTATCTTCTAACAAGGAAACATTACTTTAGC---TAGTGGGAATCGGTTGCGGTTCTA-GTTCTTAT
CTTTGTATCTTCTAACAAGGAAACATTAATTTAGC---TTTTGGGAATTAGTTGCGGTTCTA-GTTCTTAT
CTTTGTATCTTCTAACAAGGAAACATTACTTTAGC---TTTTGGGAACCAGTTGCAGTTCTA-GTTCTTAT
CTTTGTATCTTCTAACTAGGAAACATTACTTTAGC---TTTTGGGAACCAGTTGCAGTTCTA-GTTCTTAT
CTTTGTATCTTCTAACA-GGAAACAATACTTTTGC---TTTTGGGAACCGGTTACGGTTCTA-GTTCTTAT
```

FIG. 23D-2V

```
ACTTAATCATACACATGACATCTAGTCATATTTGACTCCAAAAAACTAAC    177
ACTTAATCATACACATGACATCTAGTCATATTTGACTCCAAAAAACTAAC    177
ACTCAATCATACACATGACATCTAGTCATATTTGACTCCAAAACACTAACC   176
ACTCAATCATACACATGACATCTAGTCATATTTGACTCCAAAAACACTAACC  176
ACTCAATCATACACATGACAACTAGTCATATTTGACTCCAAAACACTAACC   176
ACTCAATCATACACATGACAACTAGTCATATTTGACTCCAAAAACTAA      176
ACTCAATCATACACATGACATCTAGCCATATTTGATTCCGAAAAACTAA     171
ACTCAATCATCCACATGACCCTCTAGTCATATGTGACTCCAAAAC         177
AAACAATCATCCACATGACATCAAGTCATATTTGACTCCAAAATACTAACC
```

FIG. 23D-3V

PLANT CHROMOSOME COMPOSITIONS AND METHODS

This application claims the priority of U.S. Provisional Application Ser. No. 60/125,219, filed Mar. 18, 1999, U.S. Provisional Application Ser. No. 60/127,409, filed Apr. 1, 1999, U.S. Provisional Application Ser. No. 60/134,770, filed May 18, 1999, U.S. Provisional Application Ser. No. 60/153,584, Sep. 13, 1999, U.S. Provisional Application Ser. No. 60/154,603, filed Sep. 17, 1999 and U.S. Provisional Application Ser. No. 60/172,493, filed Dec. 16, 1999, each of which disclosures is specifically incorporated herein by reference in its entirety.

The government owns rights in the invention pursuant to U.S. Department of Agriculture Grant No. 96-35304-3491, National Science Foundation Grant No. 9872641 and Grant No. DOEDE-FG05-920R22072 from the Consortium for Plant Biotechnology.

BACKGROUND OF THE INVENTION

I. Field of the Invention

The present invention relates generally to the field of molecular biology. More particularly, it concerns plant chromosome compositions and methods for using the same.

II. Description of Related Art

Two general approaches are used for introduction of new genetic information ("transformation") into cells. One approach is to introduce the new genetic information as part of another DNA molecule, referred to as a "vector," which can be maintained as an independent unit (an episome) apart from the chromosomal DNA molecule(s). Episomal vectors contain all the necessary DNA sequence elements required for DNA replication and maintenance of the vector within the cell. Many episomal vectors are available for use in bacterial cells (for example, see Maniatis et al., 1982). However, only a few episomal vectors that function in higher eukaryotic cells have been developed. The available higher eukaryotic episomal vectors are based on naturally occurring viruses and most function only in mammalian cells (Willard, 1997). In higher plant systems the only known double-stranded DNA viruses that replicate through a double-stranded intermediate upon which an episomal vector could be based is the gemini virus, although the gemini virus is limited to an approximately 800 bp insert. Although an episomal plant vector based on the Cauliflower Mosaic Virus has been developed, its capacity to carry new genetic information also is limited (Brisson et al., 1984).

The other general method of genetic transformation involves integration of introduced DNA sequences into the recipient cell's chromosomes, permitting the new information to be replicated and partitioned to the cell's progeny as a part of the natural chromosomes. The most common form of integrative transformation is called "transfection" and is frequently used in mammalian cell culture systems. Transfection involves introduction of relatively large quantities of deproteinized DNA into cells. The introduced DNA usually is broken and joined together in various combinations before it is integrated at random sites into the cell's chromosome (see, for example Wigler et al., 1977). Common problems with this procedure are the rearrangement of introduced DNA sequences and unpredictable levels of expression due to the location of the transgene in the genome or so called "position effect variation" (Shingo et al., 1986). Further, unlike episomal DNA, integrated DNA cannot normally be precisely removed. A more refined form of integrative transformation can be achieved by exploiting naturally occurring viruses that integrate into the host's chromosomes as part of their life cycle, such as retroviruses (see Cepko et al., 1984). In mouse, homologous integration has recently become common, although it is significantly more difficult to use in plants (Lam et al. 1996).

The most common genetic transformation method used in higher plants is based on the transfer of bacterial DNA into plant chromosomes that occurs during infection by the phytopathogenic soil bacterium *Agrobacterium* (see Nester et al., 1984). By substituting genes of interest for the naturally transferred bacterial sequences (called T-DNA), investigators have been able to introduce new DNA into plant cells. However, even this more "refined" integrative transformation system is limited in three major ways. First, DNA sequences introduced into plant cells using the *Agrobacterium* T-DNA system are frequently rearranged (see Jones et al., 1987). Second, the expression of the introduced DNA sequences varies between individual transformants (see Jones et al., 1985). This variability is presumably caused by rearranged sequences and the influence of surrounding sequences in the plant chromosome (i.e., position effects), as well as methylation of the transgene. A third drawback of the *Agrobacterium* T-DNA system is the reliance on a "gene addition" mechanism: the new genetic information is added to the genome (i.e., all the genetic information a cell possesses) but does not replace information already present in the genome.

One attractive alternative to commonly used methods of transformation is the use of an artificial chromosome. Artificial chromosomes are man-made linear or circular DNA molecules constructed from cis-acting DNA sequence elements that are responsible for the proper replication and partitioning of natural chromosomes (see Murrary et al., 1983). Desired elements include: (1) Autonomous Replication Sequences (ARS) (these have properties of replication origins, which are the sites for initiation of DNA replication), (2) Centromeres (site of kinetochore assembly and responsible for proper distribution of replicated chromosomes at mitosis or meiosis), and (3) Telomeres (specialized DNA structures at the ends of linear chromosomes that function to stabilize the ends and facilitate the complete replication of the extreme termini of the DNA molecule).

At present, the essential chromosomal elements for construction of artificial chromosomes have been precisely characterized only from lower eukaryotic species. ARSs have been isolated from unicellular fungi, including *Saccharomyces cerevisiae* (brewer's yeast) and *Schizosaccharomyces pombe* (see Stinchcomb et al., 1979 and Hsiao et al., 1979). An ARS behaves like a replication origin allowing DNA molecules that contain the ARS to be replicated as an episome after introduction into the cell nuclei of these fungi. Plasmids containing these sequences replicate, but in the absence of a centromere they are partitioned randomly into daughter cells.

Artificial chromosomes have been constructed in yeast using the three cloned essential chromosomal elements. Murray et al., 1983, disclose a cloning system based on the in vitro construction of linear DNA molecules that can be transformed into yeast, where they are maintained as artificial chromosomes. These yeast artificial chromosomes (YACs) contain cloned genes, origins of replication, centromeres and telomeres and are segregated in daughter cells with high fidelity when the YAC is at least 100 kB in length. Smaller CEN containing vectors may be stably segregated, however, when in circular form.

None of the essential components identified in unicellular organisms, however, function in higher eukaryotic systems.

For example, a yeast CEN sequence will not confer stable inheritance upon vectors transformed into higher eukaryotes. While such DNA fragments can be readily introduced, they do not stably exist as episomes in the host cell. This has seriously hampered efforts to produce artificial chromosomes in higher organisms.

In one case, a plant artificial chromosome was discussed (Richards et al., U.S. Pat. No. 5,270,201). However, this vector was based on plant telomeres, as a functional plant centromere was not disclosed. While telomeres are important in maintaining the stability of chromosomal termini, they do not encode the information needed to ensure stable inheritance of an artificial chromosome. It is well documented that centromere function is crucial for stable chromosomal inheritance in almost all eukaryotic organisms (reviewed in Nicklas 1988). For example, broken chromosomes that lack a centromere (acentric chromosomes) are rapidly lost from cell lines, while fragments that have a centromere are faithfully segregated. The centromere accomplishes this by attaching, via centromere binding proteins, to the spindle fibers during mitosis and meiosis, thus ensuring proper gene segregation during cell divisions.

In contrast to the detailed studies done in *S. cerevisiae* and *S. Pomme*, little is known about the molecular structure of functional centromeric DNA of higher eukaryotes. Ultrastructural studies indicate that higher eukaryotic kinetochores, which are specialized complexes of proteins that form on the chromosome during late prophase, are large structures (mammalian kinetochore plates are approximately 0.3 µm in diameter) which posses multiple microtubule attachment sites (reviewed in Rieder, 1982). It is therefore possible that the centromeric DNA regions of these organisms will be correspondingly large, although the minimal amount of DNA necessary for centromere function may be much smaller.

While the above studies have been useful in elucidating the structure and function of centromeres, they have failed to provide a cloned centromere from a higher eukaryotic organism. The extensive literature indicating both the necessity of centromeres for stable inheritance of chromosomes, and the non-functionality of year centromeres in higher organisms, demonstrate that cloning of a functional centromere from a higher eukaryote is a necessary first step in the production of artificial chromosomes suitable for use in higher plants and animals. The production of artificial chromosomes with centromeres which function in higher eukaryotes would overcome many of the problems associated with the prior art and represent a significant breakthrough in biotechnology research.

SUMMARY OF THE INVENTION

In one aspect of the invention, a method is provided for the identification of plant centromeres. In one embodiment of the invention, the method may comprise tetrad analysis. Briefly, tetrad analysis measures the recombination frequency between genetic makers and a centromere by analyzing all four products of individual meiosis. A particular advantage arises from the quartet (qrt 1) mutation in *Arabidopsis*, which causes the four products of pollen mother cell meiosis in *Arabidopsis* to remain attached. The quartet mutation may also find use in accordance with the invention in species other than *Arabidopsis*. For example, several naturally occurring plant species are also known to release pollen clusters, including water lilies, cattails, health (*Ericaceae and Epacridceae*), evening primrose (*Onagraceae*), sundews (*Droseraceae*), orchids (*Orchidaceae*), and acacias (*Mimosaceae*) (Preuss 1994; Smyth 1994). None of these species however, has been developed into an experimental systems thus severely limiting their use for genetic analysis. However, it is contemplated by the inventors that a quartet mutation could be introduced into a host plant to enable the use of tetrad analysis in potentially any species. When used to pollinate a flower, one tetrad can result in the formation of four seeds, and the plants from these seeds can be analyzed genetically. With unordered tetrads, however, such as those produced by *Arabidopsis*, genetic mapping using tetrad analysis requires that two markers be scored simultaneously.

In another aspect, the invention provides a recombinant DNA construct comprising a plant centromere. The recombinant DNA construct may additionally comprise any other desired sequences, for example, a telomere, including a plant telomere such as an *Arabidopsis thaliana* telomere, or alternatively, a year or any other type of telomere. One may also desire to include an autonomous replicating sequence (ARS), such as a plant ARS, including an *Arabidopsis thaliana* ARS. Still further, one may wish to include a structural gene on the construct, or multiple genes (for example, two, three, four, five, six, seven, eight, nine, ten, fifteen, twenty, twenty-five, fifty, one hundred, two hundred, five hundred, one thousand) up to and including the maximum number of structural genes (roughly 5000) which can physically be placed on the recombinant DNA construct. Examples of structural genes one may wish to use include a selectable or screenable marker gene, an antibiotic resistance gene, a herbicide resistance gene, a nitrogen fixation gene, a plant pathogen defense gene, a plant stress-induced gene, a toxin gene, a receptor gene, a ligand gene, a hormone gene, an enzyme gene, an interleukin gene, a clotting factor gene, a cytokine gene, an antibody gene, a growth factor gene and a seed storage gene. In one embodiment of the invention, the construct is capable of expressing the structural gene, for example, in a prokaryote or eukaryote, including a lower eukaryote, or a higher eukaryote such as a plant.

In yet another aspect, the invention provides a recombinant DNA construct comprising a plant centromere and which is a plasmid. The plasmid may contain may desired sequences, such as an origin of replication, including an origin of replication functions in bacteria, such as *E. coli* and *Agrobacterium*, or in plants or yeast, for example, such as *S. cerevisiae*. The plasmid may also comprises a selection marker, which may function in bacteria, including *E. coli* and *Agrobacterium*, as well as a selection marker that functions in plants or yeast, such as *S. cerevisiae*.

In still yet another aspect, the invention provides a recombinant DNA construct comprising a plant centromere and which is capable of being maintained as a chromosome, wherein the chromosome is transmitted in dividing cells. The plant centromere may be from any plant.

In still yet another aspect, the invention provides a plant centromere which is further defined as an *Arabidopsis thaliana* centromere. In yet another embodiment of the invention, the plant centromere is an *Arabidopsis thaliana* chromosome 1 centromere, and may still further be defined as flanked by the genetic markers T22C23-T7 and T3P8-SP6, or still further as flanked by the genetic markers T22C23-T7 and T5D18, T22C23-T7 and T3L4, T5D18 and T3P8-SP6, T5D18 and T3L4, and T3L4 and T3P8-SP6. In yet another embodiment of the invention, the plant centromere comprises an *Arabidopsis thaliana* chromosome 2 centromere. The chromosome 2 centromere may comprise, for example, from about 100 to about 611,000, about 500 to about 611,000, about 1,000 to about 611,000, and 10,000 to about 611,000, and 20,000 to about 611,000, about 40,000 to about 611,000, about 80,000 to about 611,000, about 150,000 to about 611,000, or about 300,000 to about 611,000 contiguous nucelotides of the nucleic acid sequence of SEQ ID NO:209, including comprising the nucleic acid sequence of SEQ ID NO:209. The centromere may also be defined as comprising from about 100 to about 50,959, about 500 to about 50,959, about 1,000 to about 50,959, about 5,000 to about 50,959, about 10,000 to about 50,959, 20,000 to about 50,959, about 30,000 to about 50,959, or about 40,000 to about 50,959 contiguous nucleotides of the nucleic acid sequence of SEQ ID NO:210, and may comprise the nucleic acid sequence of SEQ ID NO:210. The centromere may comprise sequences from both SEQ ID NOS:209 and 210, including the aforementioned fragments, or the entirety of SEQ ID NOS:209 and 210. In particular embodiments, the inventors contemplate a 3' fragment of SEQ ID NO:209 can be fused to a 5' fragment of SEQ ID NO:210, optionally including one or more 180 bp repeat sequence disposed therebetween.

In still yet another aspect, the invention provides an *Arabidopsis thaliana* chromosome 3 centromere. In one embodiment of the invention, the centromere may be further defined as flanked by the genetic markers T9G9-SP6 and T5M14-SP6, and still further defined as flanked by a pair of genetic markers selected from the group consisting of T9G9-SP6 and T14H20, T9G9-SP6 and T7K14, T9G9-SP6 and T21P20, T14H20 and T7K14, T14H20 and T21P20, T14H20 and T5M14-SP6, T7K14 and T5M14-SP6, T7K14 and T21P20, and T21P20 and T5M14-SP6.

In still yet another aspect, the invention provides an *Arabidopsis thaliana* chromosome 4 centromere. In certain embodiments of the invention, the centromere may comprise from about 100 to about 1,082,000, about 500 to about 1,082,000, about 1,000 to about 1,082,000, about 5,000 to about 1,082,000, about 10,000 to about 1,082,000, about 50,000 to about 1,082,000, about 100,000 to about 1,082,000, about 200,000 to about 1,082,000, about 400,000 to about 1,082,000, or about 800,000 to about 1,082,000 contiguous nucleotides of the nucleic acid sequence of SEQ ID NO:211, including comprising the nucleic acid sequence of SEQ ID NO:211. The centromere may also be defined as comprising from about 100 to about 163,317, about 500 to about 163,317, about 1,000 to about 163,317, about 5,000 to about 163,317, about 10,000 to about 163,317, about 30,000 to about 163,317, about 50,000 to about 163,317, about 80,000 to about 163,317, or about 120,000 to about 163,317 contiguous nucleotides of the nucleic acid sequence of SEQ ID NO:212, and may be defined as comprising the nucleic acid sequence of SEQ ID NO:212. The centromere may comprise sequences from both SEQ ID NOS:211 and 212, including the aforementioned fragments, or the entirety of SEQ ID NOS:211 and 212. In particular embodiments, the inventors contemplate a 3' fragment of SEQ ID NO:211 can be fused to a 5' fragment of SEQ ID NO:212, optionally including one or more 180 bp repeat sequence disposed therebetween.

In yet another embodiment, there is provided a *Arabidopsis thaliana* chromosome 1, 3 or 5 centromere selected from the nucleic acid sequence given by SEQ ID NO: 184, SEQ ID NO: 185, SEQ ID NO:186, SEQ ID NO:187, SEQ ID NO:188, SEQ ID NO:189, SEQ ID NO:190, SEQ ID NO:191, SEQ ID NO:192, SEQ ID NO:193, SEQ ID NO:194, SEQ ID NO:195, SEQ ID NO:196, SEQ ID NO:197, SEQ ID NO:198, SEQ ID NO:199, SEQ ID NO:200, SEQ ID NO:201, SEQ ID NO:202, SEQ ID NO:203, SEQ ID NO:204, SEQ ID NO:205, SEQ ID NO:206, SEQ ID NO:207, SEQ ID NO:208, or fragments thereof. In one embodiment, the construct comprises at least 100 base pairs, up to an including the full length, of one of the preceding sequences. In addition, the construct may include 1 or more 180 base pair repeats.

In still yet another aspect, the invention provides an *Arabidopsis thaliana* chromosome 5 centromere. The centromere may be further defined as flanked by the genetic markers F13K20-T7 and CUE1, and still further defined as flanked by a pair of genetic markers selected from the group consisting of F13K20-T7 and T18M4, F13K20-T7 and T18F2, F13K20-T7 and T24I20, T18M4 and T18F2, T18M4 and T24I20, T18M4 and CUE1, T18F2 and T24I20, T18F2 and CUE1, and T24I20 and CUE1.

In still yet another aspect, the invention provides a recombinant DNA construct comprising a plant centromere, and further defined as comprising n copies of a repeated nucleotide sequence, wherein n is at least 2. Potentially any number of repeat copies capable of physically being placed on the recombinant construct could be included on the construct, including about 5, 10, 15, 20, 30, 50, 75, 100, 150, 200, 300, 400, 500, 750, 1,000, 1,500, 2,000, 3,000, 5,000, 7,500, 10,000, 20,000, 30,000, 40,000, 50,000, 60,000, 70,000, 80,000, 90,000 and about 100,000, including all ranges in-between such copy numbers. In one embodiment the repeated nucleotide sequence may be isolatable from the nucleic acid sequence given by SEQ ID NO:184, SEQ ID NO:185, SEQ ID NO:186, SEQ ID NO:187, SEQ ID NO:188, SEQ ID NO:189, SEQ ID NO:190 SEQ ID NO:191, SEQ ID NO:192, SEQ ID NO:193, SEQ ID NO:194, SEQ ID NO:195, SEQ ID NO:196, SEQ ID NO:197, SEQ ID NO:198, SEQ ID NO:199, SEQ ID NO:200, SEQ ID NO:201, SEQ ID NO:202, SEQ ID NO:203, SEQ ID NO:204, SEQ ID NO:205, SEQ ID NO:206, SEQ ID NO:207, SEQ ID NO:208, SEQ ID NO:209, SEQ ID NO:210, SEQ ID NO:211 OR SEQ ID NO:212. Examples of such sequences that could be used are given in FIGS. 23A–23D. The length of the repeat used may vary, but will preferably range from about 20 bp to about 250 bp, from about 50 bp to about 225 bp, from about 75 bp to about 210 bp, from about 100 bp to about 205 bp, from about 125 bp to about 200 bp, from about 150 bp to about 195 bp, from about 160 bp to about 190 and from about 170 bp to about 185 bp including about 180 bp.

In conjunction with SEQ ID NOS:209, 210, 211 and 212, the repeats may be included as part of centromeric structures. The number of repeats may vary and include 1, 2, 3, 4, 5, 6, 7, 8, 9, 10, 11, 12, 13, 14, 15, 16, 17, 18, 19, 20, 21, 22, 23, 24, 25, 30, 35, 40, 45, 50, 60, 70, 80, 90, 100, 125, 150, 175, 200, 300, 400, 500 or more.

In still yet another aspect, the invention provides a minichromosome vector comprising a plant centromere and a telomere sequence. Any additional desired sequence may be added to the minichromosome, such as an autonomous replicating sequence, a second telomere sequence and a structural gene. One or more of the foregoing sequences may be added, up to the maximum number of such sequences that can physically be placed on the minichromosome. The minichromosome may comprise any of the centromere compositions disclosed herein. In one embodiment of the invention, the minichromosome may comprise a nucleic acid sequence selected from the group consisting of SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, AND SEQ ID NO:21. The minichromosome also may contain "negative" selectable markers which confer susceptibility to an antibiotic, herbicide or other agent, thereby allowing for selection against plants, plant cells or cells of any other organism of interest containing a minichromosome. The minichromosome also may include genes which control the copy number of the minichromosome within a cell. One or more structural genes also may be included in the minichromosome. Specifically contemplated as being useful will be as many structural genes as may be inserted into the minichromosome while still maintaining a functional vector. This may include one, two, three, four, five, six, seven, eight, nine or more structural genes.

In still yet another aspect, the invention provides a recombinant DNA construct comprising a plant centromere. The cell may be of any type, including a prokaryotic cell or eukaryotic cell. Where the cell is a eukaryotic cell, the cell may be, for example, a yeast cell or a higher eukaryotic cell, such as plant cell. The plant cell may be from a dicotyledonous plant, such as tobacco, tomato, potato, soybean, canola, sunflower, alfalfa, cotton and *Arabidopsis*, or may be a monocotyledonous plant cell, such as wheat, maize, rye, rice, turfgrass, oat, barley, sorghum, millet, and sugarcane. In one embodiment of the invention, the plant centromere is an *Arabidopsis thaliana* centromere, and the cell may be an *Arabidopsis thaliana* cell. The recombinant DNA construct may comprise additional sequences, such as a telomere, an autonomous replicating sequence (ARS), a structural gene, or a selectable or screenable marker gene, including as many of such sequences as may physically be placed on said recombinant DNA construct. In one embodiment of the invention, the cell is further defined as capable of expressing said structural gene. In another embodiment of the invention, a plant is provided comprising the aforementioned cells.

In still yet another aspect, the invention provides a method of preparing a transgenic plant cell comprising contacting a starting plant cell with a recombinant DNA construct comprising a plant centromere, whereby said starting plant cell is transformed with said recombinant DNA construct. The recombinant DNA construct may comprise any desired sequences, such as may structural genes as can physically be placed on said recombinant DNA construct. In particular embodiments, the centromere is an *Arabidopsis thaliana* centromere, and the plant cell may be an *Arabidopsis thaliana* cell.

In still yet another aspect, the invention provides a transgenic plant comprising a minichromosome vector, wherein the vector comprises a plant centromere and a telomere sequence. The minichromosome vector may further comprise an autonomous replicating sequence, second telomere sequence, or a structural gene, such as an antibiotic resistance gene, a herbicide resistance gene, a nitrogen fixation gene, a plant pathogen defense gene, a plant stress-induced gene, a toxin gene, a receptor gene, a ligand gene, a seed storage gene, a hormone gene, an enzyme gene, an interleukin gene, a clotting factor gene, a cytokine gene, an antibody gene, and a growth factor gene. As many of such sequences may be included as can physically be placed on the minichromosome. The minichromosome vector may further comprise a nucleic acid sequence selected from the group consisting of SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, AND SEQ ID NO:21, The transgenic plant may be any type of plant, such as a dicotyledonous plant, for example, tobacco, tomato, potato, pea, carrot, cauliflower, broccoli, soybean, canola, sunflower, alfalfa, cotton and *Arabidopsis*, or may be a monocotyledonous plant, such as wheat, maize, rye, rice, turfgrass, oat, barley, sorghum, millet, and sugarcane.

In still yet another aspect, the invention provides a method of producing a minichromosome vector comprising: (a) obtaining a first vector and a second vector, wherein said first vector or said second vector comprises a selectable or screenable marker, an origin of replication, a telomere, and a plant centromere, and wherein said first vector and said second vector comprises a site for site-specific recombination; and (b) contacting said first vector with said second vector to allow site-specific recombination to occur between said site for site-specific recombination on said first vector and said site for site-specific recombination on said second vector to create a minichromosome vector comprising said selectable or screenable marker, said origin of replication, said telomere and said plant centromere. The contacting may be done in vitro or in vivo, including wherein the contacting is carried out in a prokaryotic cell such as an *Agrobacterium* or *E. coli* cell, or in a lower eukaryotic cell, such as a yeast cell. The contacting may still further be carried out in a higher eukaryotic cell, such as a plant cell, including an *Arabidopsis thaliana* cell. The contacting may be done in the presence of potentially any recombinase, including Cre, Flp, Gin, Pin, Sre, pinD, Int-B13, and R. The first vector or second vector may comprise border sequences for *Agrobacterium*-mediated transformation. In one embodiment of the invention, the plant centromere is an *Arabidopsis thaliana* centromere. The telomere may be a plant telomere. Any plant selectable or screenable marker could be used, including GFP, GUS, BAR, PAT, HPT or NPTII.

In still yet another aspect, a method is provided of screening a candidate centromere sequence for plant centromere activity, said method comprising the steps of: (a) obtaining an isolated nucleic acid sequence comprising a candidate centromere sequence; (b) integratively transforming plant cells with said isolated nucleic acid; and (c) screening for centromere activity of said candidate centromere sequence. In the method, the screening may comprise observing a phenotypic effect present in the integratively transformed plant cells or plants comprising the plant cells, wherein the phenotypic effect is absent in a control plant cell not integratively transformed with said isolated nucleic acid sequence, or a plant comprising said control plant cell. Types of phenotypic effects that could be screened for include reduced viability, reduced efficiency of said transforming, genetic instability in the integratively transformed nucleic acid, aberrant plant sectors, increased ploidy, aneuploidy, and increased integrative transformation in distal or centromeric chromosome regions. The isolated nucleic acid sequence may comprise a bacterial artificial chromosome, which may be further defined as a binary bacterial artificial chromosome. The integratively transforming may comprise use of any type of transformation, such as *Agrobacterium*-mediated transformation. In one embodiment of the invention, the control plant cell has been integratively transformed with a nucleic acid sequence other than a candidate centromere sequence.

In still yet another aspect, the invention provides a recombinant DNA construct comprising an *Arabidopsis* polyubiquitin 11 promoter, wherein the promoter comprises from about 25 to about 2,000 contiguous nucleotides of the nucleic acid sequence of SEQ ID NO:180. In further embodiments of the invention, the promoter may comprise from about 75 to about 2,000 from about 125 to about 2,000, from about 200 to about 2,000, from about 400 to about 2,000, from about 800 to about 2,000, from about 1,000 to about 2,000, or from about 1,500 to about 200 contiguous nucleotides of the nucleic acid sequence of SEQ ID NO:180, or may comprise the nucleic acid sequence of SEQ ID NO:180. The promoter containing construct may comprise any additional desired sequences, for example, that of an enhancer, a telomere sequence, a plant centromere sequence, an ARS, or a structural gene, including an antibiotic resistance gene, a herbicide resistance gene, a nitrogen fixation gene, a plant pathogen defense gene, a plant stress-induced gene, a toxin gene, a receptor gene, a ligand gene, a seed storage gene, a hormone gene, an enzyme gene, an interleukin gene, a clotting factor gene, a cytokine gene, an antibody gene, and a growth factor gene. In one embodiment of the invention, the promoter may be operably linked to the 5' end of the structural gene.

In still yet another aspect, the invention provides a recombinant DNA construct comprising an *Arabidopsis* 40S ribosomal protein S16 promoter, wherein said promoter comprises from about 25 to about 2,000 contiguous nucleotides of the nucleic acid sequence of SEQ ID NO:182. In particular embodiments of the invention, the promoter may comprise from about 75 to about 2,000, from about 125 to about 2,000, from about 200 to about 2,000, from about 400 to about 2,000, from about 800 to about 2,000, from about 1,000 to about 2,000 or from about 1500 to about 2,000 contiguous nucleotides of the nucleic acid sequence of SEQ ID NO:182, or may comprise the nucleic acid sequence of SEQ ID NO:182, The promoter containing construct may comprise any additional desired sequences, for example, that of an enhancer, a telomere sequence, a plant centromere sequence, an ARS, or a structural gene, including an antibiotic resistance gene, a herbicide resistance gene, a nitrogen fixation gene, a plant pathogen defense gene, a plant stress-induced gene, a toxin gene, a receptor gene, a ligand gene, a seed storage gene, a hormone gene, an enzyme gene, an interleukin gene, a clotting factor gene, a cytokine gene, an antibody gene, and a growth factor gene. In one embodiment of the invention, the promoter may be operably linked to the 5' end of the structural gene.

In still yet another aspect, the invention provides a recombinant DNA construct comprising an *Arabidopsis* polyubiquitin 11 3' regulatory sequence including the terminator sequence, wherein the 3' regulatory sequence comprises from about 25 to about 2001 contiguous nucleotides of the nucleic acid sequence of SEQ ID NO:181. In one embodiment of the invention, the 3' regulatory sequence may be further defined as comprising from about 75 to about 2001, from about 125 to about 2001, from about 200 to about 2001, from about 400 to about 2001, from about 800 to about 2001, or from about 1,000 to about 2001 contiguous nucleotides of the nucleic acid sequence of SEQ ID NO:181, and may comprise the nucleic acid sequence of SEQ ID NO:181. The recombinant sequence may further comprise any other sequence, for example, an enhancer, a telomere sequence, a plant centromere sequence, an ARS, and a structural gene, including an antibiotic resistance gene, a herbicide resistance gene, a nitrogen fixation gene, a plant pathogen defense gene, a plant stress-induced gene, a toxin gene, a receptor gene, a ligand gene, a seed storage gene, a hormone gene, an enzyme gene, an interleukin gene, a clotting factor gene, a cytokine gene, an antibody gene, and a growth factor gene. In one embodiment of the invention, the terminator may be operably linked to the 3' end of the structural gene.

In still yet another aspect, the invention provides a recombinant DNA construct comprising an *Arabidopsis* 40S ribosomal protein S16 3' regulatory sequence including the terminator sequence, wherein the 3' regulatory sequence comprises from about 25 to about 2,000 contiguous nucleotides of the nucleic acid sequence of SEQ ID NO:183. In particular embodiments of the invention, the 3' regulatory sequence may comprise from about 75 to about 2,000, from about 125 to about 2,000, from about 200 to about 2,000, from about 400 to about 2,000, from about 800 to about 2,000, or from about 1,000 to about 2,000 contiguous nucleotides of the nucleic acid sequence of SEQ ID NO:183, and may comprise the nucleic acid sequence of SEQ ID NO:183. The recombinant sequence may further comprise any other sequence, for example, an enhancer, a telomere sequence, a plant centromere sequence, an ARS, and a structural gene, including an antibiotic resistance gene, a herbicide resistance gene, a nitrogen fixation gene, a plant pathogen defense gene, a plant stress-induced gene, a toxin gene, a receptor gene, a ligand gene, a seed storage gene, a hormone gene, an enzyme gene, an interleukin gene, a clotting factor gene, a cytokine gene, an antibody gene, and a growth factor gene. In one embodiment of the invention, the terminator may be operably linked to the 3' end of the structural gene.

In still yet another aspect, the invention provides methods for expressing foreign genes in plants, plant cells, or cells of any other organism of interest. The foreign genes may be from any organism, including plants, animals and bacteria. It is further contemplated that minichromosomes could be used to simultaneously transfer multiple foreign genes to a plant comprising entire biochemical or regulatory pathways. In yet another embodiment of the invention, it is contemplated that the minichromosomes can be used as DNA cloning vectors. Such a vector could be used in plant and animal sequencing projects. The current invention may be of particular use in the cloning of sequences which are "unclonable" in yeast and bacteria, but which may be easier to clone in a plant based system.

In still yet another aspect of the invention, it is contemplated that the minichromosomes disclosed herein may be used to clone functional segments of DNA such as origins of DNA replication, telomeres, telomere associated genes, nuclear matrix attachment regions (MARs), scaffold attachment regions (SARs), boundary elements, enhancers, silencers, promoters, recombinational hot-spots and centromeres. This embodiment may be carried out by cloning DNA into a defective minichromosome which is deficient for one or more type of functional elements. Sequences which complement such deficient elements would cause the minichromosome to be stably inherited. A selectable or screenable marker on the minichromosome could then be used to select for viable minichromosome containing cells which contain cloned functional elements of the type that were non-functional in the defective minichromosome.

In still yet another aspect of the invention, the sequences disclosed herein may be used for the isolation of centromeric sequences from plants other than *Arabidopsis*. Such techniques may employ, for example, hybridization or sequence-based analysis. In one embodiment of the invention, the centromere may be isolated from agriculturally important species such as, for example, vegetable crops, including artichokes, kohlrabi, arugula, leeks, asparagus, lettuce (e.g., head, leaf, romaine), bok choy, malanga, broccoli, melons (e.g., muskmelon, watermelon, crenshaw, honeydew, cantaloupe), brussels sprouts, cabbage, cardoni, carrots, napa, cauliflower, okra, onions, celery, parsley, chick peas, parsnips, chicory, chinese cabbage, peppers, collards, potatoes, cucumber plants (marrows, cucumbers), pumpkins, cucurbits, radishes, dry bulb onions, rutabaga, eggplant, salsify, escarole, shallots, endive, garlic, spinach, green onions, squash, greens, beet (sugar beet and fodder beet), sweet potatoes, swiss chard, horseradish, tomatoes, kale, turnips, and spices. Alternatively, centromeres could be isolated from fruit and vine crops such as apples, apricots, cherries, nectarines, peaches, pears, plums, prunes, quince almonds, chestnuts, filberts, pecans, pistachios, walnuts, citrus, blueberries, boysenberries, cranberries, currants, loganberries, raspberries, strawberries, blackberries, grapes, avocados, bananas, kiwi, persimmons, pomegranate, pineapple, tropical fruits, pomes, melon, mango, papaya, and lychee.

In still yet another aspect of the invention, centromeres could be isolated in accordance with the invention from field crop plants, such as evening primrose, meadow foam, corn (field, sweet, popcorn), hops, jojoba, peanuts, rice, safflower, small grains (barley, oats, rye, wheat, etc.), sorghum, tobacco, kapok, leguminous plants (beans, lentils, peas, soybeans), oil plants (rape, mustard, poppy, olives, sunflowers, coconut, castor oil plants, cocoa beans, groundnuts), fibre plants (cotton, flax, hemp, jute), lauraceae (cinnamon, camphor), or plants such as coffee, sugarcane, tea, and natural rubber plants. Still other examples of plants from which centromeres could be isolated include bedding plants such as flowers, cactus, succulents and ornamental plants, as well as trees such as forest (broad-leaved trees and evergreens, such as conifers), fruit, ornamental, and nut-bearing trees, as well as shrubs and other nursery stock.

In still yet another aspect of the invention, the minichromosome vectors described herein may be used to perform efficient gene replacement studies. At present, gene replacement has been detected on only a few occasions in plant systems and has only been detected at low frequency in mammalian tissue culture systems (see Thomas et al., 1986; Smithies et al., 1985). The reason for this is the high frequency of illegitimate nonhomologous recombination events relative to the frequency of homologous recombination events (the latter are responsible for gene replacement). Artificial: chromosomes may participate in homologous recombination preferentially. Since the artificial chromosomes remain intact upon delivery, no recombinogenic broken ends will be generated to serve as substrates for the extremely efficient illegitimate recombination machinery. Thus, the artificial chromosome vectors disclosed by the present invention will be maintained in the nucleus through meiosis and available to participate in homology-dependent meiotic recombination. In addition, because in principle, artificial chromosomes of any length could be constructed using the teachings of the present invention, the vectors could be used to introduce extremely long stretches of DNA from the same or any other organism into cells. Specifically contemplated inserts include those from about several base pairs to one hundred megabase pairs, including about 1 kb, 25 kB, 50 kB, 100 kB, 125 kB, 150 kB, 200 kB, 300 kB, 400 kB, 500 kB, 600 kB, 700 kB, 800 kB, 900 kB, 1 MB, 1.25 Mb, 1.5 Mb, 2 Mb, 3 Mb, 5 Mb, 10 Mb, 25 Mb, 50 Mb and 100 Mb.

In still yet another aspect, the present invention provides methods for the construction of minichromosome vectors for the genetic transformation of plant cells, uses the vectors, and organisms transformed by them. Standard reference works setting forth the general principles of recombinant DNA technology include Lewin, 1985. Other works describe methods and products of genetic engineering. See, e.g., Maniatis et al., 1982; Watson et al., 1983; Setlow et al., 1979; and Dillon et al., 1985.

In still yet another aspect, the invention provides a method of preparing a transgenic cell. In one embodiment of the invention, the method comprises the steps of: a.) obtaining a nucleic acid molecule comprising *Arabidopsis thaliana* centromere DNA having the following characteristics: 1.) mapping to a location on an *Arabidopsis thaliana* chromosome defined by a pair of genetic markers selected from the group consisting of: mi342 and T27K12, mi310 and g4133, atpox and ATA, mi233 and mi167, and F13K20-t7 and CUE1, and 2.) sorts DNA to the spindle poles in meiosis 1 in a pattern indicating the disjunction of homologous chromosomes, b) preparing a recombinant construct comprising said nucleic acid molecule; and c) transforming a recipient cell with said recombinant construct.

The cell may be, for example, a lower eukaryotic cell including a yeast cell, or may be a higher eukaryotic cell. Where the cell is a higher eukaryotic cell, the cell may be an animal or plant cell. In one embodiment of the invention, the cell is not an *Arabidopsis thaliana* cell. In another embodiment of the invention, the *Arabidopsis thaliana* centromere is defined by the marker pair mi342 and T27K12, which may be further defined by the genetic marker pair T22C23-t7 and T3P3-sp6; and/or is defined by the marker pair mi310 and g4133, which may be further defined by the genetic marker pair F5J15-sp6 and T15D9; and/or is defined by the marker pair atpox and ATA, which may be further defined by the genetic marker pair T9G9-sp6 and T5 M14-sp6; and/or is defined by the marker pair mi233 and mi167, which may be further defined by the genetic marker pair T24H24.30k3 and F13H14-t7; and/or is defined by the genetic marker pair F13K20-t7 and CUE1, which may be further defined by a genetic marker pair selected from the group consisting of F13K20-T7 and T18M4, F13K20-T7 and T18F2, F13K20-T7 and T24I20, T18M4 and T18F2, T18M4 and T24I20, T18M4 and CUE1, T18F2 and T24I20, T18F2 and CUE1, and T24I20 and CUE1.

In one embodiment of the invention, the transforming may comprise use of a method selected from the group consisting of: *Agrobacterium*-mediated transformation, protoplast transformation, electroporation, or particle bombardment. The recombinant construct may comprise desired elements, including a telomere, such as an *Arabidopsis thaliana* or yeast telomere. The recombinant construct may also comprise an autonomous replicating sequence (ARS), for example, an *Arabidopsis thaliana* ARS. The recombinant construct may also comprise a prokaryotic or eukaryotic selectable or screenable marker gene. Also desired to include with a recombinant construct may be one or more structural genes. Exemplary structural genes include a gene selected from the group consisting of an antibiotic resistance gene, a herbicide resistance gene, a nitrogen fixation gene, a plant pathogen defense gene, a plant stress-induced gene, a toxin gene, a seed storage gene, a hormone gene, an enzyme gene, an interleukin gene, a clotting factor gene, a cytokine gene, an antibody gene, and a growth factor gene. The method may further comprise the step of regenerating a transgenic plant from said cell.

In still yet another aspect, the invention provides a method of identifying a nucleic acid molecule capable of conferring centromere activity comprising the steps of: a) obtaining a nucleic acid molecule comprising *Arabidopsis thaliana* centromere DNA, wherein the *Arabidopsis thaliana* centromere is defined by a pair of genetic markers selected from the group consisting of mi342 and T27K12, mi310 and g4133, atpox and ATA, mi233 and mi167, and F13K20-t7 and T17M11-sp6; b) preparing a recombinant construct that comprises the nucleic acid molecule; and c) determining the ability of the recombinant construct to demonstrate a stable inheritance pattern. In the method, the ability to demonstrate a stable inheritance pattern may be determined by preparing a recombinant cell that comprises the recombinant construct. In another embodiment of the invention, the *Arabidopsis thaliana* centromere is defined by the marker pair mi342 and T27K12, which may be further defined by the genetic marker pair T22C23-t7 and T3P8sp6; and/or is defined by the marker pair mi310 and g4133, which may be further defined by the genetic marker pair F5J15-sp6 and T15D9; and/or is defined by the marker pair atpox and ATA, which may be further defined by the genetic marker pair T9G9-sp6 and T5M14-sp6; and/or is defined by the marker pair mi233 and mi167, which may be further defined by the genetic marker pair T24H24.30k3 and F13H14-t7; and/or is defined by the genetic marker pair F13K20-t7 and CUE1, which may be further defined by a genetic marker pair selected from the group consisting of F13K20-T7 and T18M4, F13K20-T7 and T18F2, F13K20-T7 and T24I20, T18M4 and T18F2, T18M4 and T24I20, T18M4 and CUE1, T18F2 and T24I20, T18F2 and CUE1, and T24I20 and CUE1.

In one embodiment of the invention, the recombinant construct is not chromosomally integrated. Said obtaining may comprise obtaining a BAC or YAC clone comprising said *Arabidopsis thaliana* centromere DNA. The DNA may be obtained by a method that includes the use of pulsed-field gel electrophoresis, and may be obtained by a method that includes positional cloning. In another embodiment of the invention, the positional cloning may comprise identifying a contiguous set of clones comprising said *Arabidopsis thaliana* centromere DNA, wherein said set of clones is flanked by a pair of genetic markers selected from the group consisting of mi342 and T27K12, mi310 and g4133, atpox and ATA, mi233 and mi167, and F13K20-t7 and T17M11-sp6.

The contiguous set of clones may span the *Arabidopsis thaliana* centromere. The recombinant construct may comprise a selectable or screenable marker and said step of determining may comprise determining a phenotype conferred by the selectable or screenable marker. The determining may comprise, for example, determining the ability of the recombinant construct to demonstrate a stable inheritance pattern in mitosis and/or meiosis. In still another embodiment, the invention provides a transgenic cell prepared by a method provided by the invention. Also provided by the invention are a transgenic plant, plant parts and tissue cultures comprising the transgenic cell. In another embodiment of the invention, the *Arabidopsis thaliana* centromere is defined by the marker pair mi342 and T27K12, which may be further defined by the genetic marker pair T22C23-t7 and T3P8-sp6; and/or is defined by the marker pair mi310 and g4133, which may be further defined by the genetic marker pair F5J15-sp6 and T15D9; and/or is defined by the marker pair atpox and ATA, which may be further defined by the genetic marker pair T9G9-sp6 and T5M14-sp6; and/or is defined by the marker pair mi233 and mi167, which may be further defined by the genetic marker pair T24H24.30k3 and F13H14-t7; and/or is defined by the genetic marker pair F13K20-t7 and CUE1, which may be further defined by a genetic marker pair selected from the group consisting of F13K20-T7 and T18M4, F13K20-T7 and T18F2, F13K20-T7 and T24I20, T18M4 and T18F2, T18M4 and T24I20, T18M4 and CUE1, T18F2 and T24I20, T18F2 and CUE1, and T24I20 and CUE1.

In still yet another aspect of the invention, a centromere used in accordance with the invention is not from *Arabidopsis*, for example, from *Arabidopsis thaliana*. Similarly, a plant or plant cell comprising a centromere composition in accordance with the invention, may also be from a plant other than *Arabidopsis*.

BRIEF DESCRIPTION OF THE DRAWINGS

The following drawings form part of the present specification and are included to further demonstrate certain aspects of the present invention. The invention may be better understood by reference to one or more of these drawings in combination with the detailed description of specific embodiments presented herein.

FIG. 4. Exemplary list of seed stock used for tetrad analysis in *Arabidopsis thaliana*. The individual strains are identified by the strain number (column B). The tetrad member number (column A) indicates the tetrad source (i.e., T1 indicates seeds from tetrad number 1, and the numbers −1, −2, −3, or −4 indicate individual members of the tetrad). The strains listed have been deposited with the *Arabidopsis*

Biological Resources Center (ABRC) at Ohio State University under the name of Daphne Preuss.

FIG. 5. Marker information for centromere mapping. DNA polymorphisms used to localize the centromeres are indicated by chromosome (Column 1). The name of each marker is shown in Column 2, the name of the markers used by Copenhaver et al., 1999 to position centromeres is given in Column 3 and marker type is indicated in Column 4. CAPS (Co-dominant Amplified Polymorphic Sites) are markers that can be amplified with PCR and detected by digesting with the appropriate restriction enzyme (also indicated in Column 3). SSLPs (Simple Sequence Length Polymorphisms) detect polymorphisms by amplifying different length PCR products. Column 5 notes if the marker is available on public web sites (e.g., genome-www.stanford.edu/Arabidopsis). For those markers that are not available on public web sites the sequences of the forward and reverse primers used to amplify the marker are listed in columns 6 and 7, respectively.

Figure 6:
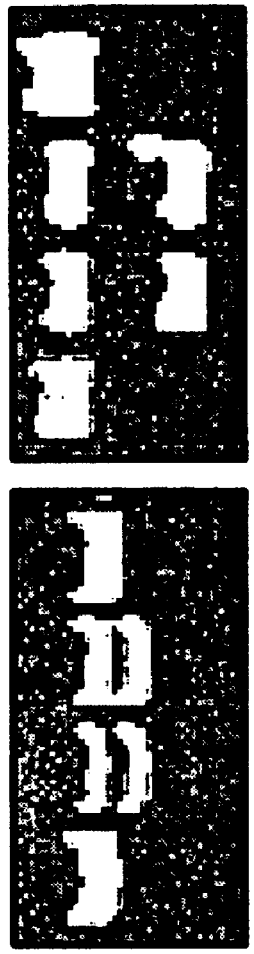

FIG. 6. Scoring PCR-based markers for tetrad analysis. The genotype of the progeny from one pollen tetrad (T2) was determined for two genetic markers (SO392 and nga76). Analysis of the four progeny plants (T2-1 through T2-4) using PCR and gel electrophoresis allows the genotype of the plant to be determined, and the genotype of the pollen parent to be inferred.

Figure 7A:
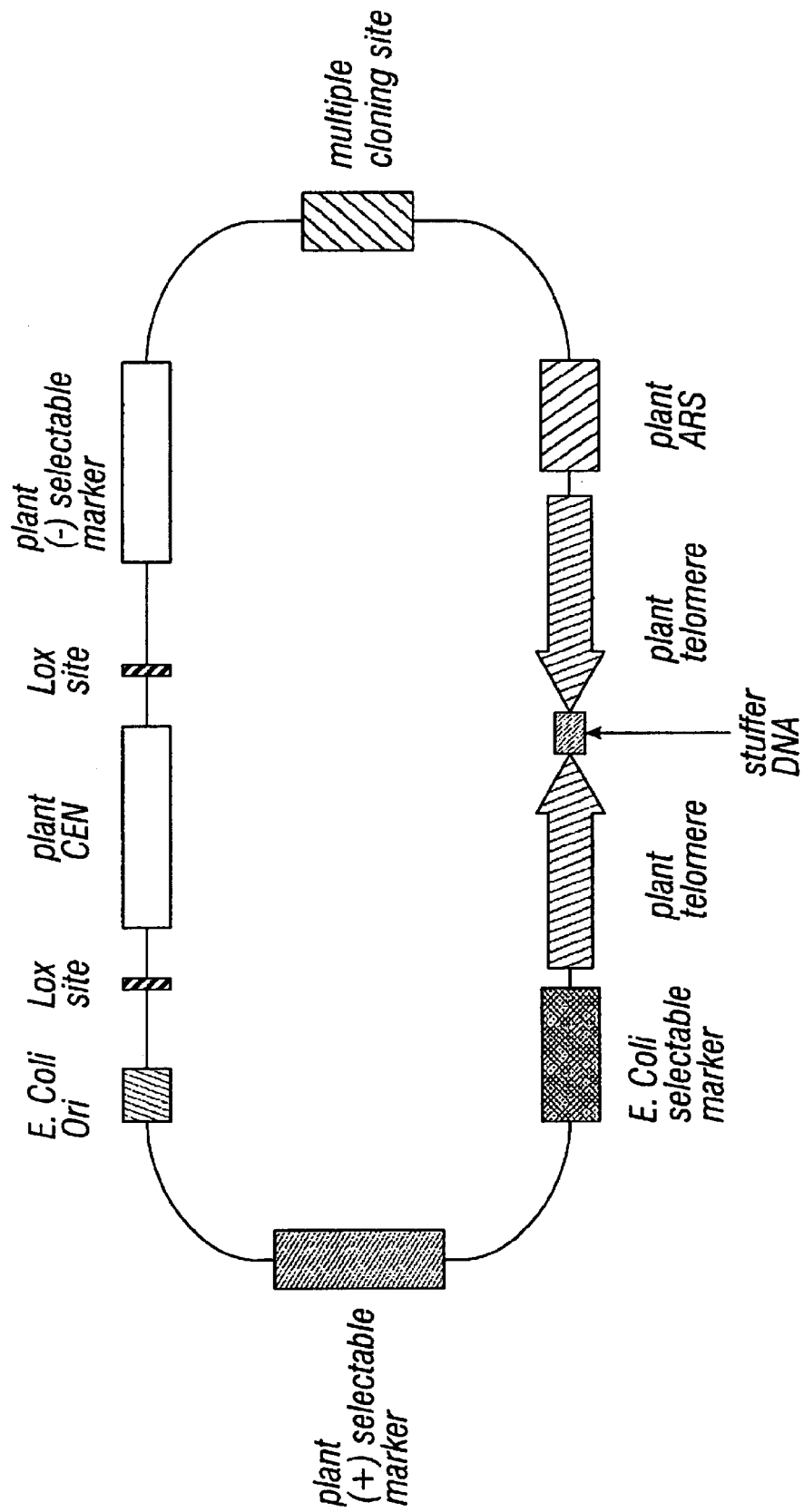
Figure 7B:
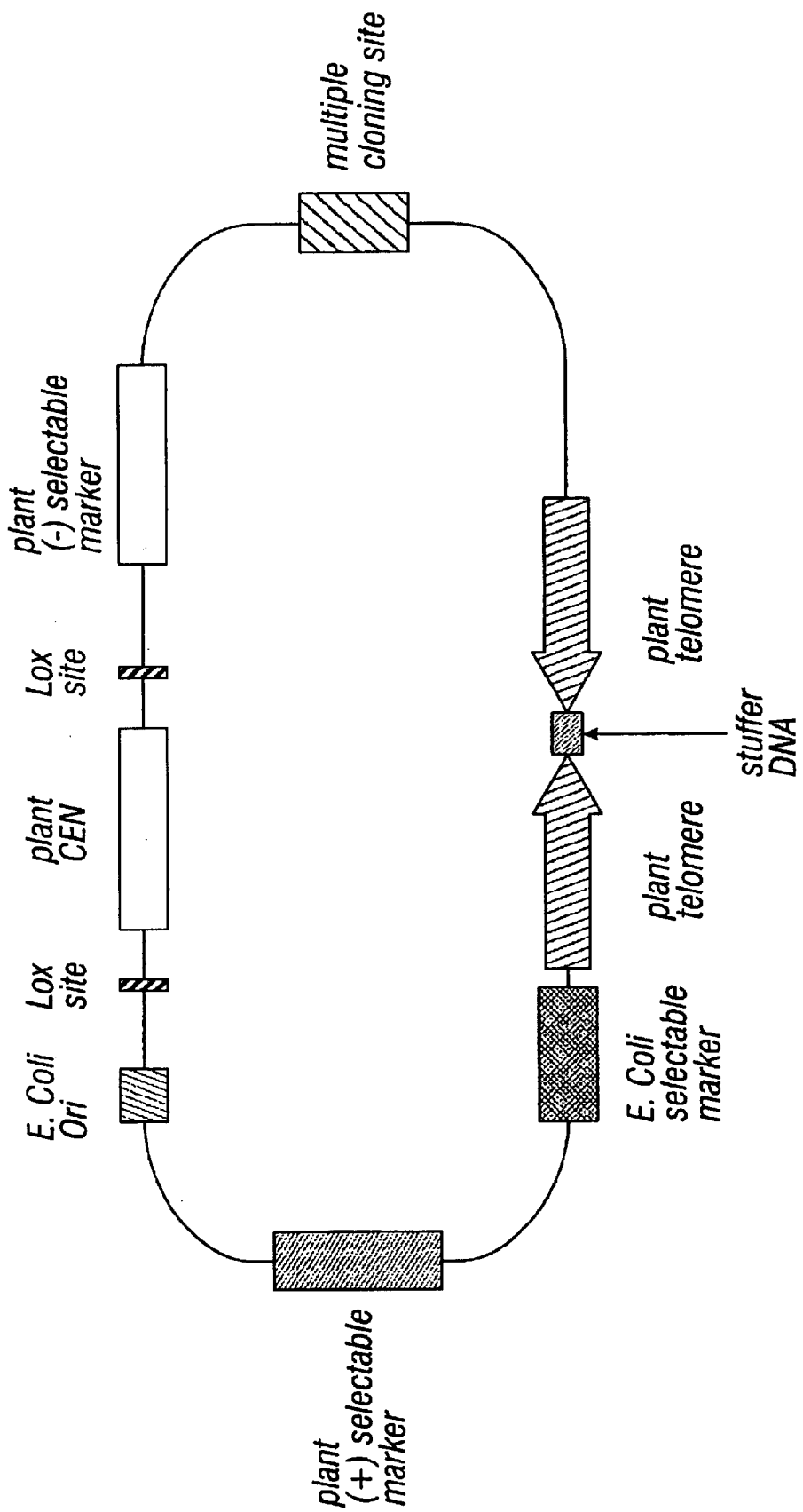
Figure 7C:
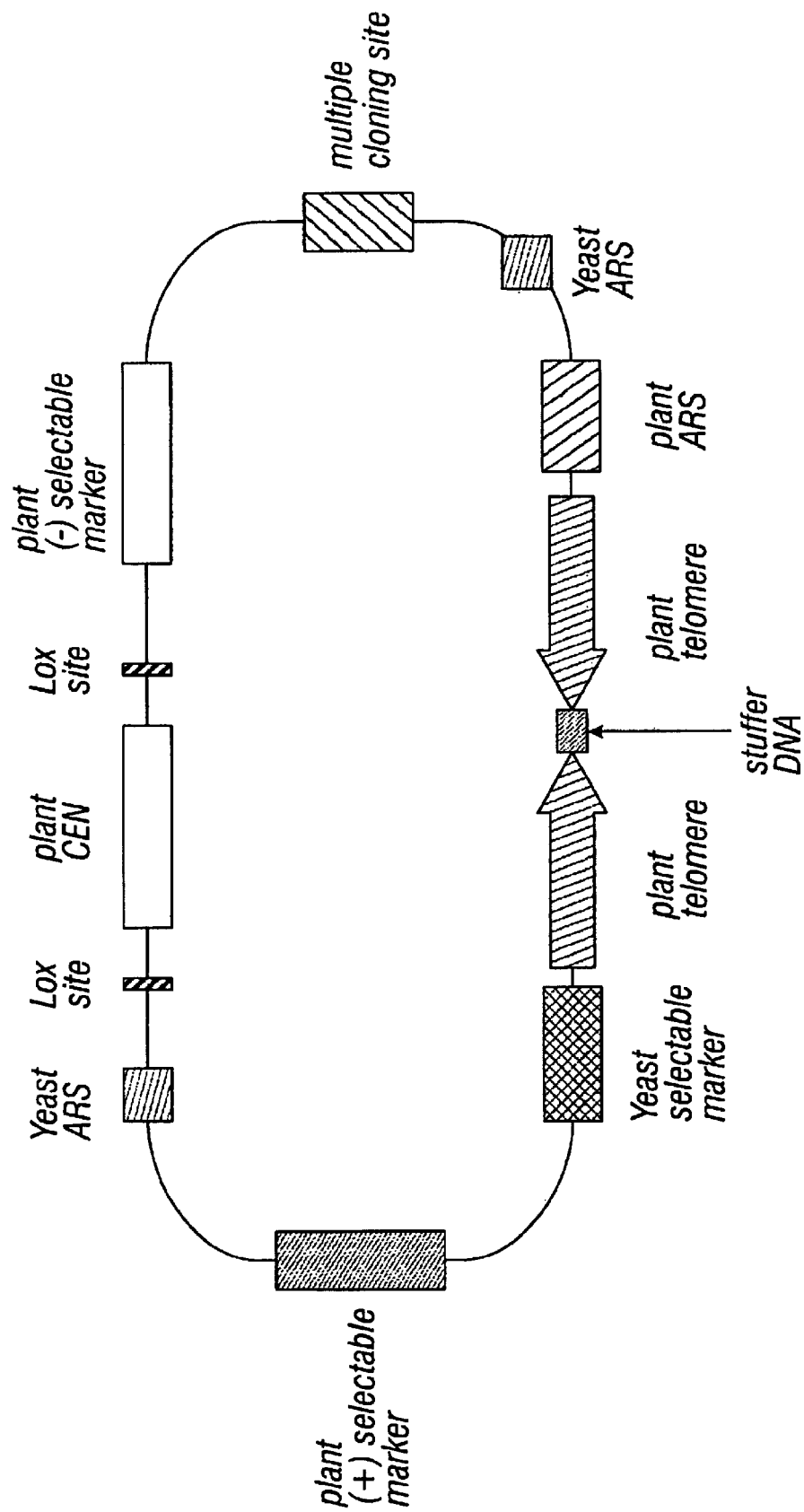
Figure 7D:
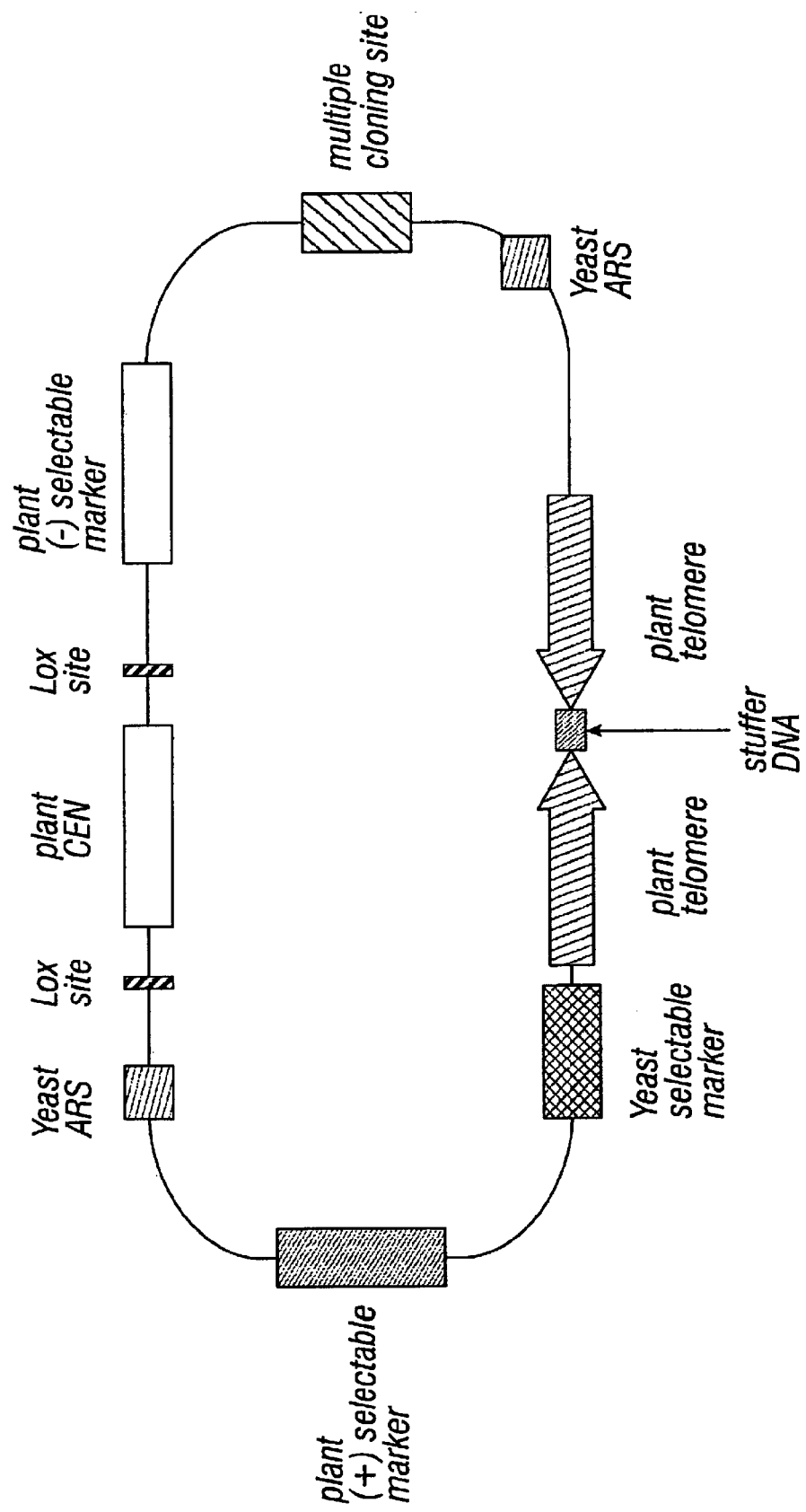
Figure 7E:
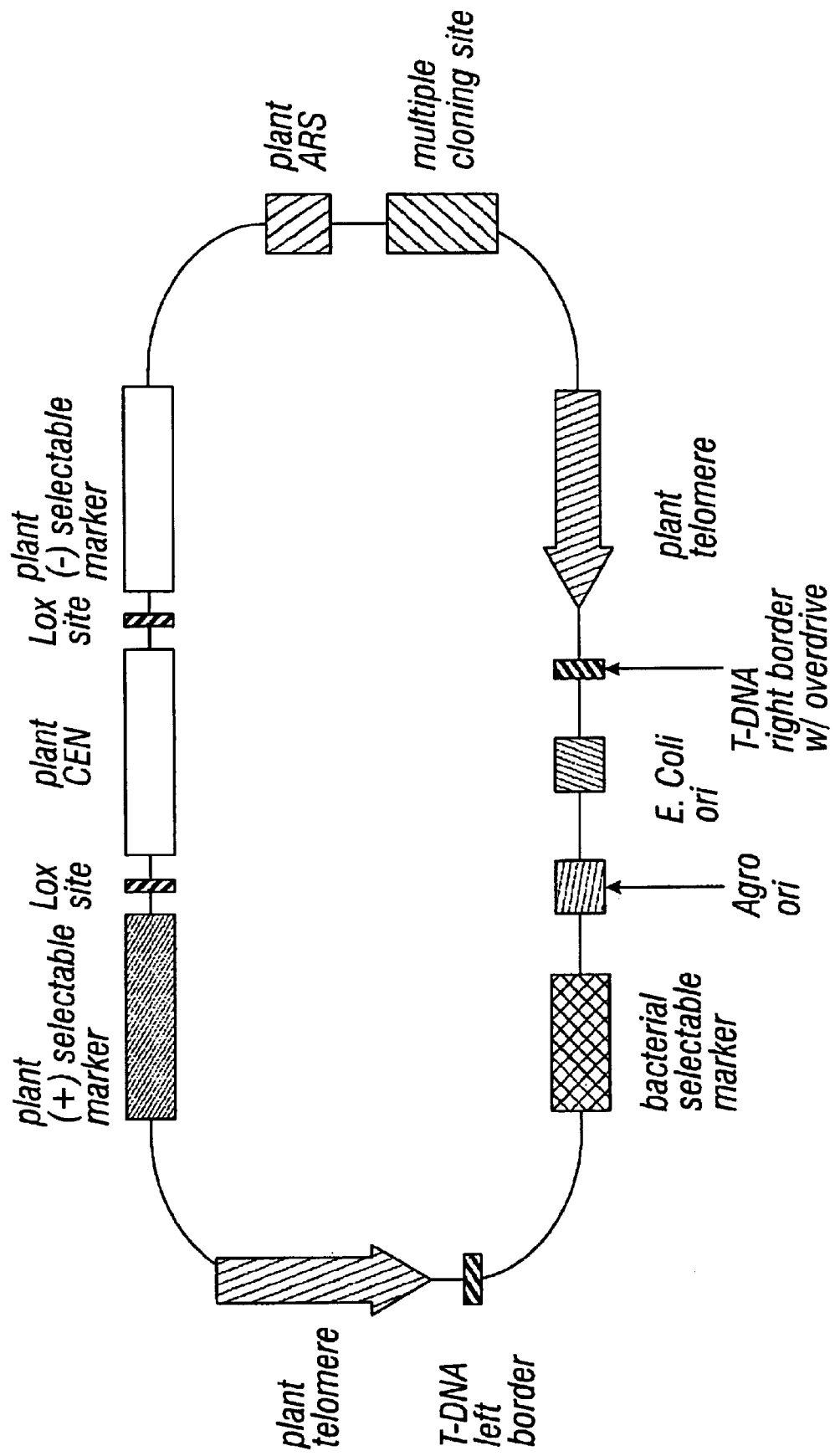
Figure 7F:
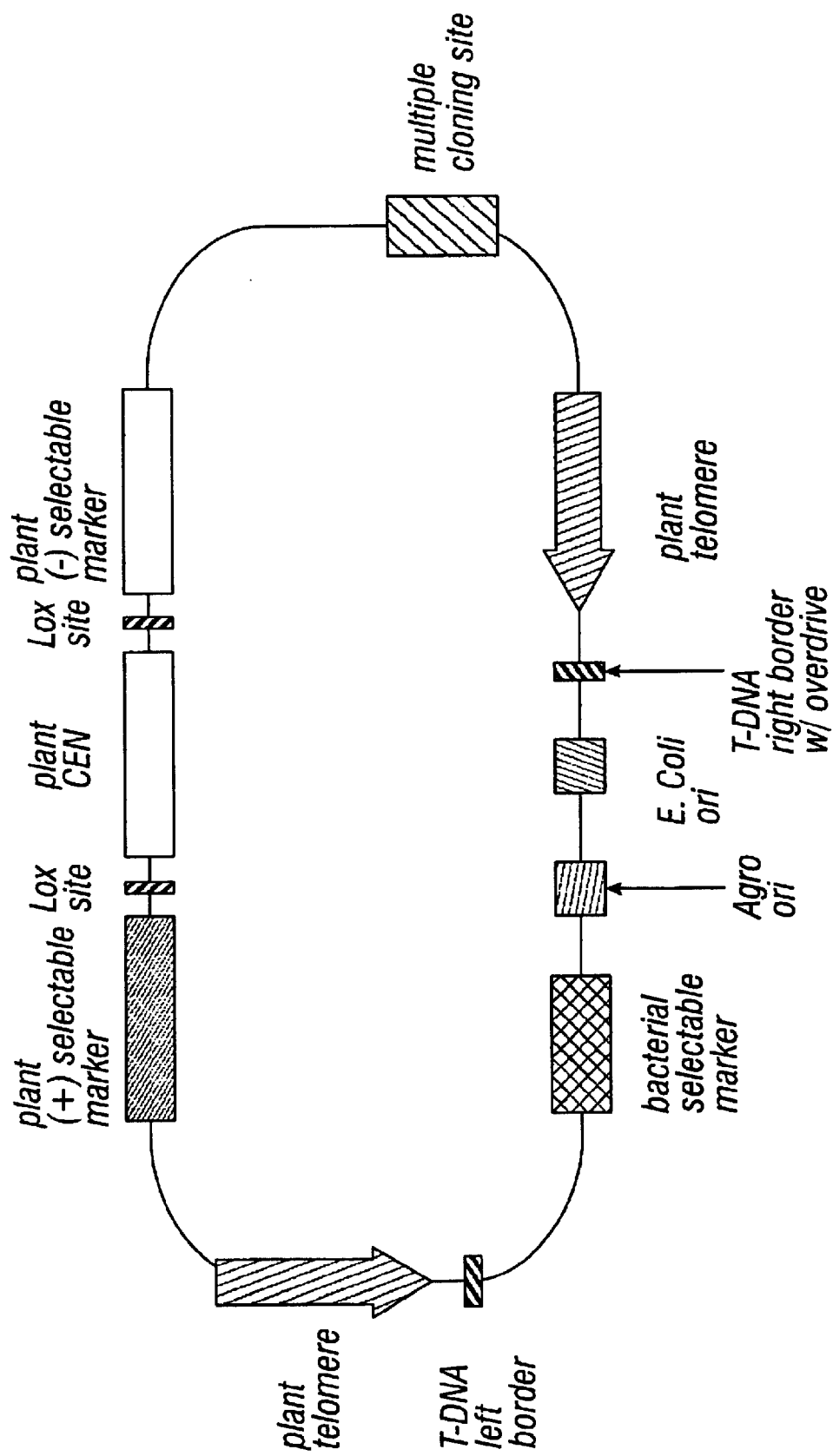
Figure 7G:
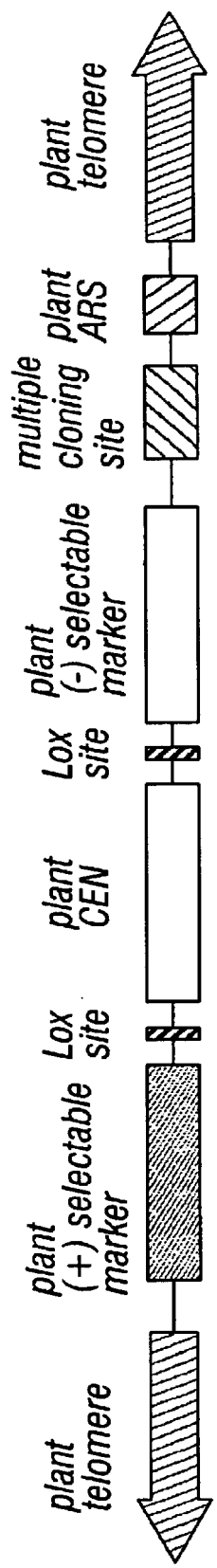
Figure 7H:
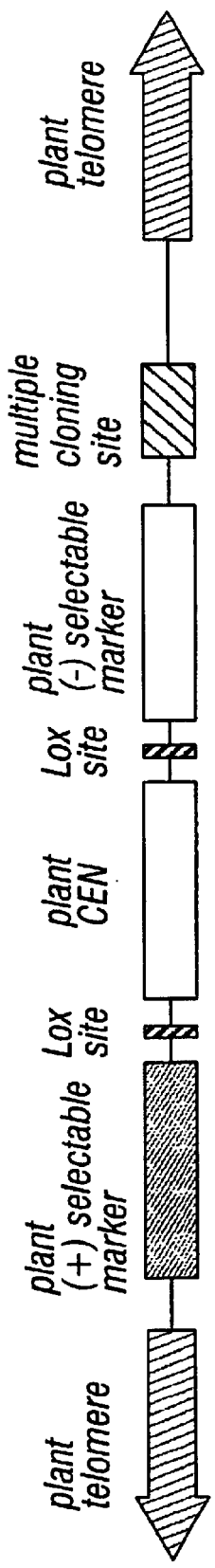
Figure 71:
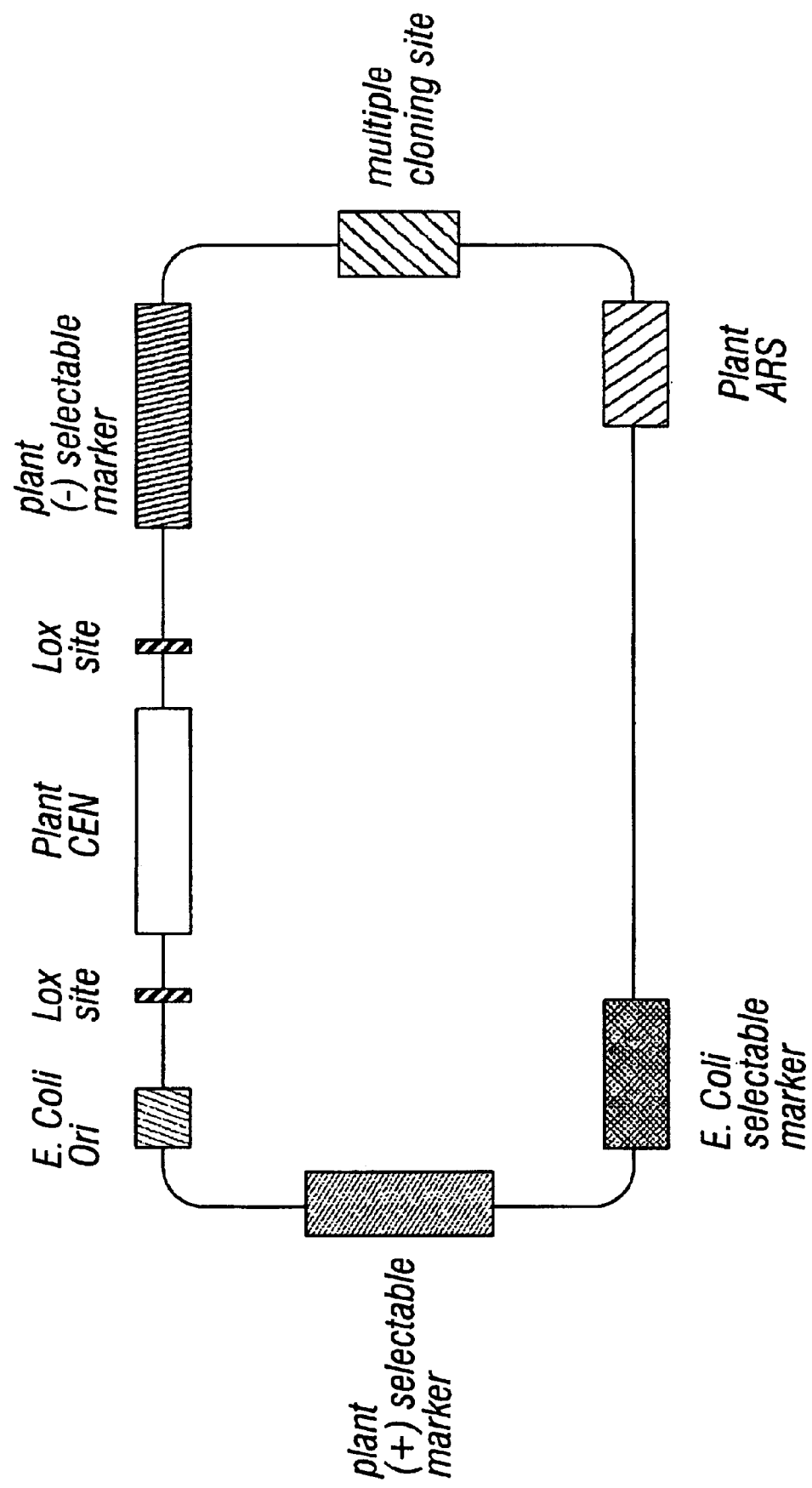
Figure 7J:
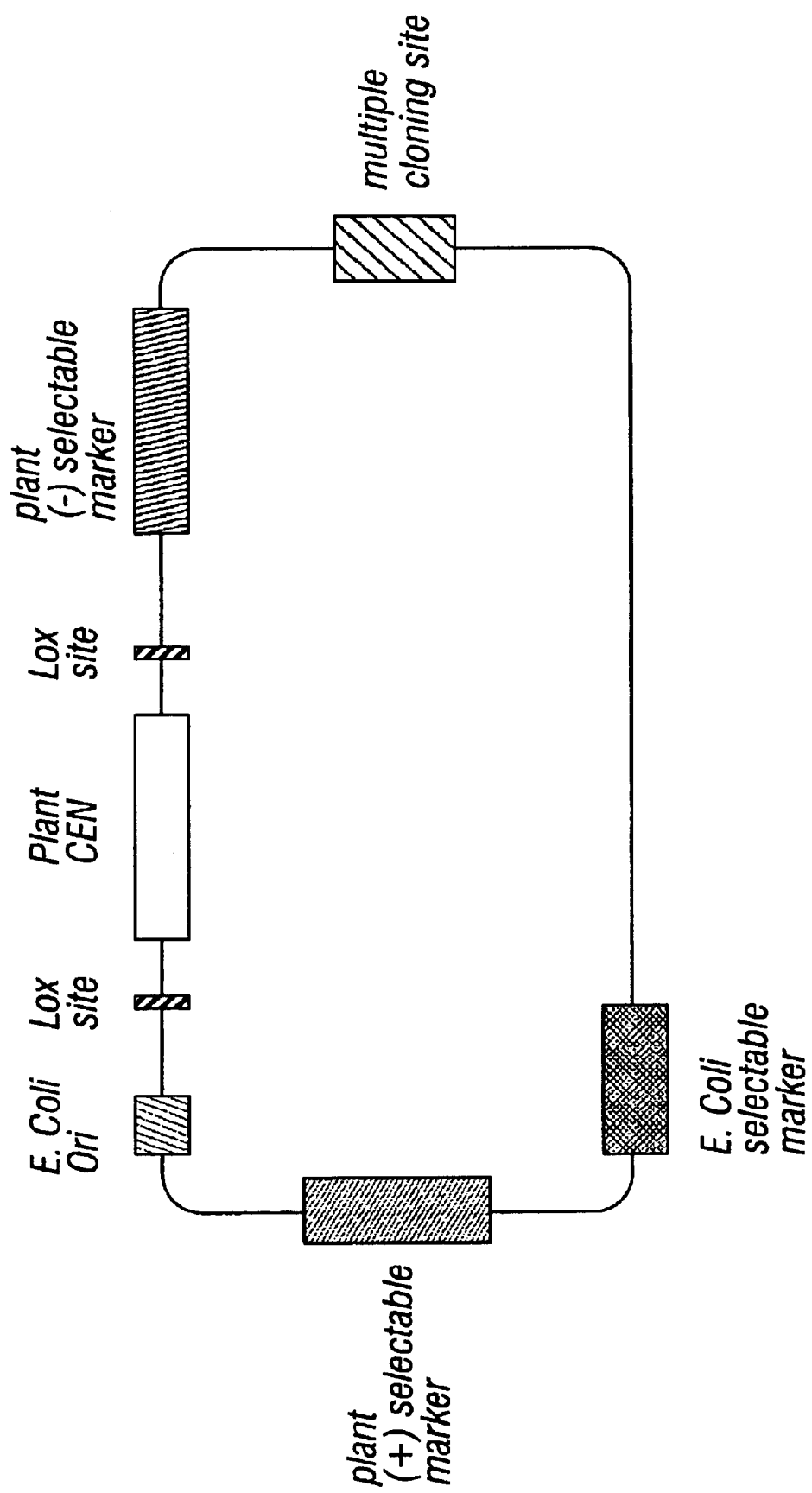
Figure 7K:
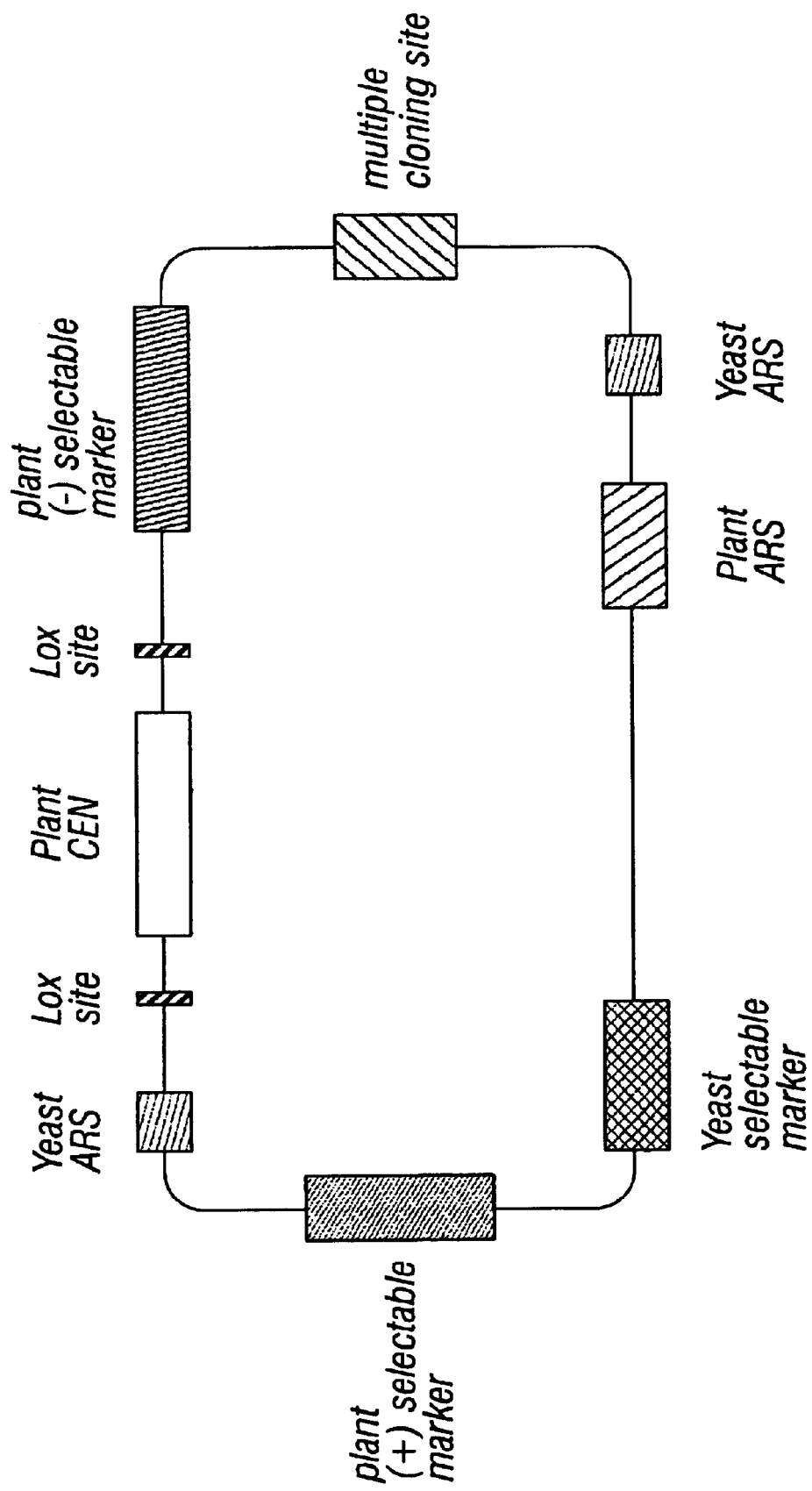
Figure 7L:
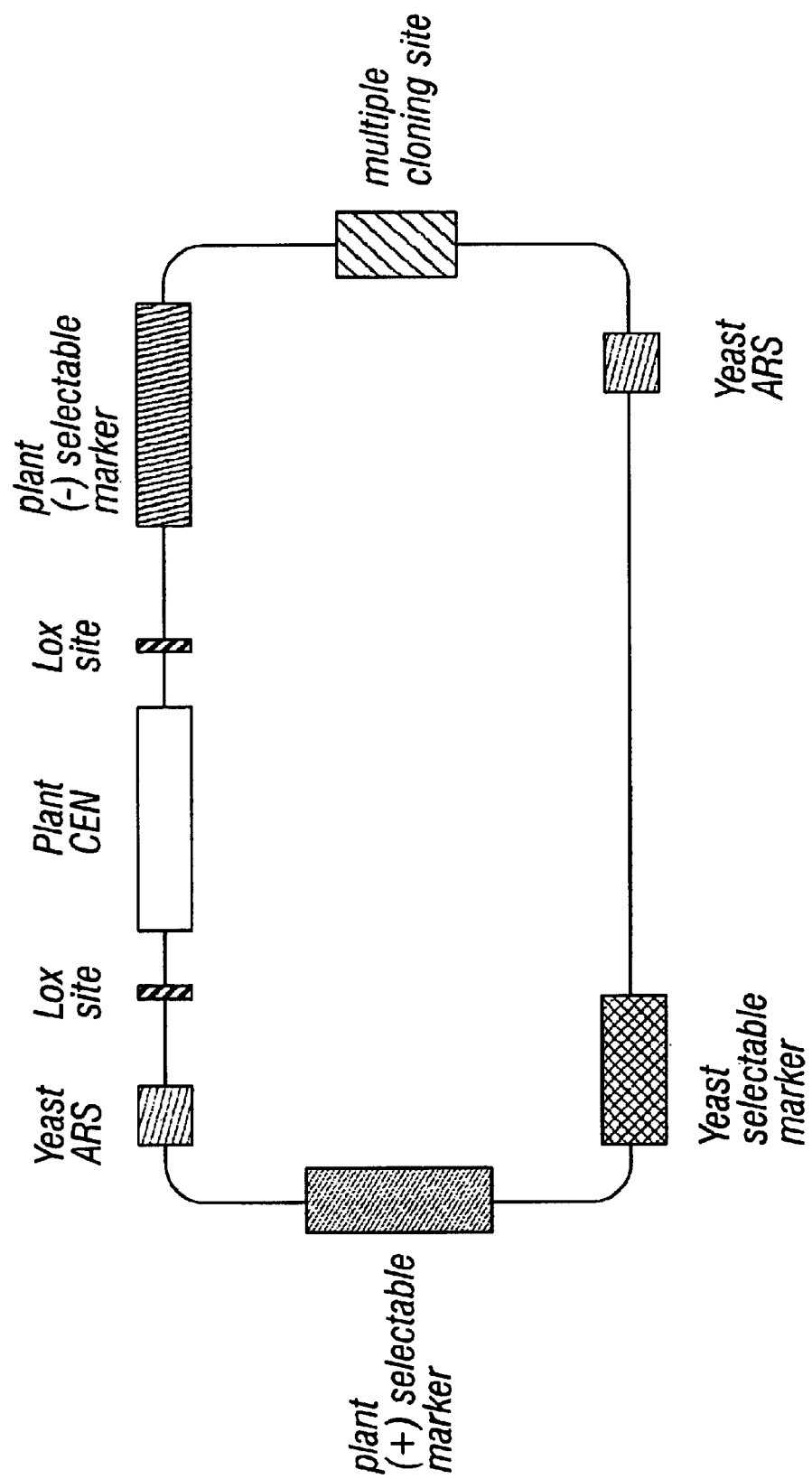
Figure 7M:
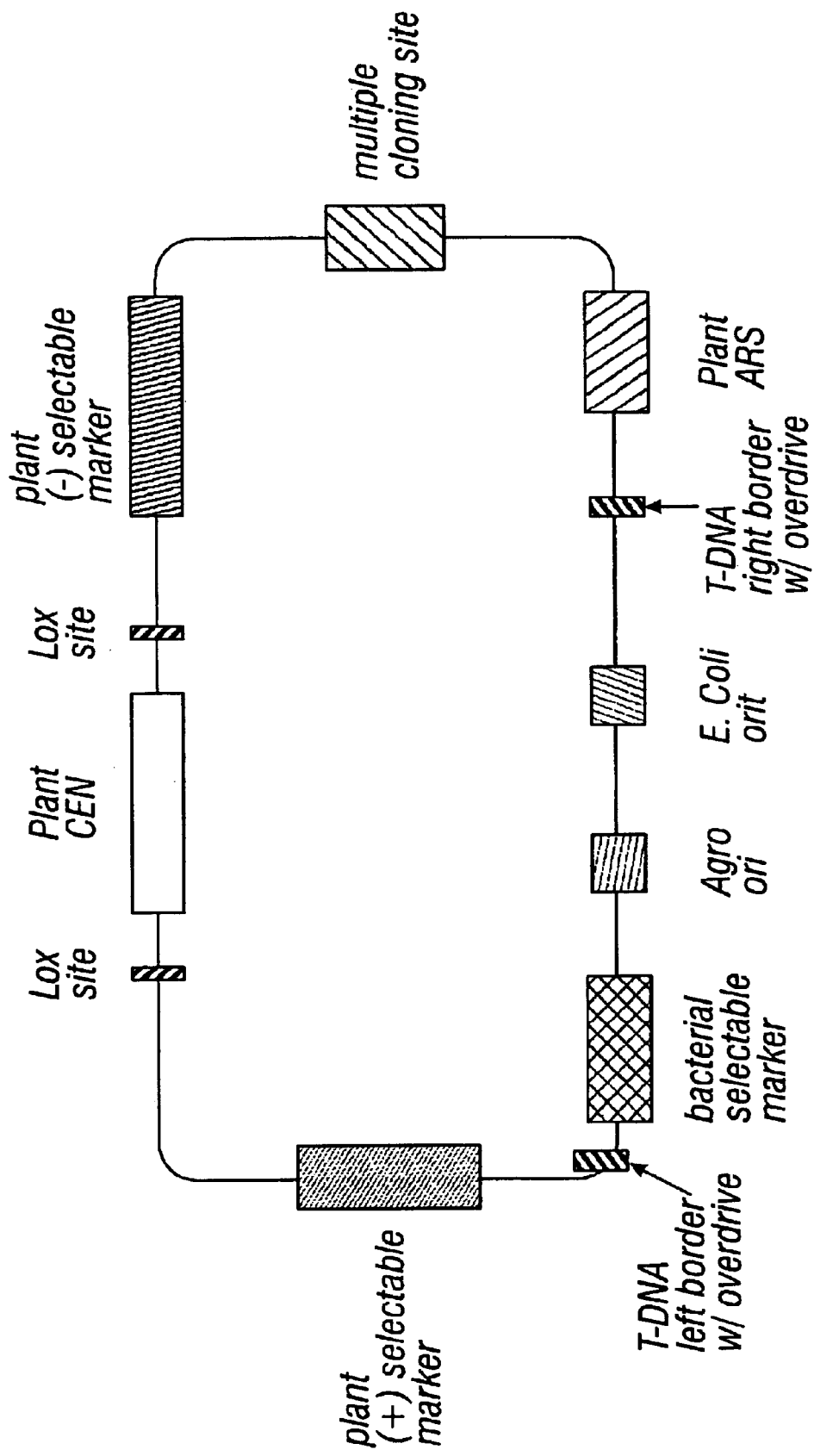
Figure 7N:
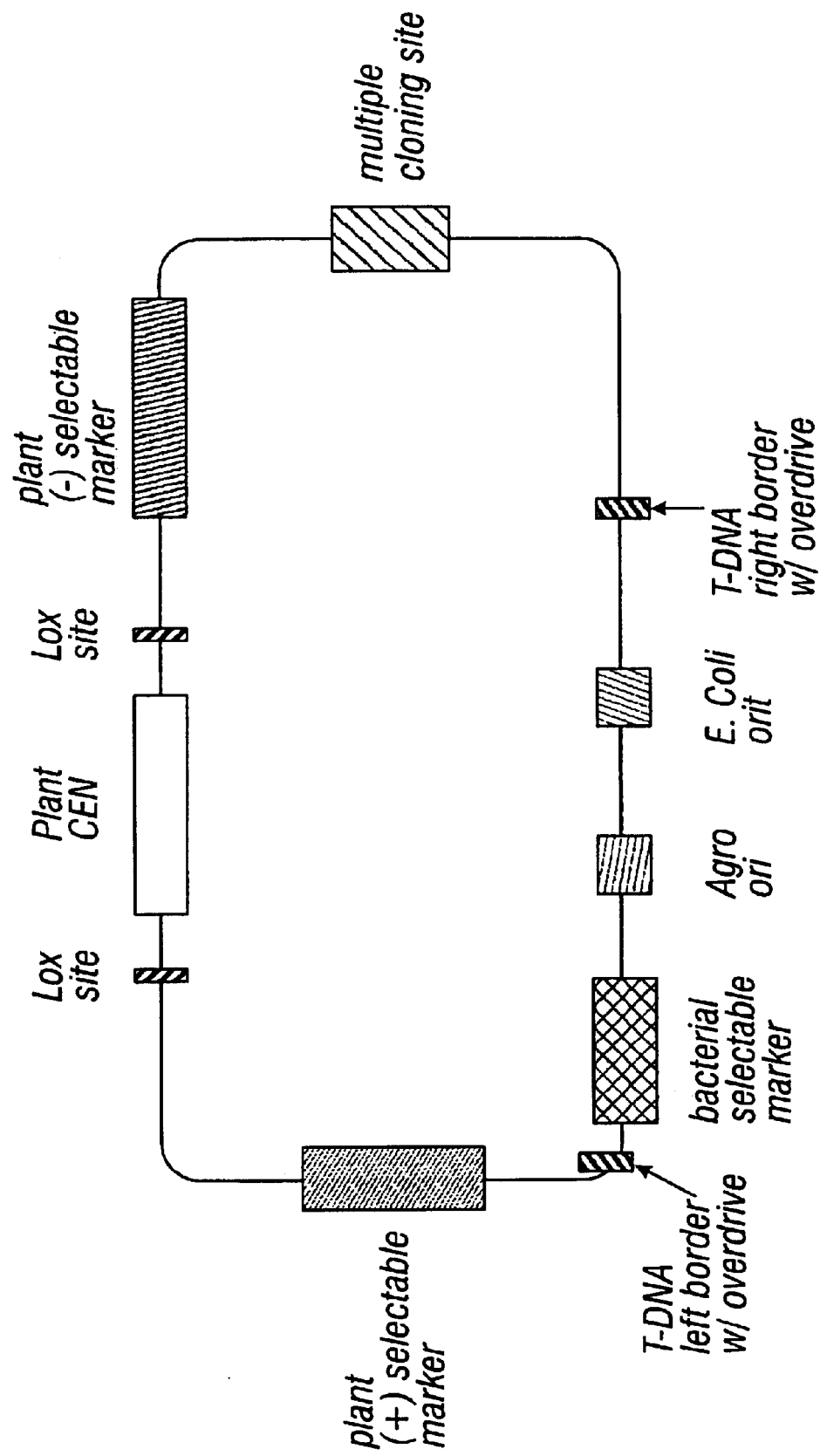

FIGS. 7A–7N. Exemplary Minichromosome vectors: The vectors shown in FIG. 7A, FIG. 7B, FIG. 7E, FIG. 7F, FIG. 7I and FIG. 7J have an *E. coli* origin of replication which can be high copy number, low copy number or single copy. In FIGS. 7A–7N, the vectors include a multiple cloning site which can contain recognition sequences for conventional restriction endonucleases with 4–8 bp specificity as well as recognition sequences for very rare cutting enzymes such as, for example, I-Ppo I, I-Cue I, PI-Tli, PI-Psp I, Not I, and PI Sce I. In FIGS. 7A–7N, the centromere is flanked by Lox sites which can act as targets for the site specific recombinase Cre. FIG. 7A. Shows an *E. coli* plant circular shuttle vector with a plant ARS. FIG. 7B. Shows a plant circular vector without a plant ARS. The vector relies on a plant origin of replication function found in other plant DNA sequences such as selectable or screenable markers. FIG. 7C. Shows a yeast-plant circular shuttle vector with a plant ARS. The yeast ARS is included twice, once on either side of multiple cloning site to ensure that large inserts are stable. FIG. 7D. Shows a yeast-plant circular shuttle vector without a plant ARS. The vector relies on a plant origin of replication function found in other plant DNA sequences such as selectable markers. The yeast ARS is included twice, once on either side of the multiple cloning site to ensure that large inserts are stable. FIG. 7E. Shows an *E. coli-Agrobacterium*-plant circular shuttle vector with a plant ARS. Vir functions for T-DNA transfer would be provided in trans by a using the appropriate *Agrobacterium* strain. FIG. 7F. Shows an *E. coli-Agrobacterium*-plant circular shuttle vector without a plant ARS. The vector relies on a plant origin of replication function found in other plant DNA sequences such as selectable markers. Vir functions for T-DNA transfer would be provided in trans by a using the appropriate *Agrobacterium* strain. FIG. 7G. Shows a linear plant vector with a plant ARS. The linear vector could be assembled in vitro and then transferred into the plant by, for example, mechanical means such as micro projectile bombardment, electroporation, or PEG-mediated transformation. FIG. 7H. Shows a linear plant vector without a plant ARS. The linear vector could be assembled in vitro and then transferred into the plant by, for example, mechanical means such as micro projectile bombardment, electroporation, or PEG-mediated transformation. FIGS. 7I–7N. The figures are identical to FIGS. 7A–7F, respectively, with the exception that they do not contain plant telomeres. These vectors will remain circular once delivered into the plant cell and therefore do not require telomeres to stabilize their ends.

Figure 8A:
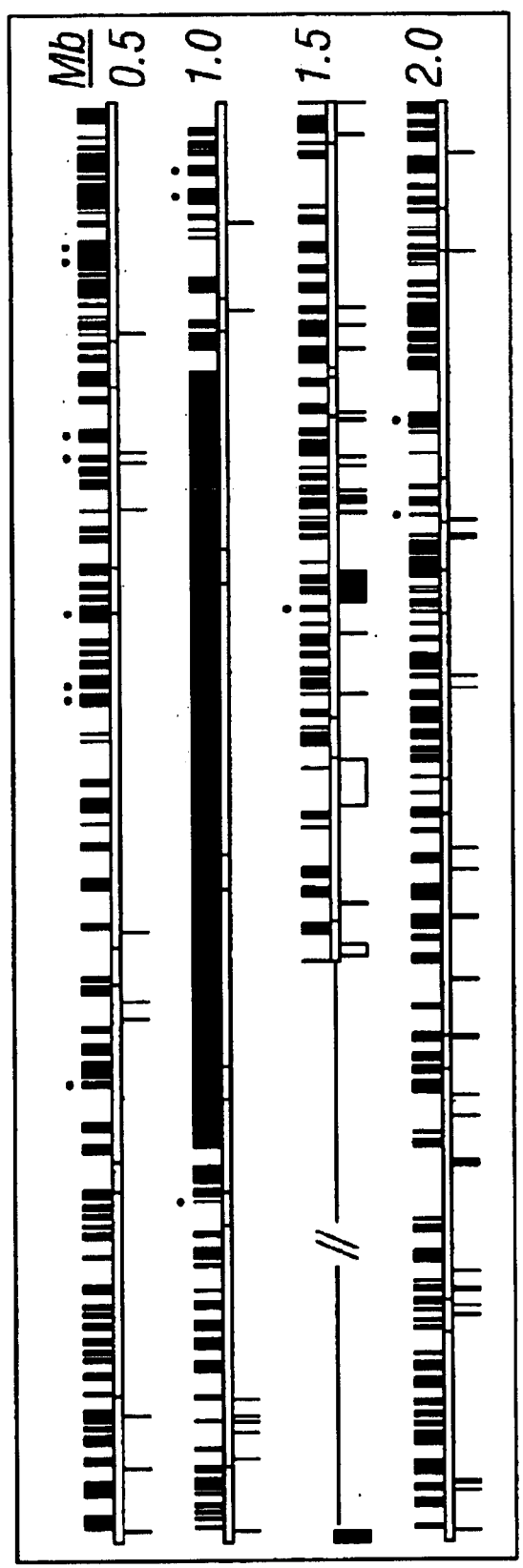
Figure 8B:
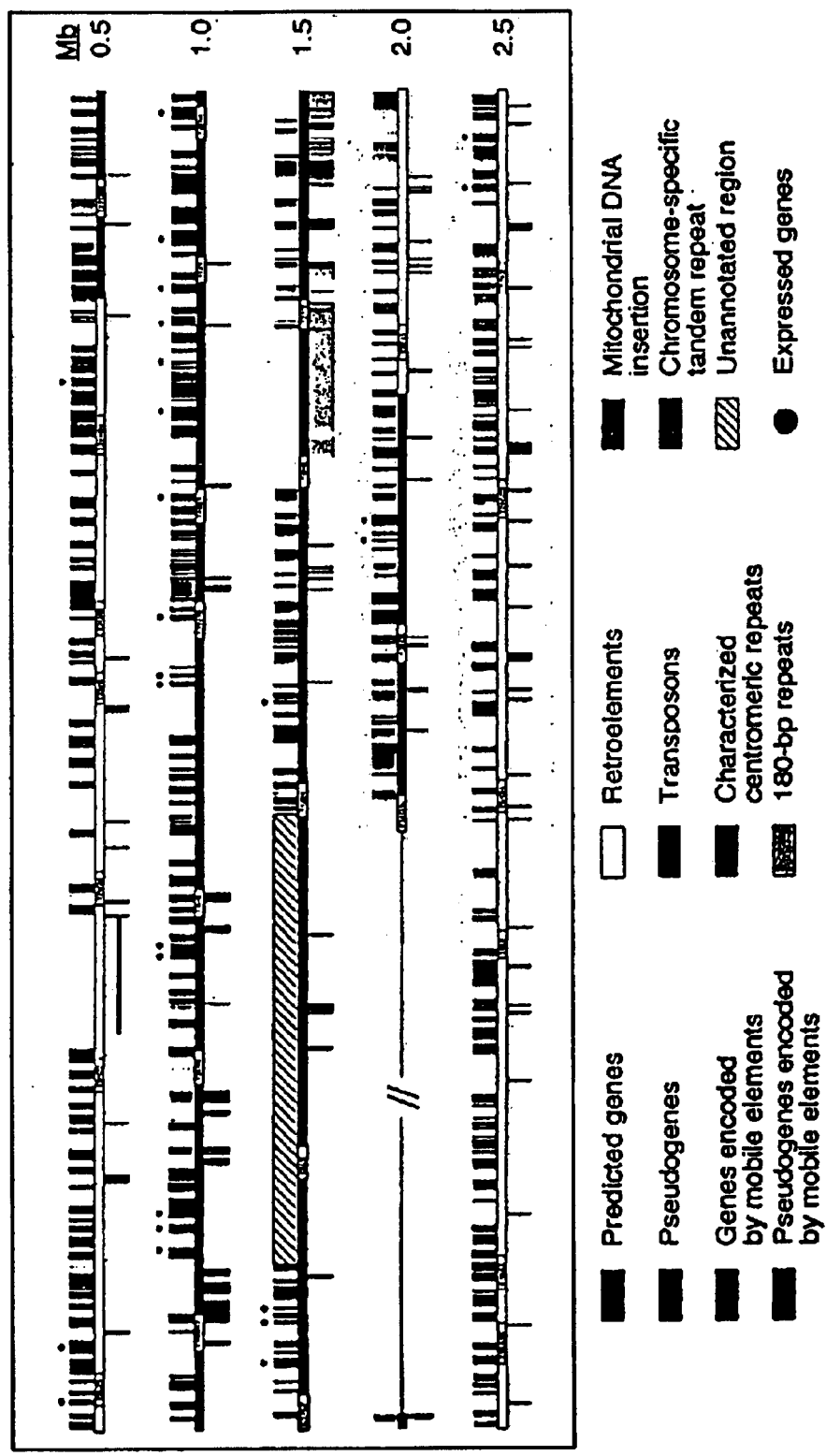

FIG. 8. Sequence features at CEN2 (A) and CEN4 (B). Central bars depict annotated genomic sequence of indicated BAC clones; black, genetically-defined centromeres; white, regions, flanking the centromeres. Sequences corresponding to genes and repetitive features, filled boxes (above and below the bars, respectively), are defined as in FIGS. 12A–T; predicted nonmobile genes, red; genes carried by mobile elements, black; nonmobile pseudogenes, pink; pseudogenes carried by mobile elements, gray; retroelements, yellow; transposons, green; previously defined centromeric repeats, dark blue; 180 bp repeats, pale blue. Chromosome-specific centromere features include a large mitochondrial DNA insertion (orange; CEN2), and a novel array of tandem repeats (purple; CEN4). Gaps in the physical maps (ll), unannotated regions (hatched boxes), and expressed genes (filled circles) are shown.

Figure 9:
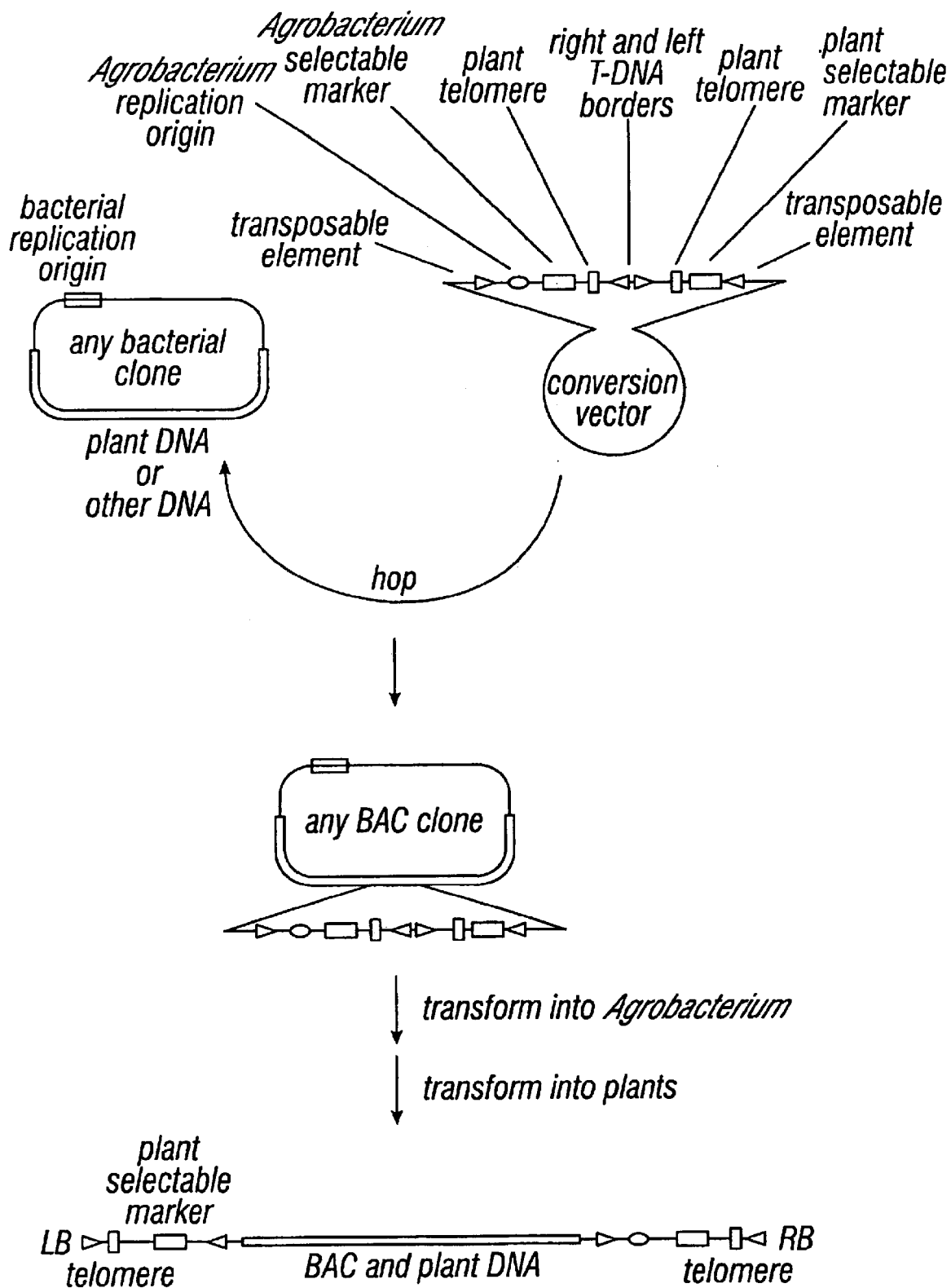

FIG. 9. Method for converting a BAC clone (or any other bacterial clone) into a minichromosome. A portion of the conversion vector will integrate into the BAC clone (or other bacterial clone of interest) either through non-homologous recombination (transposable element mediated) or by the action of a site specific recombinase system, such as Cre-Lox or FLP-FRT.

Figure 10:
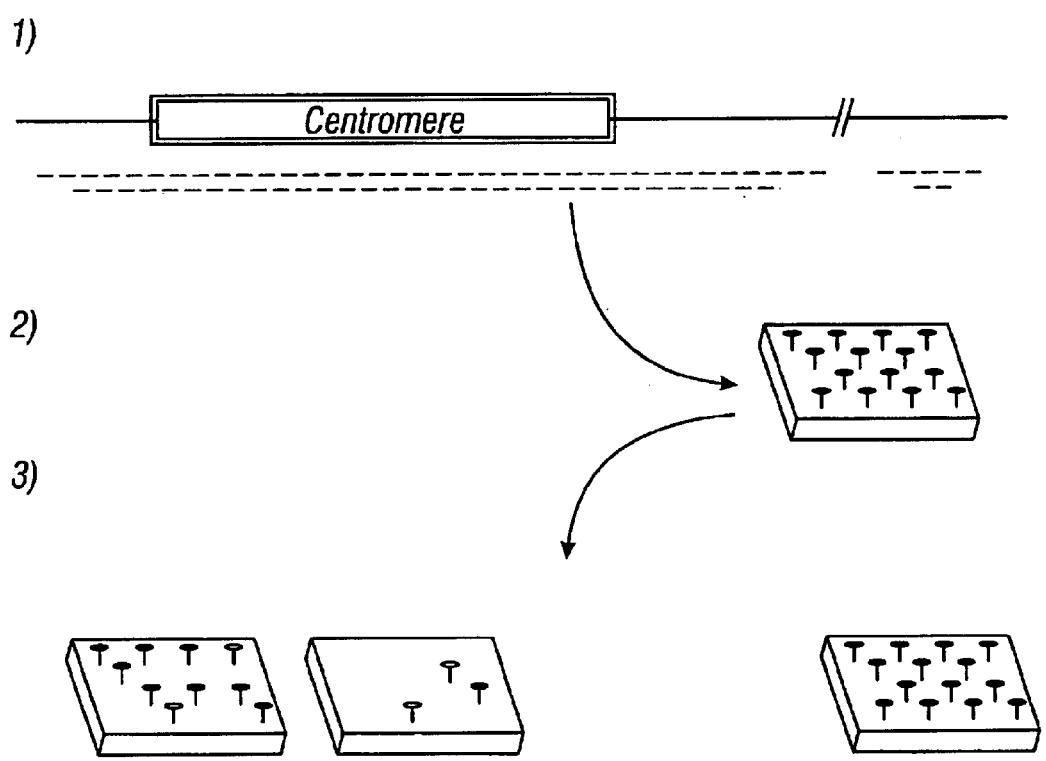

FIG. 10. Method for analysis of dicentric chromosomes in *Arabidopsis*. BiBAC vectors containing centromere fragments (~100 kb) are integrated into the *Arabidopsis* genome using *Agrobacterium*-mediated transformation procedures and studied for adverse affects due to formation of dicentric chromosomes. 1) BiBACs containing centromere fragments are identified using standard protocols. 2) Plant transformation. 3) Analysis of defects in growth and development of plants containing dicentric chromosomes.

FIGS. 11A–G. Method for converting a BAC clone (or any other bacterial clone) into a minichromosome. The necessary selectable markers and origins of replication for propagation of genetic material in *E. coli, Agrobacterium* and *Arabidopsis* as well as the necessary genetic loci for *Agrobacterium* mediated transformation into *Arabidopsis* are cloned into a conversion vector. Using Cre/loxP recombination, the conversion vectors are recombined into BACs containing centromere fragments to form minichromosomes.

FIGS. 12A–T. Properties of centromeric regions on chromosomes II and IV. (Top) Drawing of genetically-defined centromeres (gray shading, CEN2, left; CEN4, right), adjacent pericentromeric DNA, and a distal segment of each chromosome, scaled in Mb as determined by DNA sequencing (gaps in the grey shading correspond to gaps in the physical maps). Positions in cM on the RI map (nasc.nott.ac.uk/new_ri_map.html) and physical distances in Mb, beginning at the northern telomere and at the centromeric gap, are shown. (Bottom) The density of each feature (FIGS. 12A–12T) is plotted relative to the position on the chromosome in Mb. (FIGS. 12A, 12K) cM positions for markers on the RI map (solid squares) and a curve representing the genomic average of 1 cM221 kb (dashed line). A single crossover within CEN4 in the RI mapping population (nasc.nott.ac.uk/new_ri_map.html; Somerville and Somerville, 1999) may reflect a difference between male meiotic recombination monitored here and recombination in female meiosis. (FIGS. 12B–12E and FIGS. 12L–12O) The % of DNA occupied by repetitive elements was calculated for a 100 kb window with a sliding interval of 10 kb. (FIGS. 12B, 12L) 180 bp repeats; (FIGS. 12C, 12M) sequences with similarity to retroelements, including del, Tal, Tall, copia, Athila, LINE, Ty3, TSCL, 106B (Athila-like), Tat1, LTRs and Cinful; (FIGS. 12D, 12N) sequences with similarity to transposons, including Tag1, En/Spm, AcDs, Tam1 MuDR, Limpet, MITES and Mariner; (FIGS. 12E, 12O) previously described centromeric repeats including 163A, 164A, 164B, 278A, 11B7RE, mi167, pAT27, 160-, 180- and 500-bp repeats, and telomeric sequences (Murata et al., 1997; Heslop-Harrison et al., 1999; Brandes et al., 1997; Franz et al., 1998; Wright et al., 1996; Konieczny et al., 1991; Pelissier et al., 1995; Voytas and Ausubel, 1988; Chye et al., 1997; Tsay et al., 1993; Richards et al., 1991; Simoens et al., 1988; Thompson et al., 1996; Pelissier et al., 1996 Franz et al., 1998; Pelissier et al., 1995; Voytas and Ausubel, 1988; Thompson et al., 1996). (FIGS. 12F, 12P) % adenosine+ thymidine was calculated for a 50 kb window with a sliding interval of 25 kb (FIGS. 12G–12J, 12Q–12T). The number of predicted genes or pseudogenes was plotted over a window of 100 kb with a sliding interval of 10 kb. (FIGS. 12G, 12I, 12Q, 12S) predicted genes (FIGS. 12G, 12Q) and pseudogenes (FIGS. 12I, 12S) typically not found on mobile DNA elements; (FIGS. 12H, 12J, 12R, 12T) predicted genes (FIGS. 12H, 12R) and pseudogenes (FIGS. 12J, 12T) often carried on mobile DNA, including reverse transcriptase, transposase, and retroviral polyproteins. Dashed lines indicate regions in which sequencing or annotation is in progress, annotation was obtained from GenBak records (www.ncbi.nlm.nih.gov/Entrez/nucleotide.html), from the AGAD database (www.tigr.org/tdh/at/agad/.), and by BLAST comparisons to the database of repetitive *Arabidopsis* sequences (nucleus.cshl.org/protarab/AtRepBase.html); though updates to annotation records may change individual entries, the overall structure of the region will not be significantly altered.

Figures 13C, 13D:
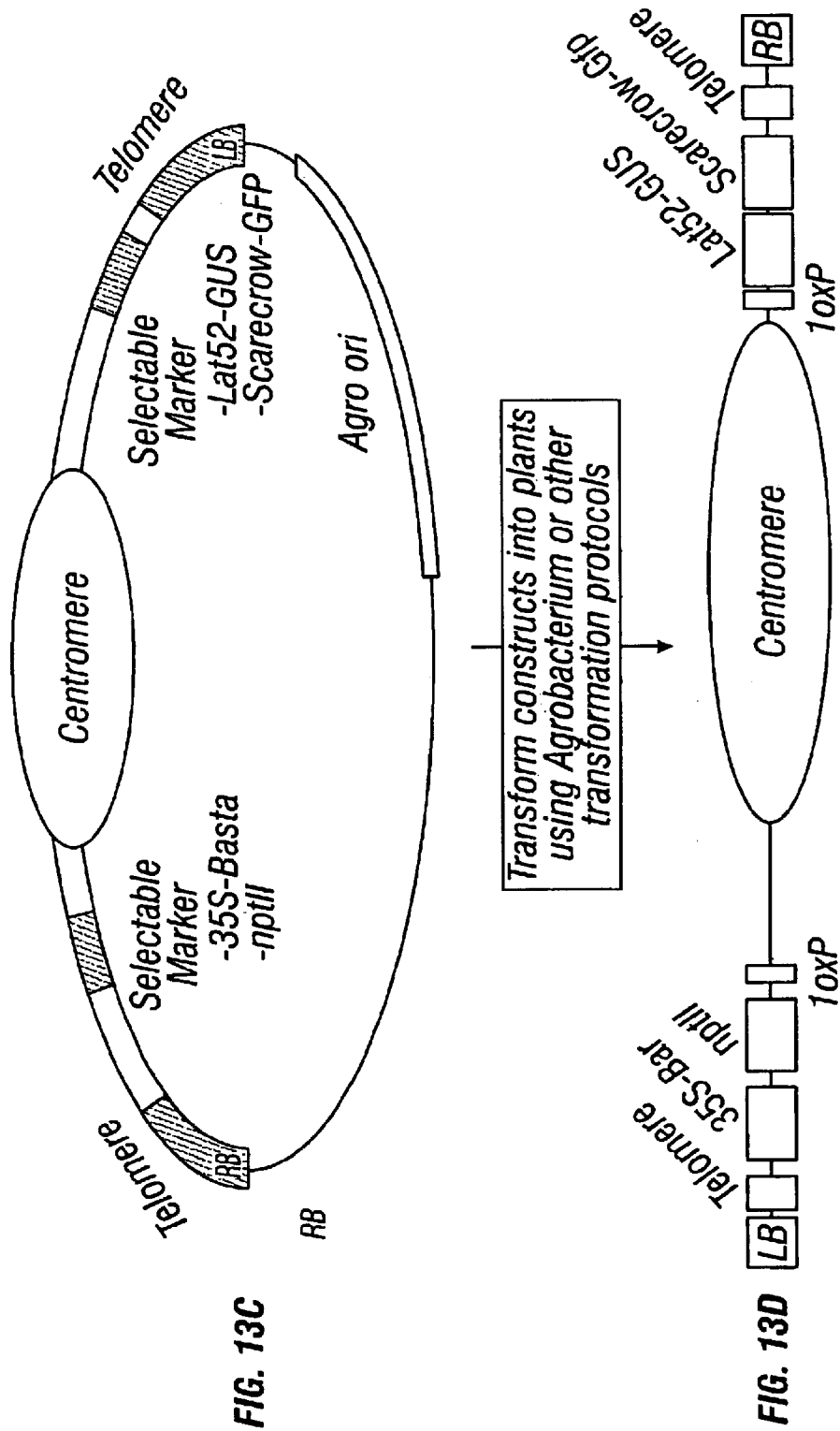

FIG. 13. Methods for converting a BAC clone containing centromere DNA into a minichromosome for introduction into plant cells. The specific elements described are provided for exemplary purposes and are not limiting. A) diagram of the BAC clone, noting the position of the centromere DNA (red), a site-specific recombination site (for example, lox P), and the F origin of replication. B) Conversion vector containing selectable and color markers (for example, 35S-Bar, nptII, LAT52-GUS, Scarecrow-GFP), telomeres, a site-specific recombination site (for example, lox P), antibiotic resistance markers (for example, amp or spc/str), *Agrobacterium* T-DNA borders (Agro Left and Right) and origin of replication (RiA4). C) The product of site specific recombination with the Cre recombinase at the lox P sites yields a circular product with centromeric DNA and markers flanked by telomeres. D) Minichromosome immediately after transformation into plants; subsequently, the left and right borders will likely be removed by the plant cell and additional telomeric sequence added by the plant telomerase.

FIGS. 14A–B. Conservation of centromere DNA. BAC clones (bars) used to sequence CEN2 (FIG. 14A) and CEN4 (FIG. 14B) are indicated; arrows denote the boundaries of the genetically-defined centromeres. PCR primer pairs yielding products from only Columbia (filled circles) or from both Landsberg and Columbia (open circles); BACs encoding DNA with homology to the mitochondrial genome (gray bars); 180 bp repeats (gray boxes); unsequenced DNA (dashed lines); and gaps n the physical map (double slashes) are shown.

FIGS. 15A–B. Primers used to analyze conservation of centromere sequences in the *A. thaliana* Columbia and Landsberg ecotypes. FIG. 15A: Primers used for amplification of chromosome 2 sequences. FIG. 15B: Primers used for amplification of chromosome 4 sequences.

Figure 16:
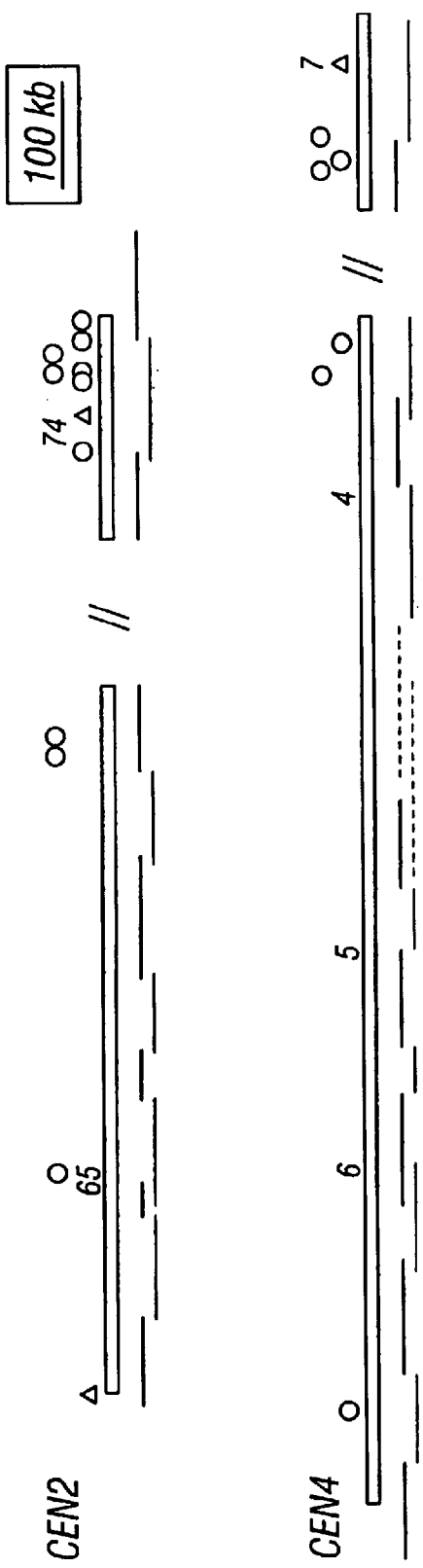

FIG. 16. Sequences common to CEN2 and CEN4. Genetically-defined centromeres (bold lines), sequenced (thin lines), and unannotated (dashed lines) BAC clones are displayed as in FIGS. 14A, B. Repeats AtCCS1 (*A. thaliana* centromere conserved sequence) and AtCCS2 (closed and open circles, respectively), AtCCS3 (triangles), and AtCCS4–7 (4–7, respectively) are indicated (GenBank Accession numbers AF204874 to AF204880), and were identified using BLAST 2.0 (blast.wustl.edu).

Figure 17A:
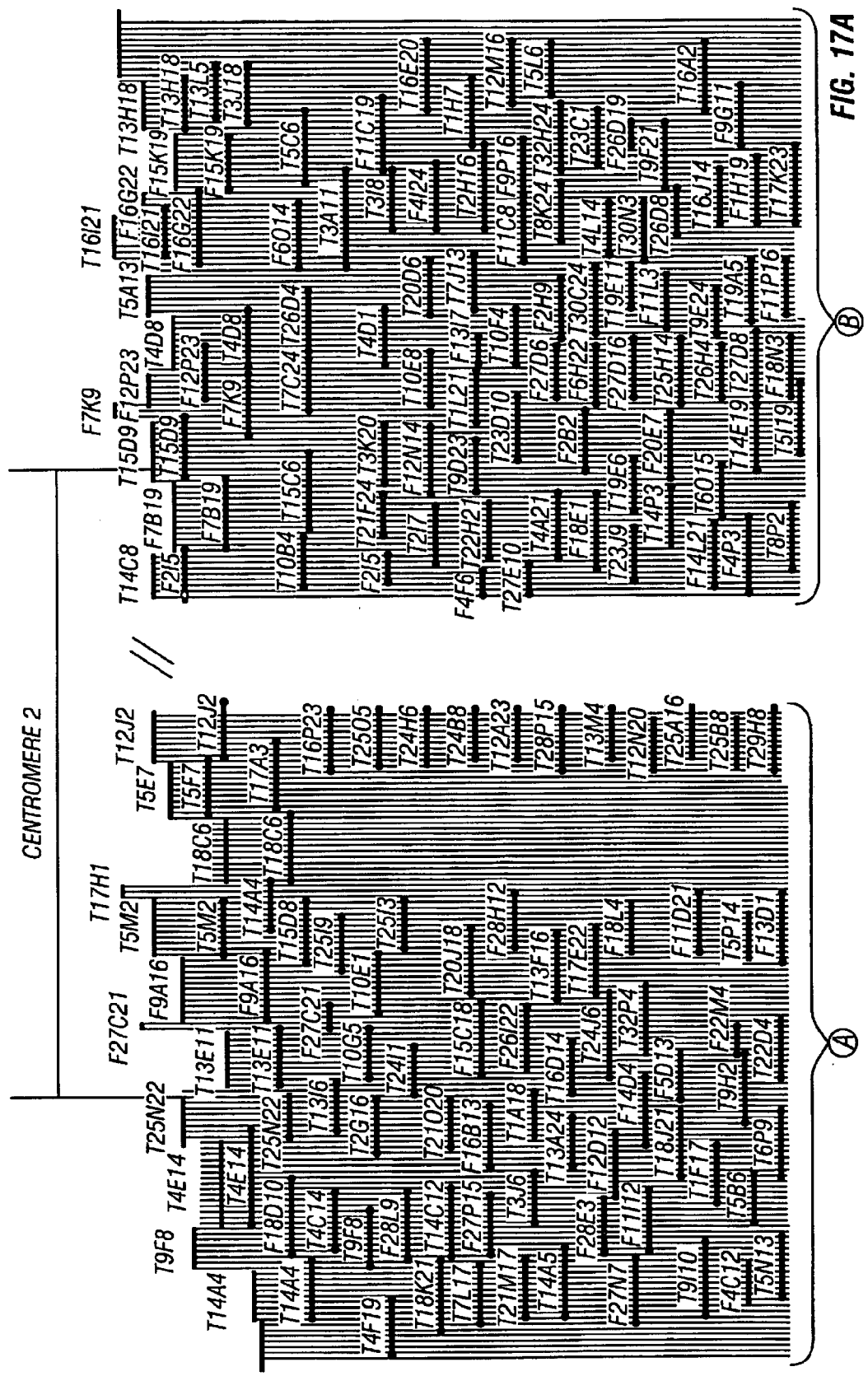
Figure 17B:
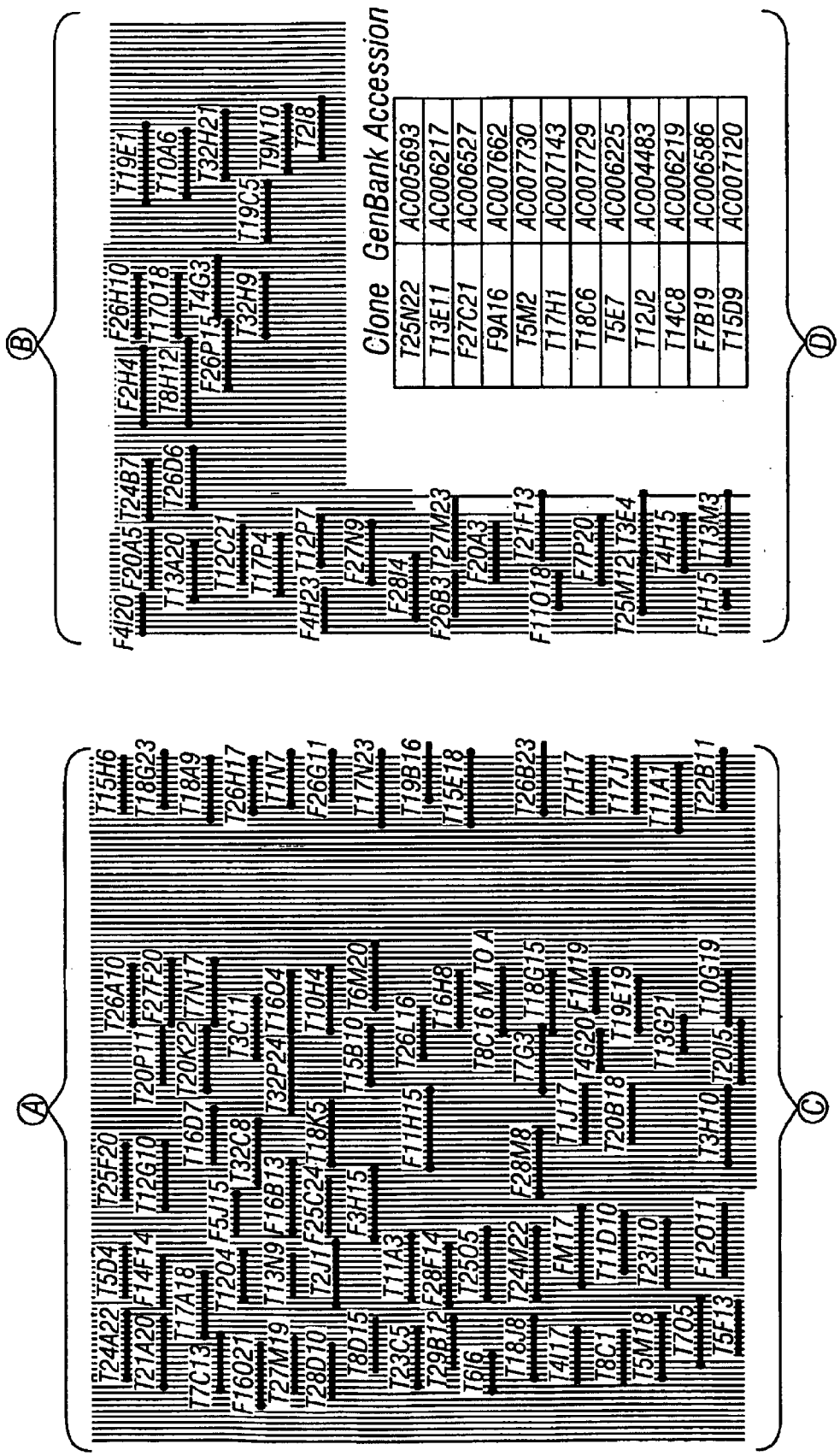
Figure 17C:
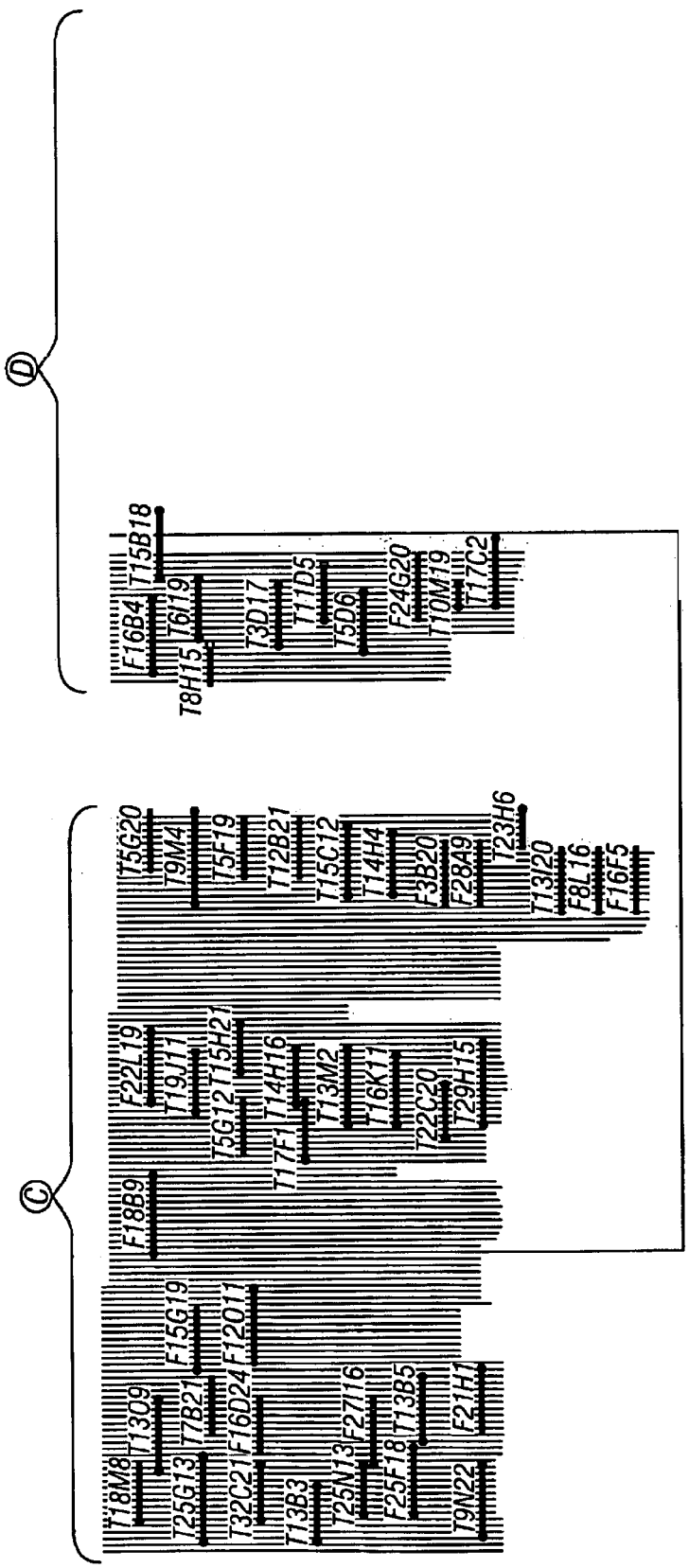

FIG. 17. Sequenced BAC clones from centromere 2. The sequenced BAC clones are indicated by the horizontal lines near the top of the figure (see for example T14A4). The red box denotes the boundaries of centromere 2, and for the BAC clones that comprise the centromere, GenBank Accession numbers are given in the lower right panel. The contiguous sequences within the red box are given by SEQ ID NO:209 and SEQ ID NO:210. Horizontal lines below the sequence clones indicate additional BAC clones; sequenced end points of these BACs are indicated with a closed circle. Clones with one or more endpoints that are undetermined are indicated by red text.

Figure 18A:
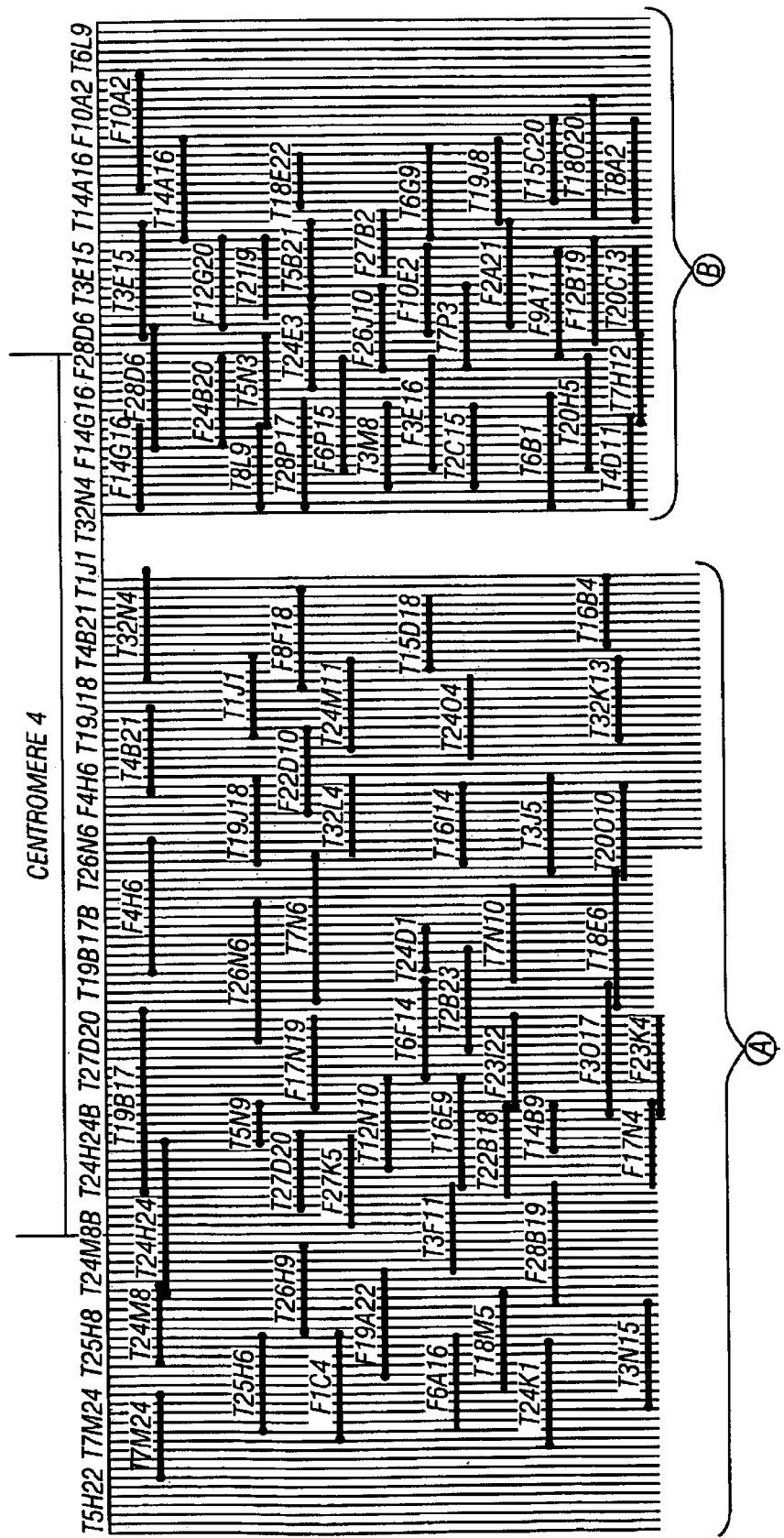
Figure 18B:
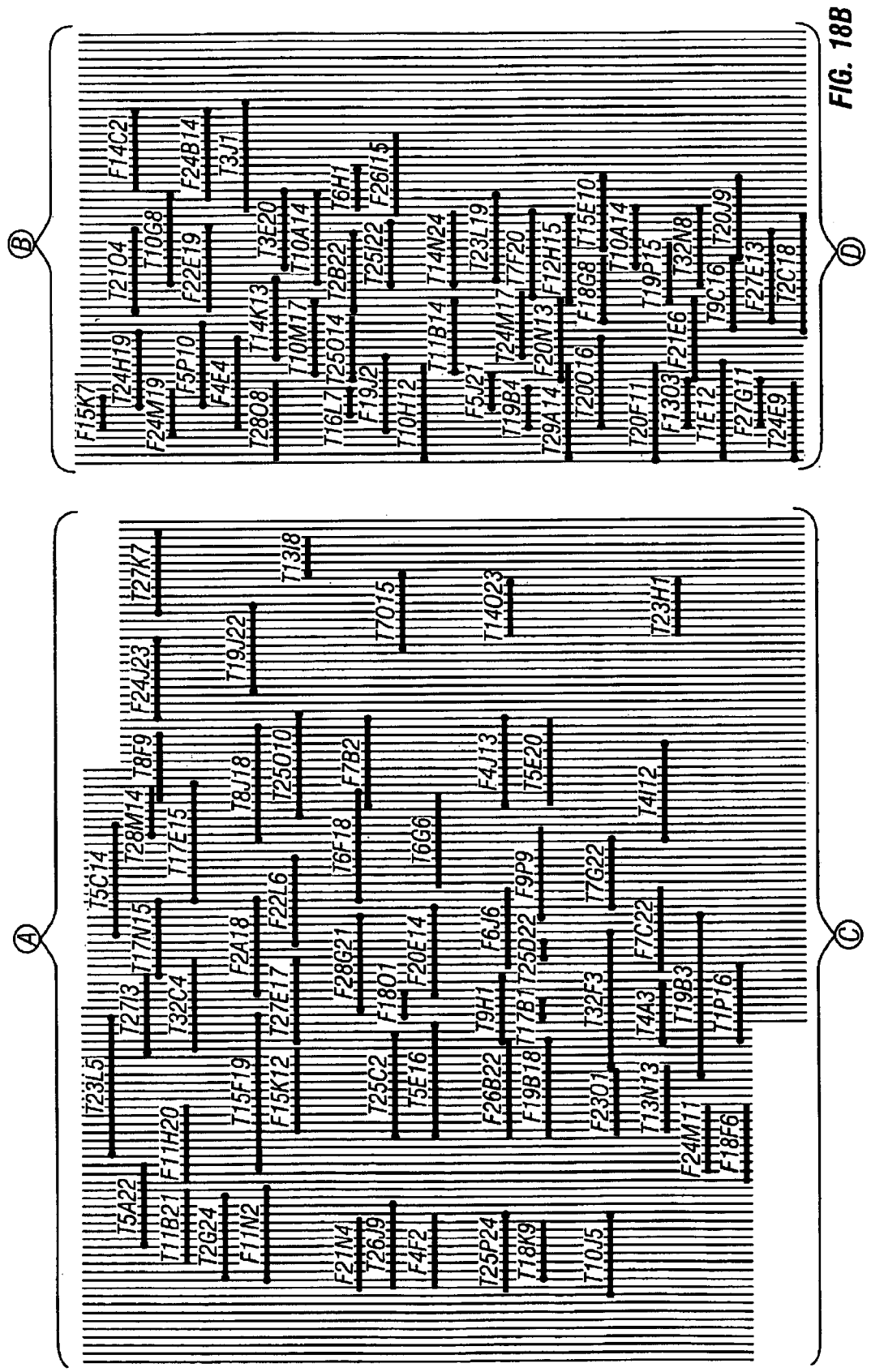
Figure 18C:
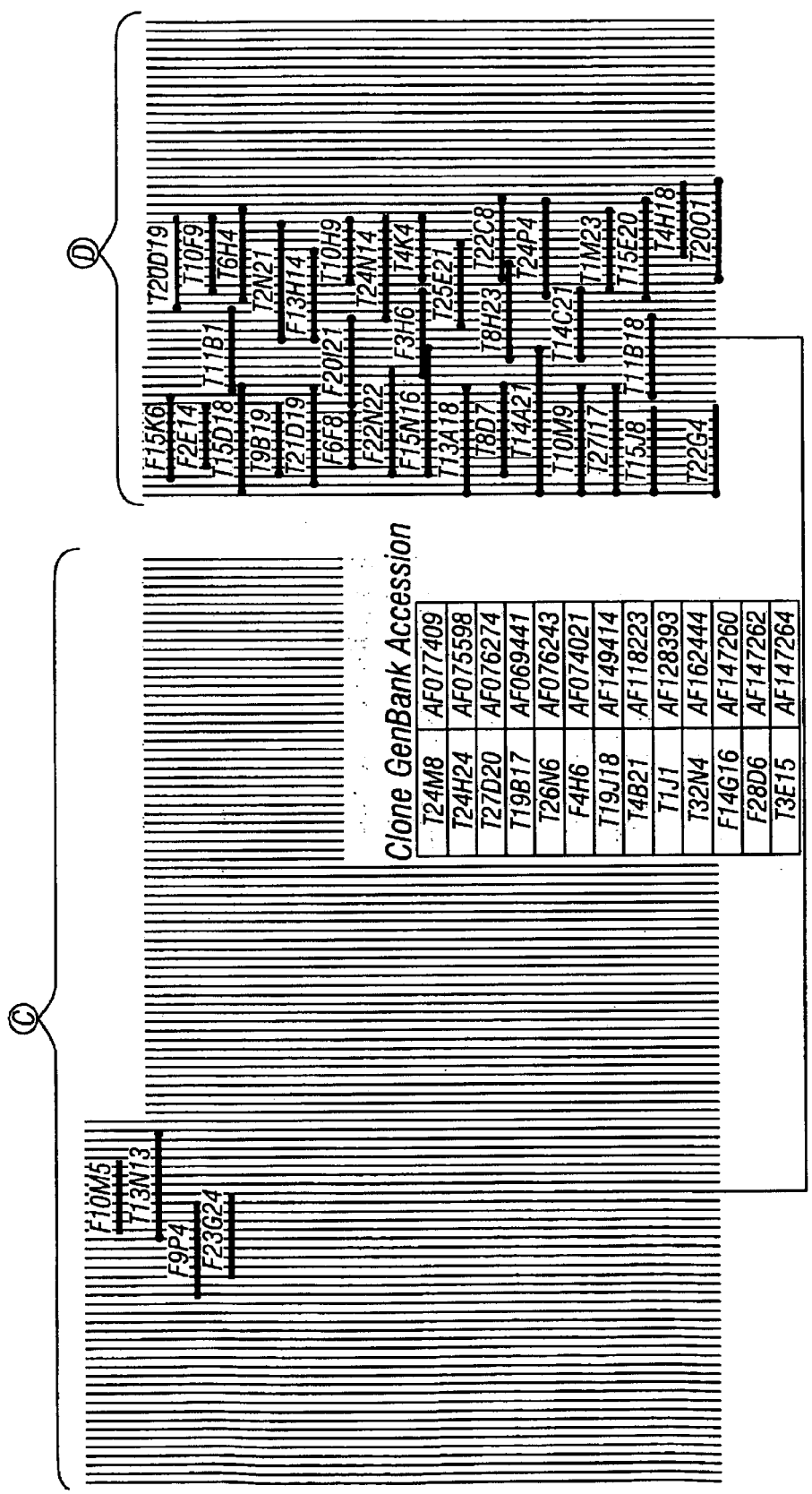

FIG. 18 Sequenced BAC clones from centromere 4. The sequenced BAC clones from centromere 4 are indicated by the horizontal lines near the top of the figure (see for example T24M8). The red box denotes the boundaries of centromere 4, and for the BAC clones that comprise the centromere, GenBank Accession numbers are given in the lower right panel. The contiguous sequences within the red box are given by SEQ ID NO:211 and SEQ ID NO:212. Horizontal lines below the sequenced clones indicate additional BAC clones; sequences end points of these BACs are indicated with a closed circle. Clones with one or more endpoints that are undetermined are indicated by red text.

Figure 19:
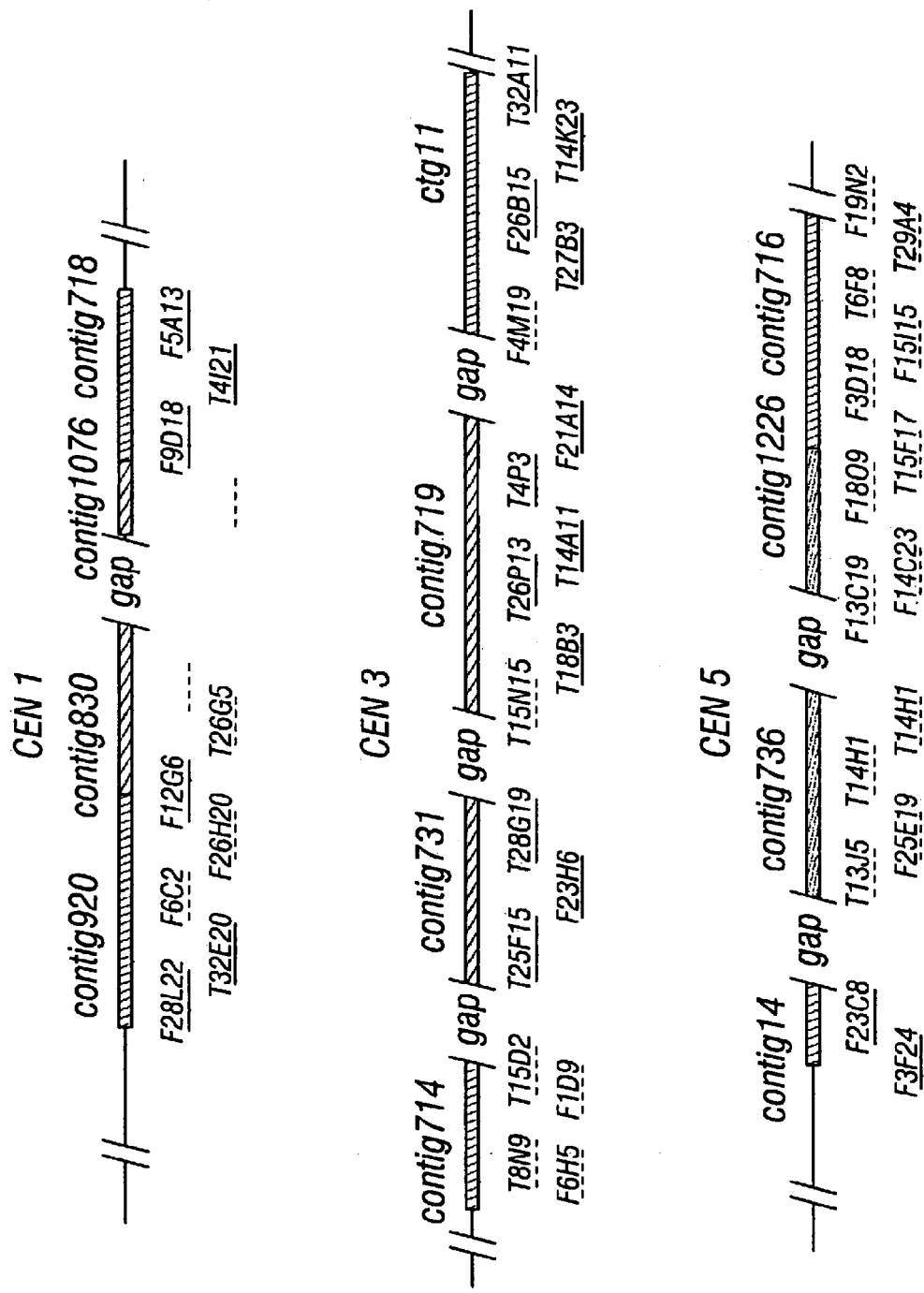

FIG. 19. Sequence tiling path of centromeres 1, 3, and 5. The boundaries of these centromeres was determined as described in Copenhaver et al (1999). Contig numbers refer to the fingerprint contigs assembled by Marra et al. (1999). Some of these clones have been sequenced and accession numbers are provided (see attached list). In other cases, sequencing will be finished by the *Arabidopsis* genome project.

Figure 20:
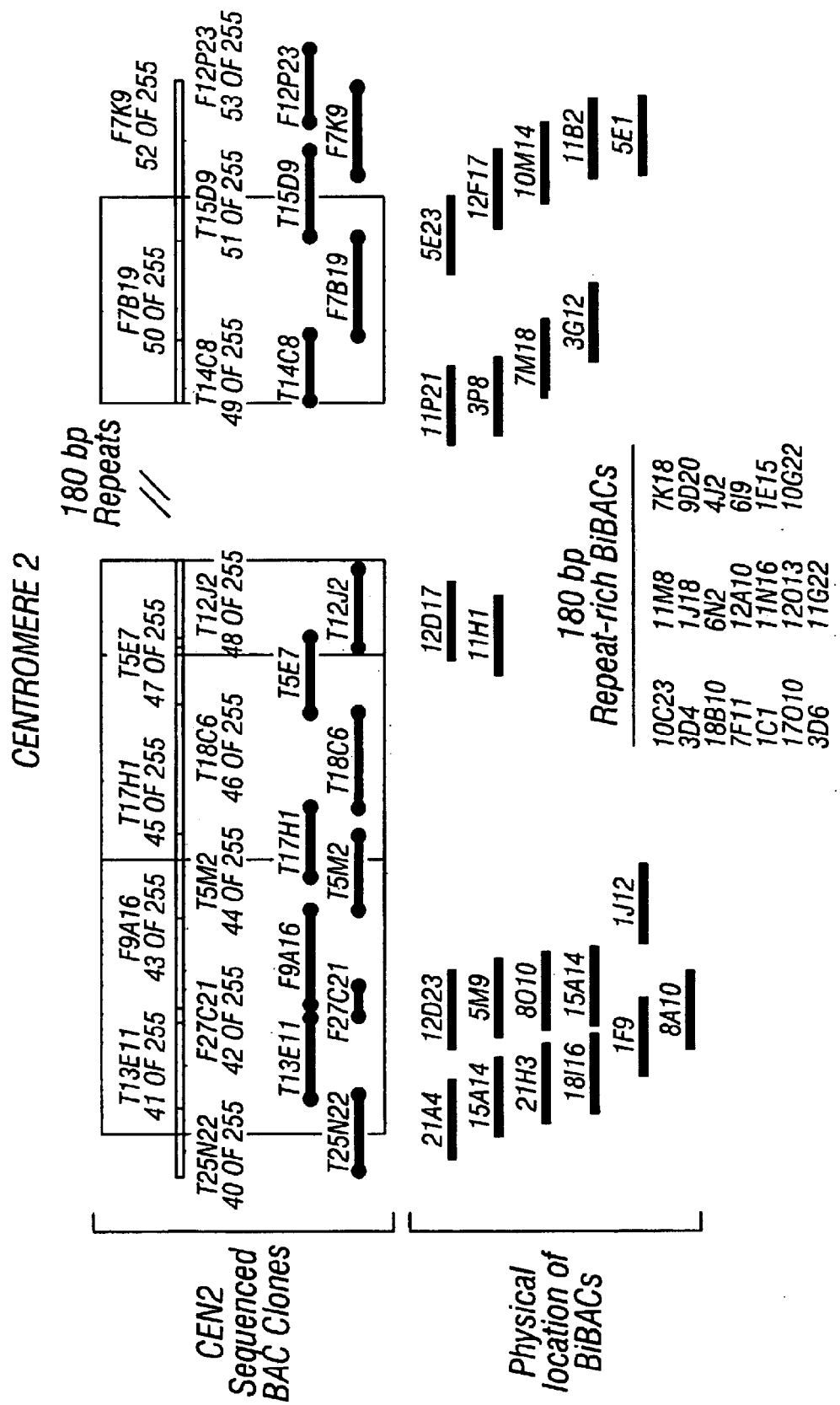

FIG. 20. Position of DNA from centromere 2 carried in BiBAC vectors. Clones were placed on the physical map by fingerprint and PCR analysis and comparison with the sequenced BAC clones.

Figure 21:
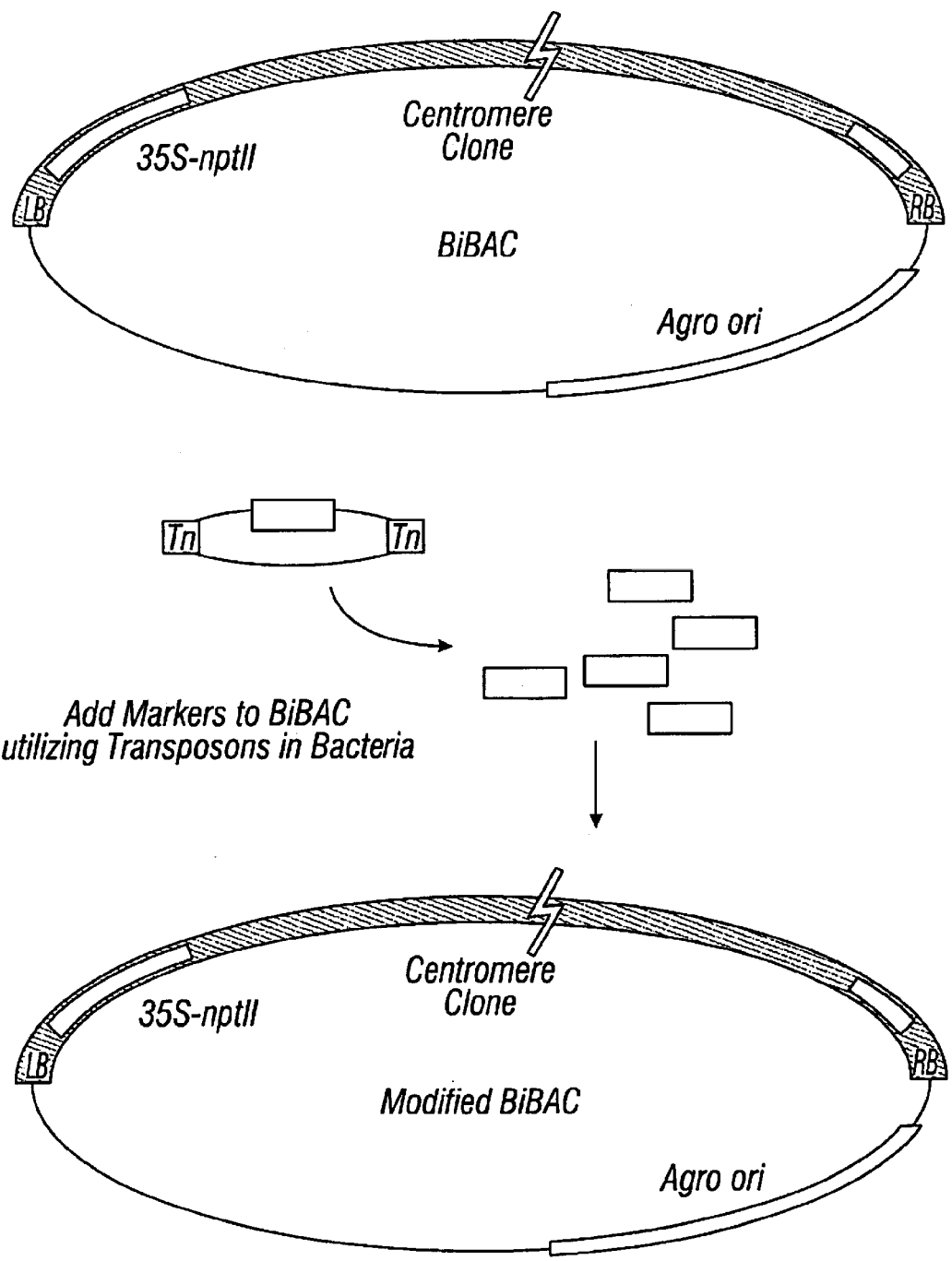

FIG. 21. Exemplary methods for adding selectable or screenable markers to BiBAC clones. The desired marker is flanked by transposon borders, and incubated with the BiBAC in the presence of transposase. Subsequently, the BiBAC is introduced into plants. Often these BiBACs may integrate into natural chromosome, creating a dicentric chromosome which may have altered stability and may cause chromosome breakage, resulting in novel chromosome fragments.

Figure 22:
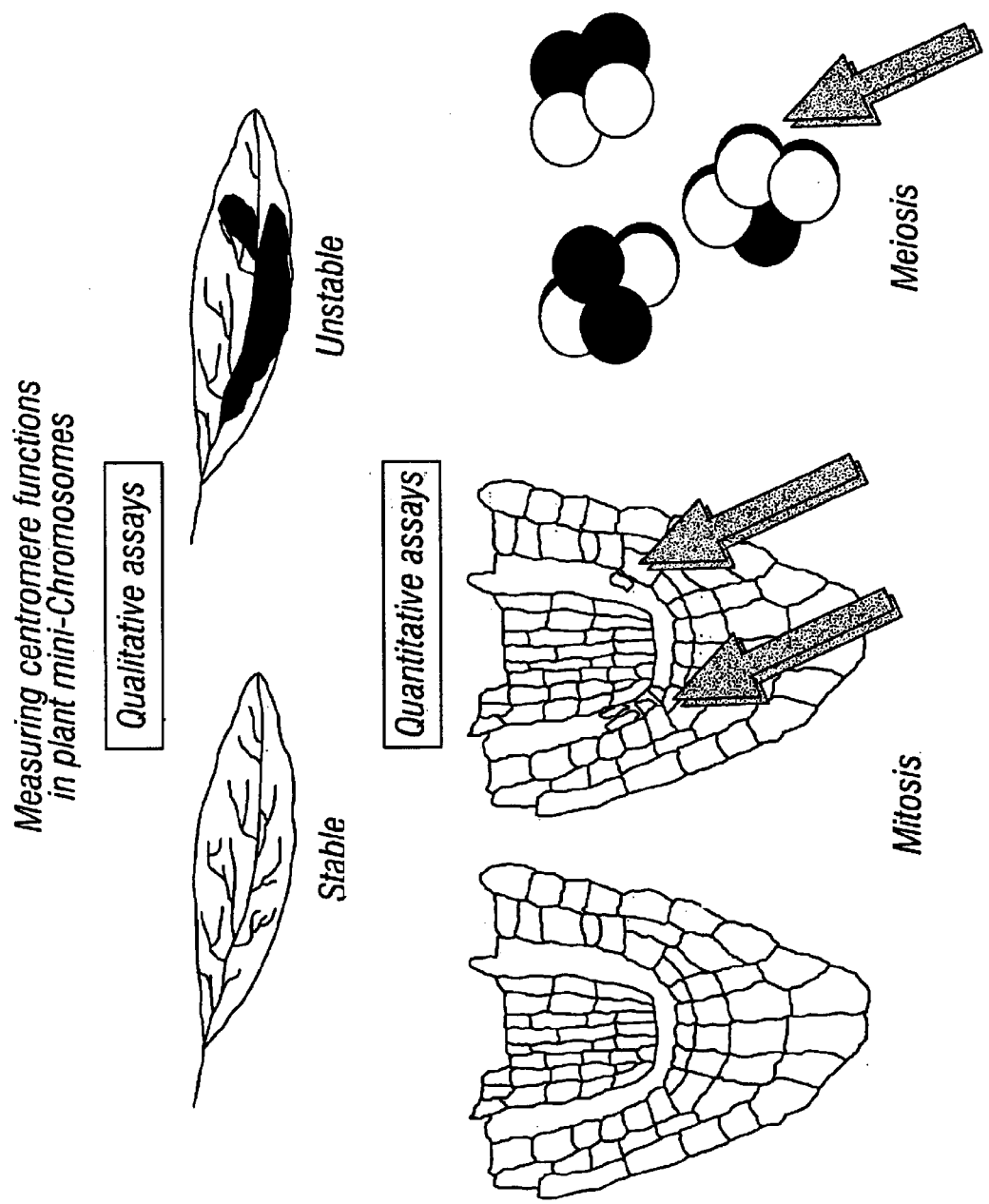

FIG. 22. Assay of chromosome stability. The stability of natural chromosomes, constructed minichromosome, or dicentric chromosomes can be assessed by monitoring the assortment of color markers through cell division. The markers are linked to the centromere in modified BAC or BiBAC vectors and introduced into plants. Regulation of the marker gene by an appropriate promoter determines which tissues will be assayed. For example, root-specific promoters, such as SCARECROW make it possible to monitor assortment in files of root cells; post-meiotic pollen-specific promoters such as LAT52 allow monitoring of assortment through meiosis, and general promoters such as the 35S Cauliflower mosaic virus promoter make it possible to monitor assortment in many other plant tissues. Qualitative assays assess the general pattern of stability and measure the size of sectors corresponding to marker loss, while quantitative assays require knowledge of cell lineage and allow the number of chromosome loss events to be calculated during mitosis and meiosis.

Figures 2A, 23A:
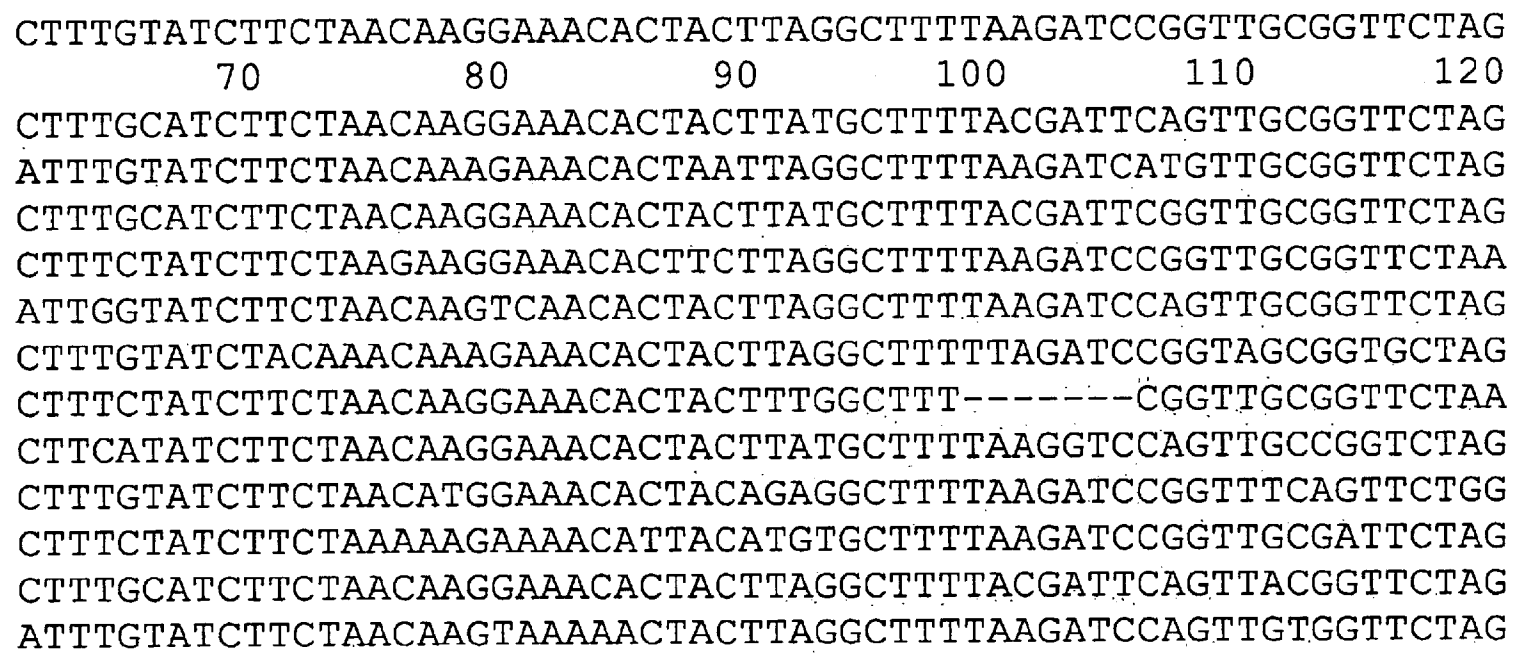
Figures 1E, 23D:
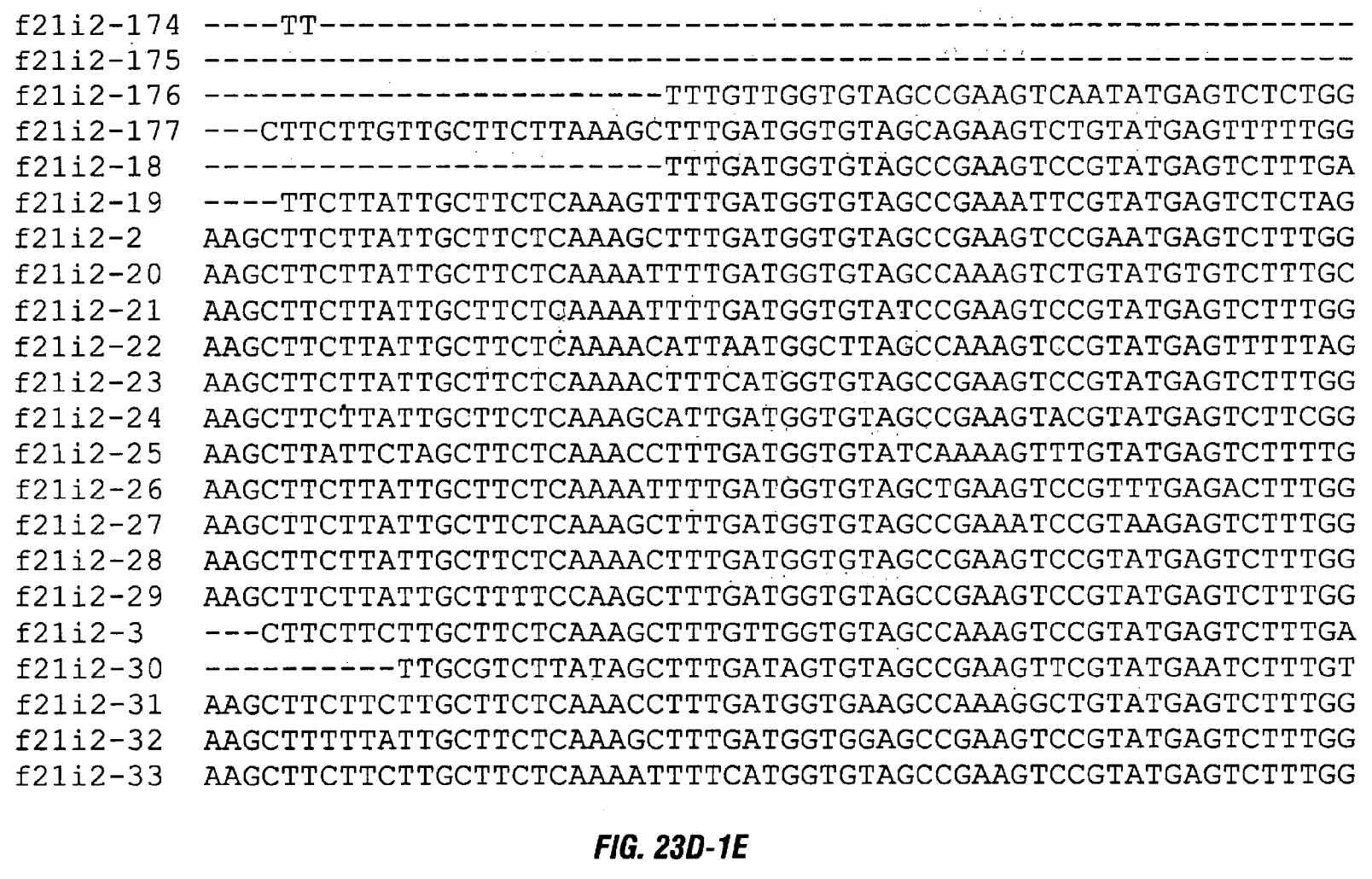
Figures 2E, 23D:
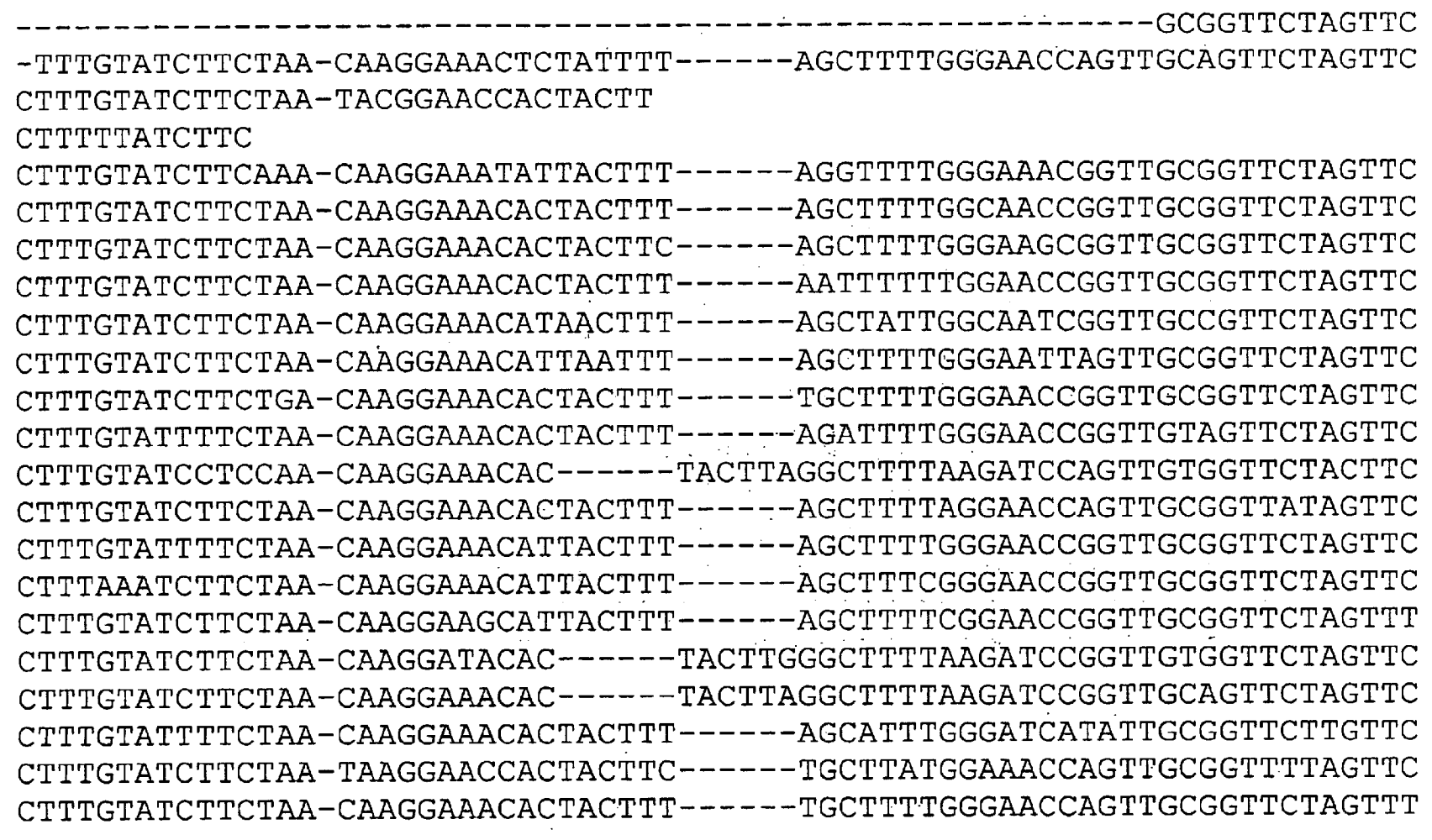
Figures 2K, 23D:
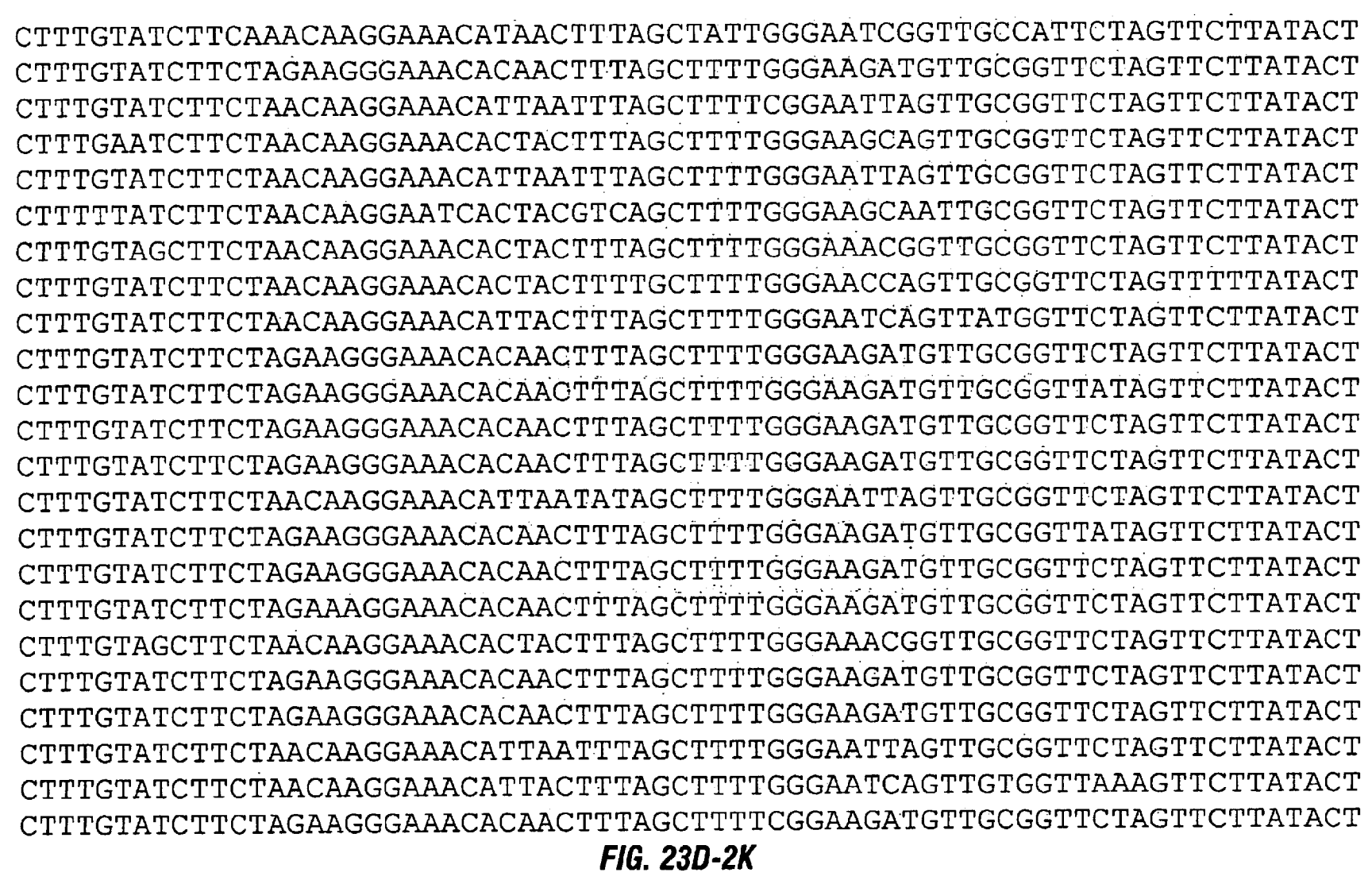
Figure 23D-20:
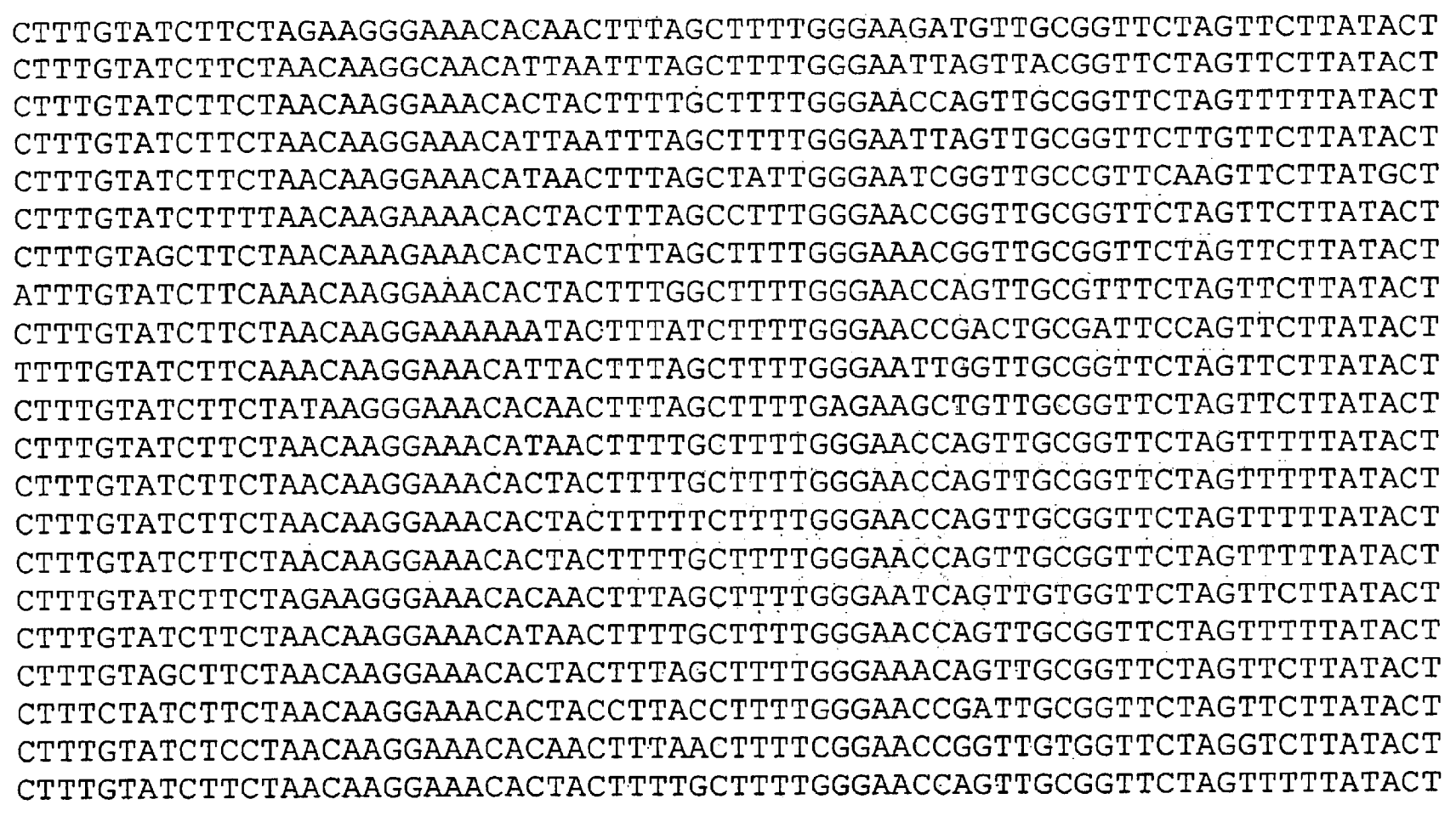

FIGS. 23A–D. Sequence alignments for 180 bp repeats from centromeres 1–4. The left hand column indicates the BAC source of the repeat copy and an arbitrarily assigned number given to the sequence. For example, the designation f12g6-1 indicates a repeat copy from BAC number f12g6 and arbitrarily given a repeat number of 1. the nucleic acid sequences of the BACs containing the repeat copies, designated f12g6, f5a13, t25f15, t12j2, t14c8, t6c20, f21i2, and f6h8 are given by SEQ ID NO:184, SEQ ID NO:191, SEQ ID NO:189, SEQ ID NO:205, SEQ ID NO:206, SEQ ID NO:186, SEQ ID NO:208 AND SEQ ID NO:207, respectively. FIG. 23A. Alignment of 180 bp repeats from centromere 1. FIG. 23B. Alignment of 180 bp repeats from centromere 2. FIG. 23C. Alignment of 180 bp repeats from centromere 3. FIG. 23D. Alignment of 180 bp repeats from centromere 4.

DETAILED DESCRIPTION OF THE INVENTION

The inventors have overcome the deficiencies in the prior art by providing, for the first time, the nucleic acid sequence of a plant chromosome. The significance of this achievement relative to the prior art is exemplified by the general lack of detailed information in the art regarding the centromeres of multicellular organisms in general. To date, the most extensive and reliable characterization of centromere sequences has come from studies of lower eukaryotes such as *S. cerevisiae* and *S. pombe*, where the ability to analyze centromere functions has provided a clear picture of the desired DNA sequences. The *S. cerevisiae* centromere consists of three essential regions, CDEI, CEDII, and CEDIII, totaling only 125 bp, or approximately 0.006 to 0.06% of each yeast chromosome (Carbon et al., 1990; Bloom 1993). *S. pombe* centromeres are between 40 and 100 kB in length and consist of repetitive elements that comprise 1 to 3% of each chromosome (Baum et al., 1994). Subsequent studies using tetrad analysis to follow the segregation of artificial chromosomes, demonstrated that less than ⅕ of the naturally occurring *S. pombe* centromere is sufficient for centromere function (Baum et al., 1994).

Figure 2:
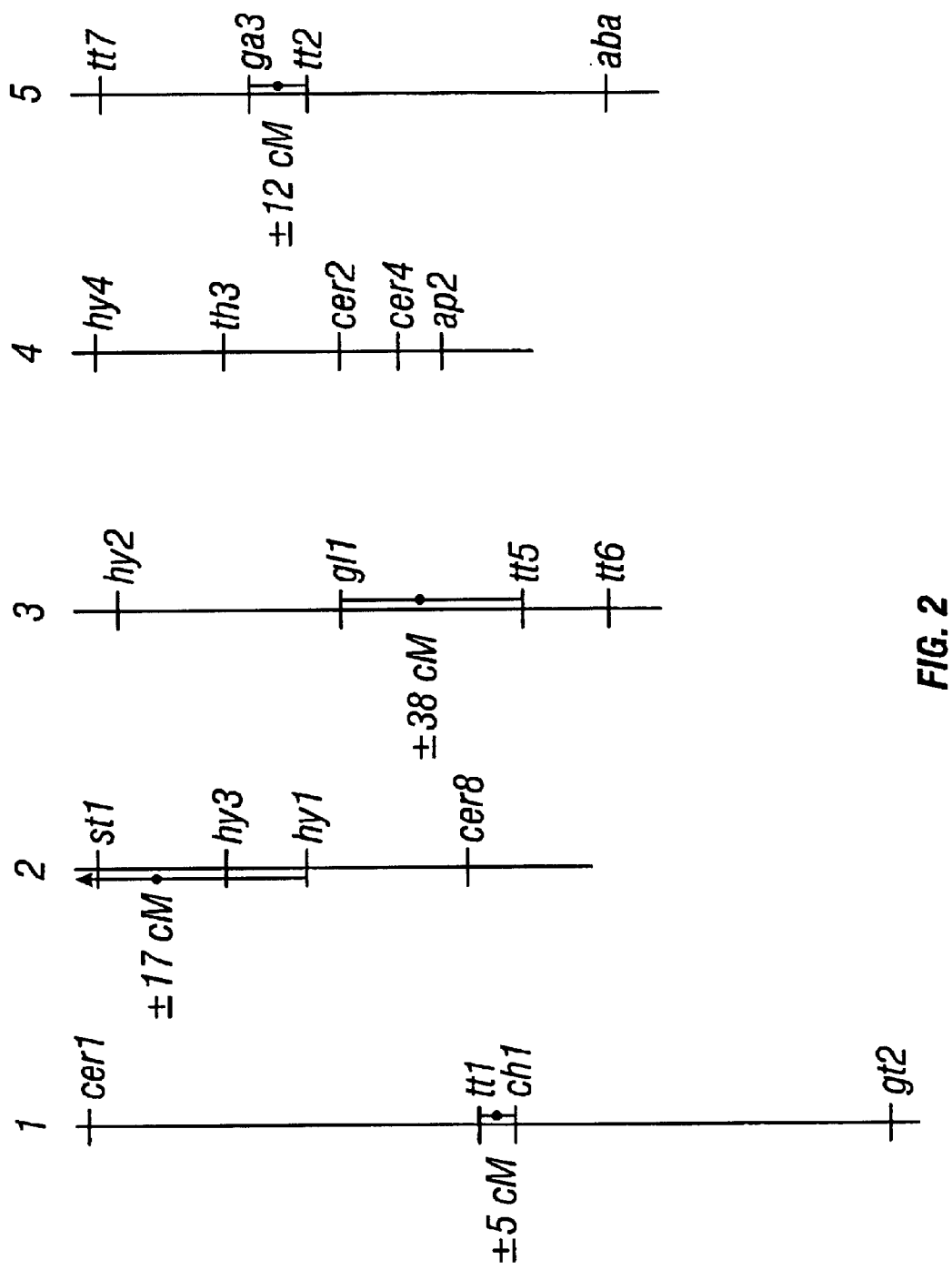
FIG. 2 Low resolution map location of *Arabidopsis* centromere. Trisomic mapping was used to determine the map position of centromeres on four of the five *Arabidopsis* chromosomes (Koomneef, 1983, Sears et al., 1970). For chromosome 4, useful trisomic strains were not obtained. With the methods of Kormneef and Sears et al., 1983, (which rely on low-resolution deletion mapping) the centromere on chromosome 1 was found to lie between the two visible markers, ttl and chl, that are separated by 5 cM. Centromere positions on the other chromosomes are mapped to a lower resolution.

In contrast, the centromeres of mammals and other higher eukaryotes are poorly defined. Although DNA fragments that hybridize to centromeric regions in higher eukaryotes have been identified, little is known regarding the functionality of these sequences (see Tyler-Smith et al., 1993). In many cases centromere repeats correlate with centromere location, with probes to the repeats mapping both cytologically and genetically to centromere regions. Many of these sequences are tandemly-repeated satellite elements and dispersed repeated sequences in arrays ranging from 300 kB to 5000 kB in length (Willard 1990). To date, only one of these repeats, a 171 bp element known as the alphoid satellite, has been shown in by situ hybridization to be present at each human centromere (Tyler-Smith et al., 1993). Whether repeats themselves represent functional centromeres remains controversial, as other genomic DNA is required to confer inheritance upon a region of DNA (Willard, 1997). Alternatively, the positions of some higher eukaryotic centromeres have been estimated by analyzing the segregation of chromosome fragments. This approach is imprecise, however, because a limited set of fragments can be obtained, and because normal centromere function is influenced by surrounding chromosomal sequences (for example, see Koomneef, 1983; FIG. 2).

A more precise method for mapping centromeres that can be used in intact chromosomes is tetrad analysis (Mortimer et al., 1981), which provides a functional definition of a centromere in its native chromosomal context. At present, the only centromeres that have been mapped in this manner are from lower eukaryotes, including the yeast *Saccharomyces cerevisiae*, *Schizosaccharomyces pombe*, and *Kluyveromyces lactis* (Carbon et al., 1990; Hegemann et al., 1993). In these systems, accurate mapping of the centromeres made it possible to clone centromeric DNA, using a chromosome walking strategy (Clarke et al., 1980). Subsequently, artificial chromosome assays were used to define more precisely the centromere sequences (Hegemann et al., 1993; Baum et al., 1994).

Attempts to develop a reliable centromeric assay in mammals have yielded ambiguous results. For example, Hadlaczky et al., (1991) identified a 14 kB human fragment that can, at low frequency, result in de novo centromere formation in a mouse cell line. In situ hybridization studies, however, have shown that this fragment is absent from naturally occurring centromeres, calling into question the reliability of this approach for testing centromere function (Tyler-Smith et al., 1993). Similarly, transfection of alphoid satellites into cell lines results in the formation of new chromosomes, yet these chromosomes also contain host sequences that could contribute centromere activity (Haaf et al., 1992; Willard, 1997). Further, the novel chromosomes can have alphoid DNA spread throughout their length yet have only a single centromeric constriction, indicating that a block of alphoid DNA alone may be insufficient for centromere function (Tyler-Smith et al., 1993).

Although plant centromeres can be visualized easily in condensed chromosomes, they have not been characterized as extensively as centromeres from yeast or mammals. Genetic characterization has relied on segregation analysis of chromosome fragments, and in particular on analysis of trisomic strains that carry a genetically marked, telocentric fragment (for example, see Kormneef 1983; FIG. 2). In addition, repetitive elements have been identified that are either genetically (Richards et al., 1991) or physically (Alfenito et al., 1993; Maluszynska et al., 1991) linked to a centromere. In no case, however, has the functional significance of these sequences been tested.

Cytology in *Arabidopsis thaliana* has served to correlate centromere structure with repeat sequences. A fluorescent dye, DAPI, allows visualization of centromeric chromatin domains in metaphase chromosomes. A fluorescence in situ hybridization (FISH) probe based on 180 bp pAL1 repeat sequences colocalized with the DAPI signature near the centromeres of all five *Arabidopsis* chromosomes (Maluszynska et al., 1991; Martinez-Zapater et al., 1986). Although a functional role for pAL1 has been proposed, more recent studies have failed to detect this sequence near the centromeres in species closely related to *Arabidopsis thaliana* (Maluszynska et al., 1993). These results are particularly troubling because one of the species tested, *A. pumila*, is thought to be an amphidiploid, derived from a cross between *A. thaliana* and another close relative (Maluszynska et al., 1991; Price et al., 1995). Another repetitive sequence, pAtT12, has been genetically mapped to within 5 cM of the centromere on chromosome 1 and to the central region of chromosome 5 (Richards et al., 1991), although its presence on other chromosomes has not been established. Like pAL1, a role for pAtT12 in centromere function remains to be demonstrated.

Due to the fact that kinetochores constitute a necessary link between centromeric DNA and the spindle apparatus, the proteins that are associated with these structures recently have been the focus of intense investigation (Bloom 1993; Earnshaw 1991). Human autoantibodies that bind specifically in the vicinity of the centromere have facilitated the cloning of centromere-associated proteins (CENPs, Rattner 1991), and at least one of these proteins belongs to the kinesin superfamily of microtuble-based motors (Yen 1991). Yeast centromere-binding proteins also have been identified, both through genetic and biochemical studies (Bloom 1993; Lechner et al., 1991).

The centromeres of *Arabidopsis thaliana* have been mapped using trisomic strains, where the segregation of chromosome fragments (Kormneef 1983) or whole chromosomes (Sears et al., 1970) was used to localize four of the centromeres to within 5, 12, 17 and 38 cM, respectively (FIG. 2). These positions have not been refined by more recent studies because the method is limited the difficulty of obtaining viable trisomic strains (Koomneef 1983). These factors introduce significant error into the calculated position of the centromere, and in *Arabidopsis*, where 1 cM corresponds roughly to 200 kB (Koomneef 1987; Hwang et al., 1991), this method did not map any of the centromeres with sufficient precision to make chromosome walking strategies practical. Mapping of the *Arabidopsis* genome was also discussed by (Hauge et al., 1991).

I. Tetrad Analysis

Figure 1:
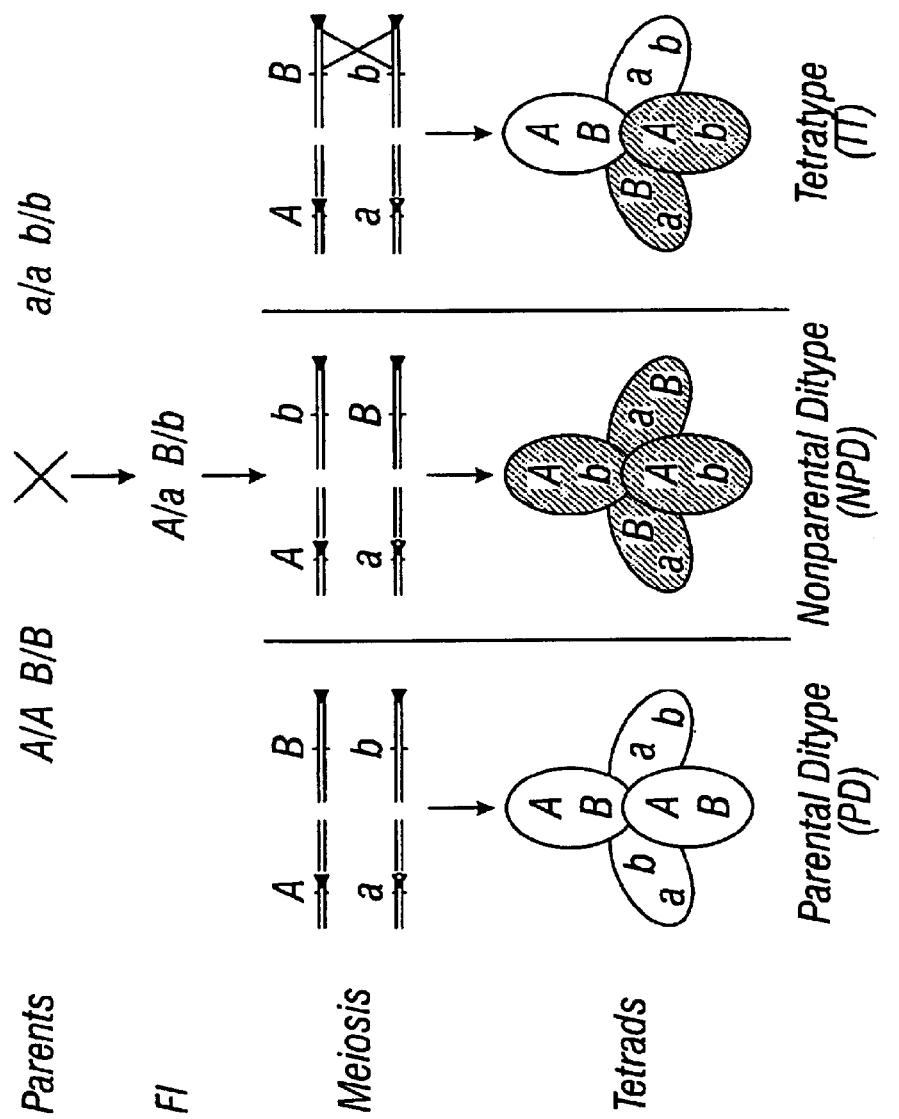
FIG. 1 Centromere mapping with unordered tetrads: A cross of two parents (AABB×aabb), in which "A" is on the centromere of one chromosome, and "B" is linked to the centromere of a second chromosome. At meiosis, the A and B chromosomes assort independently, resulting in equivalent numbers of parental ditype (PD) and nonparental ditype (NPD) tetrads (recombinant progeny are shown in gray). Tetratype tetrads (T) result only from a crossover between "B" and the centromere.

With tetrad analysis, the recombination frequency between genetic markers and a centromere can be measured directly (FIG. 1). This method requires analysis of all four products of individual meiosis, and it has not been applied previously to multicellular eukaryotes because their meiotic products typically are dissociated. Identification of the quartet mutation makes tetrad analysis possible for the first time in a higher eukaryotic system (Preuss et al., 1994). The quartet (qrt 1) mutation causes the four products of pollen mother cell meiosis in *Arabidopsis* to remain attached. When used to pollinate a flower, one tetrad can result in the formation of four seeds, and the plants from these seeds can be analyzed genetically.

With unordered tetrads, such as those produced by *S. cerevisiae* or *Arabidopsis*, genetic mapping using tetrad analysis requires that two markers be scored simultaneously (Whitehouse 1950). Tetrads fall into different classes depending on whether the markers are in a parental (nonrecombinant) or nonparental (recombinant) configuration (FIG. 1). A tetrad with only nonrecombinant members is referred to as a parental ditype (PD); one with only recombinant members as a nonparental ditype (NPD); and a tetrad with two recombinant and two nonrecombinant members are a tetratype (TT) (Perkins 1953). If two genetic loci are on different chromosomes, and thus assort independently, the frequency of tetratype (crossover products) versus parental or nonparental assortment ditype (noncrossover products) depends on the frequency of crossover between each of the two loci and their respective centromeres.

Tetratype tetrads arise only when a crossover has occurred between a marker in question and its centromere. Thus, to identify genes that are closely linked to the centromere, markers are examined in a pair-wise fashion until the TT frequency approaches zero. The genetic distance (in centimorgans, cM) between the markers and their respective centromeres is defined by the function $[(1/2)TT]/100$ (Mortimer et al., 1981). Because positional information obtained by tetrad analysis is a representation of physical distance between two points, as one approaches the centromere the chance of a recombination event declines.

Tetrad analysis has been used to genetically track centromeres in yeasts and other fungi in which products of a single meioses can be collected. The budding yeast *Saccharomyces cerevisiae* lacks mitotic condensation and thus cytogenetics (Hegemann et al., 1993), yet due to tetrad analysis, has served as the vehicle of discovery for centromere function. Meiosis is followed by the generation of four spores held within an ascus and these can be directly assayed for gene segregation.

The recessive qrt1 mutation makes it possible to perform tetrad analysis in *Arabidopsis* by causing the four products of meiosis to remain attached (Preuss et al., 1994; and Smythe 1994; both incorporated herein by reference). As previously shown, within each tetrad, genetic loci segregate in a 2:2 ratio (FIG. 6). Individual tetrads can be manipulated onto flowers with a fine brush (at a rate of 20 tetrads per hour), and in 30% of such crosses, four viable seeds can be obtained (Preuss et al., 1994).

Mapping centromeres with high precision requires a dense genetic map, and although the current *Arabidopsis* map contains many visible markers, it would be laborious to cross each into the qrt1 background. Alternatively, hundreds of DNA polymorphisms can be introduced simultaneously by crossing two different strains, both containing the qrt1 mutation.

A dense RFLP map (Chang et al., 1988) and PCR-based maps (Konieczny et al., 1993; Bell et al., 1994) have been generated in *Arabidopsis* from crosses of the Landsberg and Columbia strains (*Arabidopsis* map and genetic marker data is available from the internet at www.stanford.edu/Arabidospsi and chil.humgen.upenn.edu/atge/sslp_info/sslp.html).

Centromere mapping with tetrad analysis requires simultaneous analysis of two markers, one of which must be centromere-linked (FIG. 1). To identify these centromere-linked markers, markers distributed across all 5 chromosomes were scored and compared in a pairwise fashion.

Initially, genetic markers that can be scored by PCR analysis were tested (Konieczny et al., 1993; Bell et al., 1994). Such markers are now sufficiently dense to map any locus an as additional PCR-detectable polymorphisms are identified they are incorporated into the analyses. In addition, as described in FIG. 5, new CAPS and SSLP markers useful for mapping the centromere can be readily identified.

A collection of *Arabidopsis* tetrad sets was prepared by the inventors for use in tetrad analysis. To data, progeny plants from $\leq 1,000$ isolated tetrad seed sets have been germinated and leaf tissue collected and stored from each of the tetrad progeny plants. The leaf tissue from individual plants was used to make DNA for PCR based marker analysis. The plants also were allowed to self-fertilize and the seed they produced was collected. From each of these individual seed sets, seedlings can be germinated and their tissues utilized for making genomic DNA. Tissue pooled from multiple seedlings is useful for making Southern genomic DNA blots for the analysis of restriction fragment length polymorphisms (RFLPs). An exemplary list of the seed stock of informative individuals used for tetrad analysis is given in FIG. 4.

II. Mapping Strategy

Previous DNA fingerprint and hybridization analysis of two bacterial artificial chromosome (BAC) libraries had led to the assembly of physical maps covering nearly all single-copy portions of the *Arabidopsis* genome (Marra et al., 1999). However, the presence of repetitive DNA near the *Arabidopsis* centromeres, including 180 bp repeats, retroelements, and middle repetitive sequences complicated efforts to anchor centromeric BAC contigs to particular chromosomes (Murata et al., 1997; Heslop-Harrison et al., 1999; Brandes et al., 1997; Franz et al., 1998; Wright et al., 1996; Konieczny et al., 1991; Pelissier et al., 1995; Voytas and Ausubel, 1988; Chye et al., 1997; Tsay et al., 1993; Richards et al., 1991; Simoens et al., 1988; Thompson et al., 1996; Pelissier et al., 1996).

The inventors used genetic mapping to unambiguously assign these unanchored contigs to specific centromeres, scoring polymorphic markers in 48 plants with crossovers informative for the entire genome (Copenhaver et al., 1998). In this manner, several centromeric contigs were connected to the physical maps of the chromosome arms (see EXAMPLE 6), and a large set of DNA markers defining centromere boundaries were generated. DNA sequence analysis confirmed the structure of the contigs for chromosomes II and IV (Lin et al., 1999).

CEN2 and CEN4 were selected in particular for analysis. Both reside on structurally similar chromosomes with a 3.5 Mb rDNA arrays on their distal tips, with regions measuring 3 and 2 Mb, respectively, between the rDNA and centromeres, and 16 and 13 Mb regions on their long arms (Copenhaver and Pikaard, 1996).

The virtually complete and annotated sequence of chromosomes II and IV was used to conduct an analysis of centromeres at the nucleotide level (www.ncbi.nlm.nih.gov/Entrez/nucleotide.html). The sequence composition was analyzed within the genetically-defined centromere boundaries and compared to the adjacent pericentromeric regions (FIGS. 12A–T). Analysis of the two centromeres facilitated comparisons of sequence patterns and identification of conserved sequence elements.

Figure 3A:
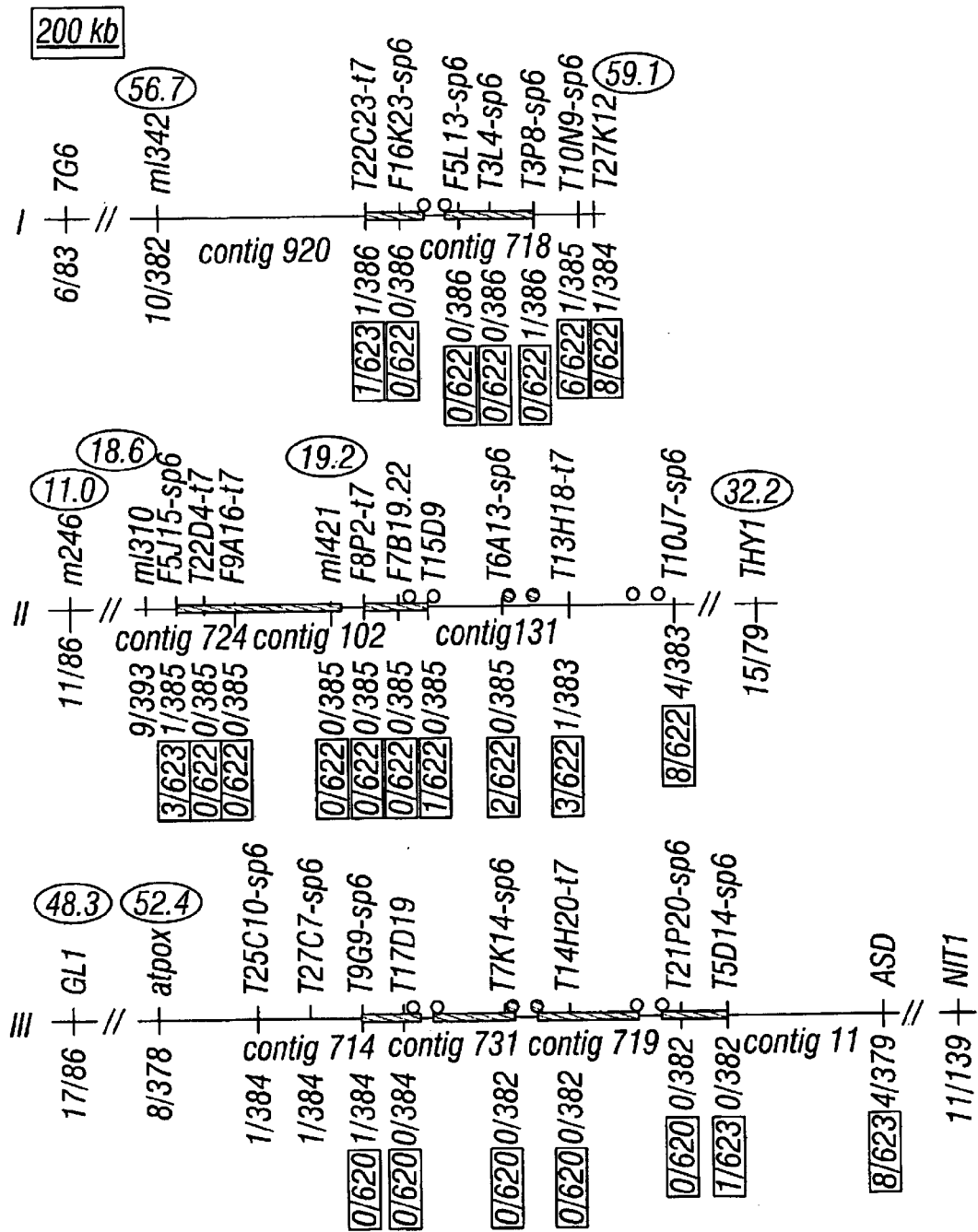
FIG. 3. Physical maps of the genetically-defined *Arabidopsis* centromeres. Each centromeric region is drawn to scale; physical sizes are derived from DNA sequencing (chromosomes II and IV) or from estimates based on BAC fingerprinting (Marra et al., 1999; Mozo et al., 1999) (chromosomes I, III, and V). Indicated for each chromosome are positions of markers (above), the number of tetratype/total tetrads at those markers (below), the boundaries of the centromere (thick black bars), and the name of contigs derived from fingerprint analysis (Marra et al., 1999; Mozo et al., 1999). For each contig, more than two genetic markers, developed from the database of BAC-end sequences (www.tigr.org/tdb/at/abe/bac$_{13}$end_search.html) were scored. PCR primers corresponding to these sequences were used to identify size or restriction site polymorphism in the Columbia and Landsberg encotypes (Bell and Ecker, 1994; Konieczny and Ausubel, 1993); primer sequences are available (www.stanford.edu/Arabidopsis/aboutcaps.html). Tetratype tetrads resulting from treatments that stimulate crossing over (boxes); positions of markers in centimorgans (cM) shared with recombinant inbred (RI) map (ovals) (nasc.nott.ac.uk/new_ri_map.html; Somerville and Somerville, 1999); and sequences bordering gaps in the physical map that correspond to 180 bp repeats (open circles) (Round et al., 1997), 5S rDNA (black circles) or 160 bp repeats (gray circles) are indicated (Copenhaver et al., 1999).
Figure 3B:
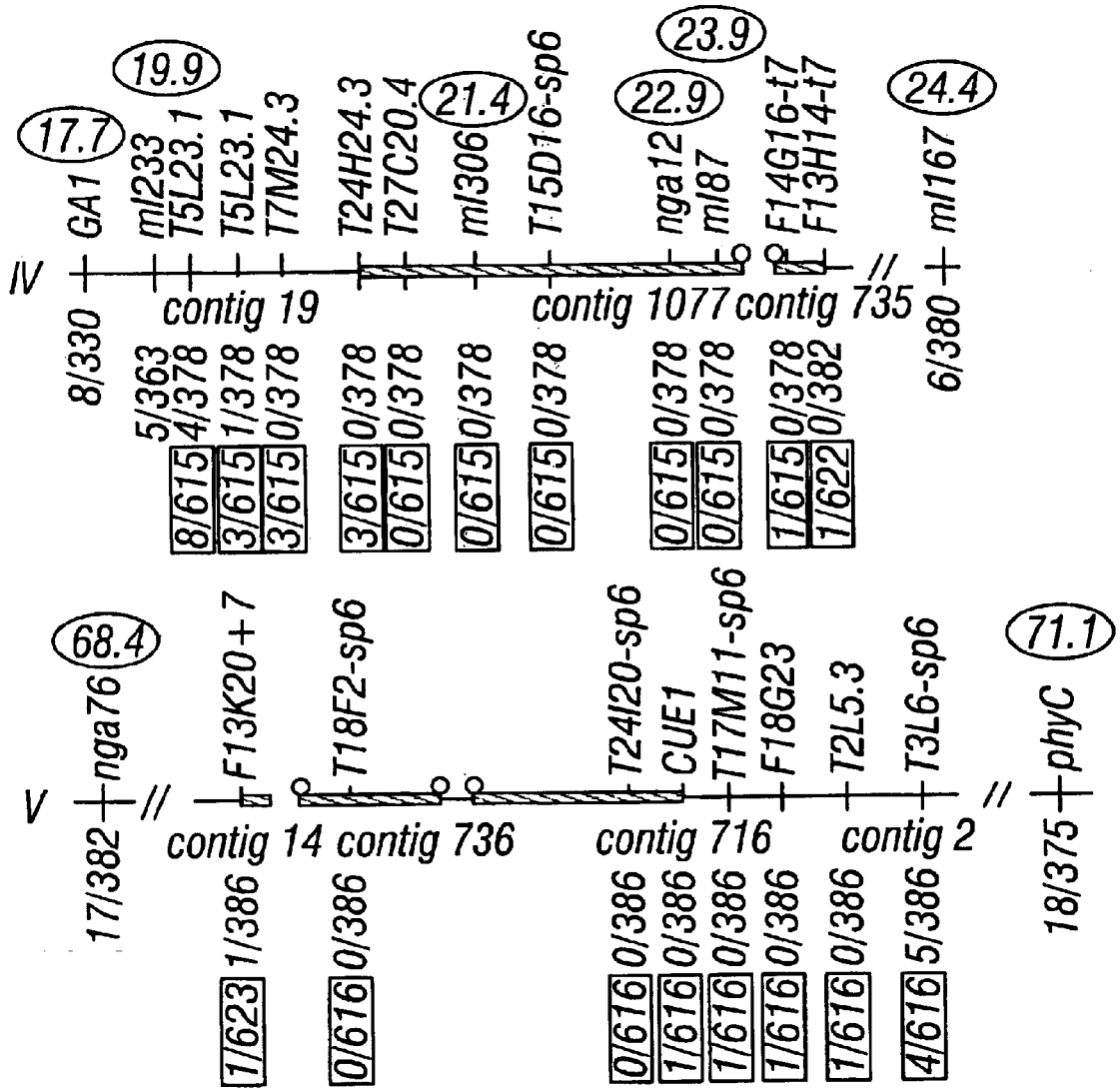
Figures 3Q, 23D:
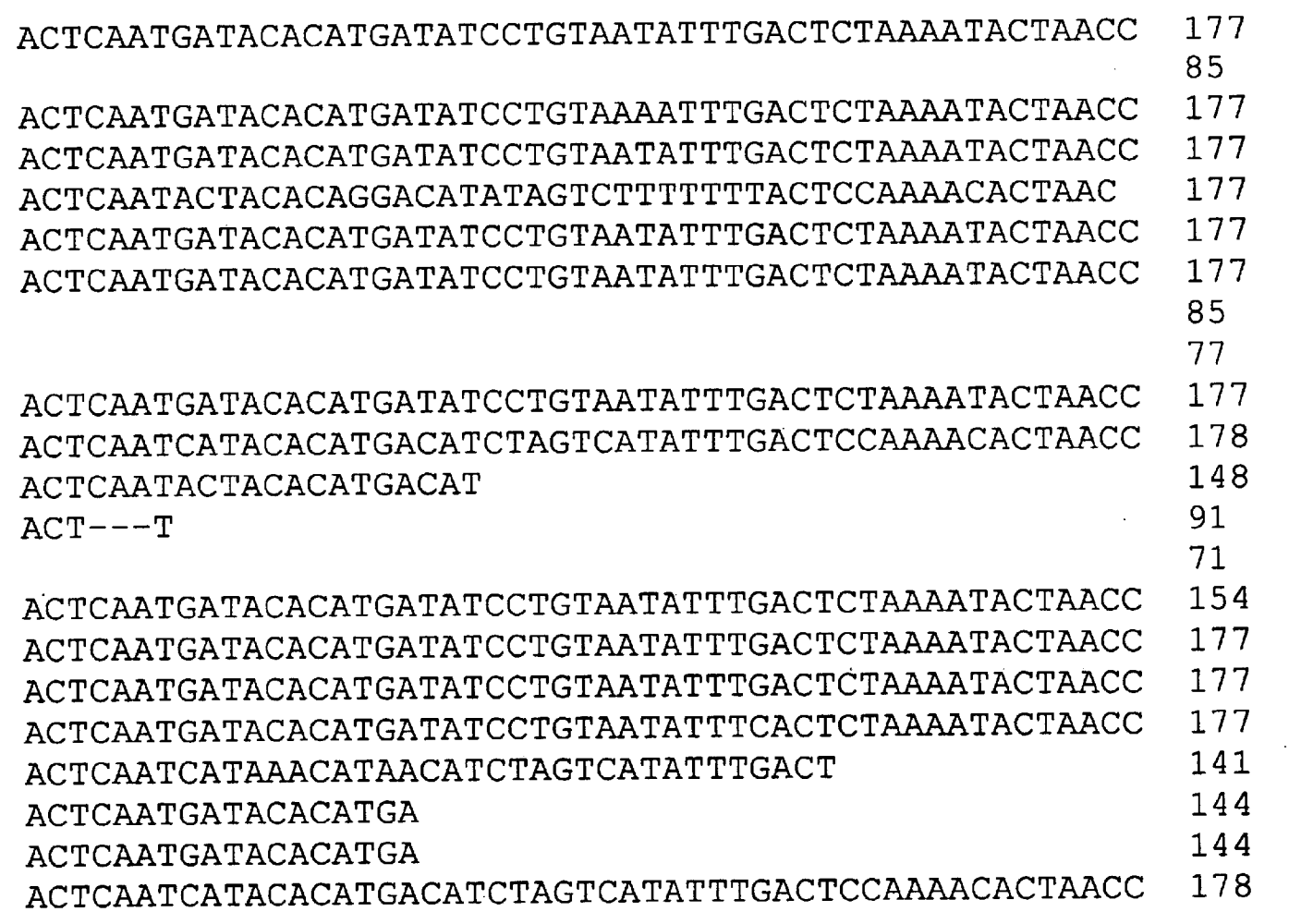

The centromere sequences were found to harbour 180 bp repeat sequences. These sequences were found to reside in the gaps of each centromeric contig (FIG. 3, FIGS. 12B, 12L), with few repeats and no long arrays elsewhere in the genome. BAC clones near these gaps have end sequences corresponding to repetitive elements that likely constitute the bulk of the DNA between the contigs, including 180 bp repeats, 5S rDNA or 160 bp repeats (FIG. 3). Fluorescent in situ hybridization has shown these repetitive sequences are abundant components of *Arabidopsis* centromeres (Murata et al., 1997; Heslop-Harrison et al., 1999; Brandes et al., 1997). Genetic mapping and pulsed-field gel electrophoresis indicate that many 180 bp repeats reside in long arrays measuring between 0.4 and 1.4 Mb in the centromeric regions (Round et al., 1997); sequence analysis revealed additional interspersed copies near the gaps. The inventors specifically contemplate the use of such 180 bp repeats for the construction of minichromosomes. The annotated sequence of chromosomes II and IV identified regions with homology to middle repetitive DNA, both within the functional centromeres and in the adjacent regions (FIGS. 12B–12E and 12L–12O).

In a 4.3 Mb sequenced region that includes CEN2 and a 2.8 Mb sequenced region that includes CEN4, retrotransposon homology was found to account for >10% of the DNA sequence, with a maximum of 62% and 70%, respectively (FIGS. 12C, 12M). Sequences with similarity to transposons or middle repetitive elements were found to occupy a similar zone, but were less common (29% and 11% maximum density for chromosomes II and IV respectively (FIGS. 12D–12E and FIG. 12N-12O). Finally, unlike in the case of *Drosophila* and *Neurospora* centromeres (Sun et al., 1997; Cambareri et al., 1998) low complexity DNA, including microsatellites, homopolymer tracts, and AT rich isochores, were not found to be enriched in the centromeres of *Arabidopsis*. Near CEN2, simple repeat sequence densities were comparable to those on the distal chromosome arms, occupying 1.5% of the sequence within the centromere, 3.2% in the flanking regions, and ranging from 20 to 319 bp in length (71 bp on average). Except for an insertion of mitochondrial DNA at CEN2 the DNA in and around the centromeres did not contain any large regions that deviated significantly from the genomic average of ~64% A+T (FIGS. 12F, 12P)(Bevan et al., 1999).

Unlike the 180 bp repeats, all other repetitive elements near CEN2 and CEN4 were less abundant within the genetically-defined centromeres than in the flanking regions. The high concentration of repetitive elements outside of the functional centromere domain suggest they may be insufficient for centromere activity. Thus, identifying segments of the *Arabidopsis* genome that are enriched in these repetitive sequences does not pinpoint the regions that provide centromere function; a similar situation may occur in the genomes of other higher eukaryotes.

The repetitive DNA flanking the centromeres may play an important role, forming an altered chromatin conformation that serves to nucleate or stabilize centromere structure. Alternatively, other mechanisms could result in the accumulation of repetitive elements near centromeres. Though evolutionary models predict repetitive DNA accumulates in regions of low recombination (Charlesworth et al., 1986; Charlesworth et al., 1994), many *Arabidopsis* repetitive elements are more abundant in the recombinationally active pericentromeric regions than in the centromeres themselves. Instead, retroelements and other transposons may preferentially insert into regions flanking the centromeres or be eliminated from the rest of the genome at a higher rate.

III. Centromere Compositions

Certain aspects of the present invention concern isolated nucleic acid segments and recombinant vectors comprising a plant centromere. In one embodiment of the invention, the plant centromere is an *Arabidopsis thaliana* centromere. In a further embodiment of the invention, nucleic acid sequences comprising an *A. thaliana* chromosome 2 centromere are provided. The sequence of the *Arabidopsis thaliana* chromosome 2 centromere is exemplified by the nucleic acid sequences of SEQ ID NO:209 and SEQ ID NO:210. As shown in FIG. 17, the nucleic acid sequences of SEQ ID NO:209 and SEQ ID NO:210 flank a series of 180 bp repeats in centromere 2 of *A. thaliana*. As such, the chromosome 2 centromere may further be defined as comprising n number of repeats linked to a nucleic acid sequence included in SEQ ID NO:209 or SEQ ID NO:210, or sequences isolated from both of those sequences. In particular embodiments of the invention, the number of repeats (n), is about 2, 4, 8, 15, 25, 40, 70, 100, 200, 400, 600, 800, 1,000, 1,500, 2,000, 4,000, 6,000, 8000, 10,000, 30,000, 50,000 or about 100,000. The actual repeat sequence used may vary. Representative samples of repeat sequences that could be used are given in FIGS. 23A–23D and included in the nucleic acid sequences given by SEQ ID NOs 184–208. The length of the repeat used may also vary, and may include repeats of, for example, about 10 bp, 20 bp, 40 bp, 60 bp, 80 bp, 100 bp, 120 bp, 140 bp, 150 bp, 160 bp, 170 bp, 180 bp, 190 bp, or about 200 bp or larger or a repeat sequence, for example, as listed in FIG. 23A–FIG. 23D and included in the nucleic acid sequences given by SEQ ID NOs 184–208.

Isolated segments of the nucleic acid sequences of SEQ ID NO:209 and SEQ ID NO:210 are also contemplated to be of use with the invention, either with or without being linked to a series of repeats. Particularly, contiguous nucleic acid segments of about 100, 200, 400, 800, 1,500, 3,000, 5,000, 7,500, 10,000, 15,000, 25,000, 40,000, 75,000, 100,000, 125,000, 150,000, 250,000, 350,000, 450,000, 600,000, 700,00 and about 800,000 bp of the nucleic acid sequences of SEQ ID NO:209 or SEQ ID NO:210 specifically form part of the instant invention. In particular embodiments of the invention, such nucleic acid sequences may be linked to n number of repeated sequences, for example, where n is 2, 4, 8, 15, 25, 40, 70, 100, 200, 400, 600, 800, 1,000, 1,500, 2,000, 4,000, 6,000, 8000, 10,000, 30,000, 50,000 or about 100,000. The repeat sequence may comprise, for example, about 10 bp, 20 bp, 40 bp, 60 bp, 80 bp, 100 bp, 120 bp, 140 bp, 150 bp, 160 bp, 170 bp, 180 bp, 190 bp, or about 200 bp or a larger segment of contiguous nucleotides of, for example, a repeat listed in FIG. 23A–FIG. 23D and included in the nucleic acid sequences given by SEQ ID NOs 184–208.

In another embodiment of the invention, nucleic acid sequences comprises an *A. thaliana* chromosome 4 centromere are provided. The sequence of the *Arabidopsis thaliana* chromosome 4 centromere is exemplified by the nucleic acid sequences of SEQ ID NO:211 and SEQ ID NO:212. As shown in FIG. 18, the nucleic acid sequences of SEQ ID NO:211 and SEQ ID NO:212 in *Arabidopsis* flank a series of repeated sequences. As such, the chromosome 4 centromere may further be defined as comprising n number of repeats linked to a nucleic acid sequence included in SEQ ID NO:211 or SEQ ID NO:212, or sequences from both SEQ ID NO:211 and SEQ ID NO:212. In particular embodiments of the invention, the number of repeats (n), is about 2, 4, 8, 15, 25, 40, 70, 100, 200, 400, 600, 800, 1,000, 1,500, 2,000, 4,000, 6,000, 8000, 10,000, 50,000 or about 100,000. The actual repeat sequence used may vary. Representative samples of repeat sequences that could be used are given in FIGS. 23A–23D, wherein these sequences are included in the nucleic acid sequences given by SEQ ID NOs 184–208. The length of the repeat used may also vary, and may include repeats of, for example, about 10 bp, 20 bp, 40 bp, 60 bp, 80 bp, 100 bp, 120 bp, 140 bp, 150 bp, 160 bp, 170 bp, 180 bp, 190 bp, or about 200 bp or a larger.

Isolated segments of the nucleic acid sequences of SEQ ID NO:211 and SEQ ID NO:212 are also contemplated to be of use with the invention, either with or without being linked to a series of repeated sequences. Particularly, contiguous nucleic acid segments of about 100, 200, 400, 800, 1,500, 3,000, 5,000, 7,500, 10,000, 15,000, 25,000, 40,000, 75,000, 100,000, 125,000, 150,000, 250,000, 350,000, 450,000, 600,000, 700,00 bp of the nucleic acid sequences of SEQ ID NO:211 or SEQ ID NO:212 specifically form part of the instant invention. In particular embodiments of the invention, such nucleic acid sequences may be linked to n number of repeated sequences, for example, where n is 2, 4, 8, 15, 25, 40, 70, 100, 200, 400, 600, 800, 1,000, 1,500, 2,000, 4,000, 6,000, 8000, 10,000, 30,000, 50,000 or about 100,000. The repeat sequence may comprise, for example, about 10 bp, 20 bp, 40 bp, 60 bp, 80 bp, 100 bp, 120 bp, 140 bp, 150 bp, 160 bp, 170 bp, 180 bp, 190 bp, or about 200 bp or a larger segment of contiguous nucleotides of the sequence of SEQ ID NO:184–208.

Also provided by the invention are regulatory regions from the *Arabidopsis* polyubiquitin 11 gene, including promoter and terminator sequences thereof. The nucleic acid sequences of these regulatory regions are exemplified by the nucleic acid sequences of SEQ ID NO:180 and SEQ ID NO:181. Also included with such sequences are contiguous stretch of from about 10, 15, 20, 25, 30, 40, 50, 75, 100, 125, 150, 200, 300, 500, 750, 1,000, 1,500, and about 2,000 nucleotides of the nucleic acid sequence of SEQ ID NO:180 and SEQ ID NO:181. In particular embodiments of the invention, it may be desirable to operably link the *Arabidopsis* polyubiquitin 11 promoter sequences to the 5' end of a coding sequence. It may also be desirable to operably link the *Arabidopsis* polyubiquitin 11 terminator sequence to the 3' end of a coding sequence.

Still further provided by the invention are regulatory regions from the *Arabidopsis* 40S ribosomal protein S16 gene, including promoter and terminator sequences thereof. The nucleic acid sequences of these regulatory regions are exemplified by the nucleic acid sequences of SEQ ID NO:182 and SEQ ID NO:183. Also included with such sequences are contiguous stretch of from about 10, 15, 20, 25, 30, 40, 50, 75, 100, 125, 150, 200, 300, 500, 750, 1,000, 1,500, and about 2,000 nucleotides of the nucleic acid sequence of SEQ ID NO:182 and SEQ ID NO:183. In particular embodiments of the invention, it may be desirable to operably link the *Arabidopsis* 40S ribosomal protein S16 gene sequences to the 5' end of a coding sequence. It may also be desirable to operably link the *Arabidopsis* 40S ribosomal protein S16 gene sequence to the 3' end of a coding sequence.

Still further provided by the invention are gene sequences and related regulatory elements and sequences with other functions from centromere regions. In particular, the invention includes the centromere sequences given by SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, and SEQ ID NO:21, as well as lengths of about 5, 10, 15, 20, 25, 30, 40, 50, 60, 70, 80, 90, 100, 110, 125, 150, 175, 200, 250, 300, 350, 400, 500, 550, 590, 1,000, and about 1,500 contiguous nucleotides of these sequences, up to and including the full length of the sequences.

Centromere-containing nucleic acid sequences may be provided with other sequences for the creation and use of recombinant minichromosomes. Such nucleic acid sequences specifically within the scope of the invention include the nucleic acid sequences listed in the sequence listing provided herewith.

The present invention concerns nucleic acid segments, isolatable from *A. thaliana* cells, that are enriched relative to total genomic DNA or other nucleic acids and are capable of conferring centromere activity to a recombinant molecule when incorporated into the host cell. As used herein, the term "nucleic acid segment" refers to a nucleic acid molecule that has been purified from total genomic nucleic acids of a particular species. Therefore, a nucleic acid segment conferring centromere function refers to a nucleic acid segment that contains centromere sequences yet is isolated away from, or purified free from, total genomic nucleic acids of *A. thaliana*. Included within the term "nucleic acid segment", are nucleic acid segments and smaller fragments of such segments, and also recombinant vectors, including, for example, BACs, YACs, plasmids, cosmids, phage, viruses, and the like.

Similarly, a nucleic acid segment comprising an isolated or purified centromeric sequence refers to a nucleic acid segment including centromere sequences and, in certain aspects, regulatory sequences, isolated substantially away from other naturally occurring sequences, or other nucleic acid sequences. In this respect, the term "gene" is used for simplicity to refer to a functional nucleic acid segment, protein, polypeptide or peptide encoding unit. As will be understood by those in the art, this functional term includes both genomic sequences, cDNA sequences and smaller engineered gene segments that may express, or may be adapted to express, proteins, polypeptides or peptides.

"Isolated substantially away from other sequences" means that the sequences of interest, in this case centromere sequences, are included within the genomic nucleic acid clones provided herein. Of course, this refers to the nucleic acid segments as originally isolated, and does not exclude genes or coding regions later added to the segment by the hand of man.

In particular embodiments, the invention concerns isolated nucleic acid segments and recombinant vectors incorporating nucleic acid sequences that encode a centromere functional sequence that includes a contiguous sequence from the centromeres of the current invention. In certain other embodiments, the invention concerns isolated nucleic acid segments and recombinant vectors that include within their sequence a contiguous nucleic acid sequence from an *A. thaliana* centromere. Again, nucleic acid segments that exhibit centromere function activity will be most preferred.

The nucleic acid segments of the present invention, regardless of the length of the sequence itself, may be combined with other nucleic acid sequences, such as promoters, polyadenylation signals, additional restriction enzyme sites, multiple cloning sites, other coding segments, and the like, such that their overall length may vary considerably. It is therefore contemplated that a nucleic acid fragment of almost any length may be employed, with the total length preferably being limited by the ease of preparation and use in the intended recombinant DNA protocol.

(i) Primers and Probes

In addition to their use in the construction of recombinant constructs, including minichromosomes, the nucleic acid sequences disclosed herein may find a variety of other uses. For example, the centromere sequences described herein may find use as probes or primers in nucleic acid hybridization embodiments. As such, it is contemplated that nucleic acid segments that comprise a sequence region that consists of at least a 14 nucleotide long contiguous sequence that has the same sequence as, or is complementary to, a 14 nucleotide long contiguous DNA segment of a centromere sequence of the current invention, for example, of the sequences given by SEQ ID NOS:1–212, and particularly, SEQ ID NOS:1–21 and SEQ ID NOS:180–212, will find particular utility. Longer contiguous identical or complementary sequences, e.g., those of about 20, 30, 40, 50, 100, 200, 500, 1,000, 2,000, 5,000 bp, etc., including all intermediate lengths and up to and including the full-length sequence of the sequences given in SEQ ID NOS:1–212, also will be of use in certain embodiments.

As described in detail herein, the ability of such nucleic acid probes to specifically hybridize to centromeric sequences will enable them to be of use in detecting the presence of similar, partially complementary sequences from other plants or animals. However, other uses are envisioned, including the use of the centromeres for the preparation of mutant species primers, or primers for use in preparing other genetic constructions.

Nucleic acid fragments having sequence regions consisting of contiguous nucleotide stretches of 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, 100 or even of 101–200 nucleotides or so, identical or complementary to a centromere sequence of the current invention, including the sequences given in SEQ ID NOS:1–212, are particularly contemplated as hybridization probes for use in, e.g., Southern and Northern blotting. Smaller fragments will generally find use in hybridization embodiments, wherein the length of the contiguous complementary region may be varied, such as between about 10–14 and about 100 or 200 nucleotides, but larger contiguous complementarity stretches also may be used, according to the length complementary sequences one wishes to detect.

Of course, fragments may also be obtained by other techniques such as, e.g., by mechanical shearing or by restriction enzyme digestion. Small nucleic acid segments or fragments may be readily prepared by, for example, directly synthesizing the fragment by chemical means, as is commonly practiced using an automated oligonucleotide synthesizer. Also, fragments may be obtained by application of nucleic acid reproduction technology, such as the PCR™ technology of U.S. Pat. Nos. 4,683,195 and 4,683,202 (each incorporated herein by reference), by introducing selected sequences into recombinant vectors for recombinant production, and by other recombinant DNA techniques generally known to those of skill in the art of molecular biology.

Accordingly, the centromere sequences of the current invention may be used for their ability to selectively form duplex molecules with complementary stretches of DNA fragments. Depending on the application envisioned, one will desire to employ varying conditions of hybridization to achieve varying degrees of selectivity of probe towards target sequence. For applications requiring high selectivity, one will typically desire to employ relatively stringent conditions to form the hybrids, e.g., one will select relatively low salt and/or high temperature conditions, such as provided by about 0.02 M to about 0.15 M NaCl at temperatures of about 50° C. to about 70° C. Such selective conditions tolerate little, if any, mismatch between the probe and the template or target strand, and would be particularly suitable for isolating centromeric DNA segments. Nucleic acid sequences hybridizing under these conditions and the conditions below to the nucleic acid sequences provided by the invention, including those given by SEQ ID NOS:1–212, form a part of the invention. Detection of nucleic acid segments via hybridization is well-known to those of skill in the art, and the teachings of U.S. Pat. Nos. 4,965,188 and 5,176,995 (each specifically incorporated herein by reference in its entirety) are exemplary of the methods of hybridization analyses. Teachings such as those found in the texts of Maloy et al., 1991; Segal, 1976; Prokop, 1991; and Kuby, 1994, are particularly relevant.

Of course, for some applications, for example, where one desires to prepare mutants employing a mutant primer strand hybridized to an underlying template or where one seeks to isolate centromere function-conferring sequences from related species, functional equivalents, or the like, less stringent hybridization conditions will typically be needed in order to allow formation of the heteroduplex. In these circumstances, one may desire to employ conditions such as about 0.15 M to about 0.9 M salt, at temperatures ranging from about 20° C. to about 55° C. Cross-hybridizing species can thereby be readily identified as positively hybridizing signals with respect to control hybridizations. In any case, it is generally appreciated that conditions can be rendered more stringent by the addition of increasing amounts of formamide, which serves to destabilize the hybrid duplex in the same manner as increased temperature or decreased salt. Thus, hybridization conditions can be readily manipulated, and thus will generally be a method of choice depending on the desired results.

In certain embodiments, it will be advantageous to employ nucleic acid sequences of the present invention in combination with an appropriate means, such as a label, for determining hybridization. A wide variety of appropriate indicator means are known in the art, including fluorescent, radioactive, enzymatic or other ligands, such as avidin/biotin, which are capable of giving a detectable signal. In preferred embodiments, one will likely desire to employ a fluorescent label or an enzyme tag, such as urease, alkaline phosphatase or peroxidase, instead of radioactive or other environmentally undesirable reagents. In the case of enzyme tags, colorimetric indicator substrates are known that can be employed to provide a means visible to the human eye or spectrophotometrically, to identify specific hybridization with complementary nucleic acid-containing samples.

In general, it is envisioned that the hybridization probes described herein will be useful both as reagents in solution hybridization as well as in embodiments employing a solid phase. In embodiments involving a solid phase, the test DNA (or RNA) is adsorbed or otherwise affixed to a selected matrix or surface. This fixed, single-stranded nucleic acid is then subjected to specific hybridization with selected probes under desired conditions. The selected conditions will depend on the particular circumstances based on the particular criteria required (depending, for example, on the G+C content, type of target nucleic acid, source of nucleic acid, size of hybridization probe, etc.). Following washing of the hybridized surface so as to remove nonspecifically bound probe molecules, specific hybridization is detected, or even quantitated, by means of the label.

(ii) Large Nucleic Acid Segments

Using the markers flanking each centromere (see FIG. 3) it may be possible to purify a contiguous DNA fragment that contains both flanking markers and the centromere encoded between those markers. In order to carry this out, very large DNA fragments up to the size of an entire chromosome are prepared by embedding *Arabidopsis* tissues in agarose using, for example, the method described by Copenhaver et al., (1995). These large pieces of DNA can be digested in the agarose with any restriction enzyme. Those restriction enzymes which will be particularly useful for isolating intact centromeres include enzymes which yield very large DNA fragments. Such restriction enzymes include those with specificities greater than six base pairs such as, for example, AscI, Bae I, BbvC I, Fse I, Not I, Pac I, Pme I, PpuM I, Rsr II, SanD I, Sap I, SexA I, Sfi I, Sgf I, SgrA I, Sbf I, Srf I, Sse8387 I, Sse8647 I, Swa, UbaD I, and UbaE I, or any other enzyme that cuts at a low frequency within the *Arabidopsis* genome, and specifically within the centromeric region. Alternatively, a partial digest with a more frequent cutting restriction enzyme could be used.

Alternatively, large DNA fragments spanning some or all of a centromere could be produced using RecA-Assisted Restriction Endonuclease (RARE) cleavage (Ferrin, 1991). In order to carry this out, very large DNA fragments up to the size of an entire chromosome are prepared by embedding *Arabidopsis* tissues in agarose using, for example, the method described by Copenhaver et al., (1995). Single stranded DNA oligomers with sequences homologous to sites flanking the region of DNA to be purified are made to form triple stranded complexes with the agarose embedded DNA using the recombinase enzyme RecA. The DNA is then treated with a site specific methylase such as, for example, Alu I methylase, BamH I methylase, dam methylase, EcoR I methylase, Hae III methylase, Hha I methylase, Hpa II methylase, or Msp methylase. The methylase will modify all the sites specified by its recognition sequence except those within the triplex region protected by the RecA/DNA oligomer complex. The RecA/DNA oligomer complex are then removed from the agarose embedded DNA and the DNA is then cleaved with the restriction enzyme corresponding to the methylase used, for example, if EcoRI methylase was used herein EcoRI restriction endonuclease would be used to perform the cleavage. Only those sites protected from modification will be subject to cleavage by the restriction endonuclease. Thus by choosing targets flanking the centromeric regions that contain the recognition sequence of a site specific methylase/restriction endonuclease pair RARE can be used to cleave the entire region from the rest of the chromosome. It is important to note that this method can be used to isolate a DNA fragment of unknown composition by using sequence information flanking it. Thus, this method may be used to isolate the DNA contained within any gaps in the physical map for the centromeres. The DNA isolated by this method can then be sequenced.

The large DNA fragments produced by digestion with restriction enzymes or by RARE cleavage are then separated by size using pulsed-field gel electrophoresis (PFGE) (Schwartz et al., 1982). Specifically, Contour-clamped Homogeneous Electric Field (CHEF) electrophoresis (a variety of PFGE) can be used to separate DNA molecules as large as 10 Mb (Chu et al., 1985). Large DNA fragments resolved on CHEF gels can then be analyzed using standard Southern hybridization techniques to identify and measure the size of those fragments which contain both centromere flanking markers and therefor, the centromere. After determining the size of the centromere containing fragment by comparison with known size standards, the region from the gel that contains the centromere fragment can be cut out of a duplicate gel. This centromeric DNA can then be analyzed, sequenced, and used in a variety of applications, as described below, including the construction of minichromosomes. As indicated in detail below, minichromosomes can be constructed by attaching telomeres and selectable markers to the centromere fragment cut from the agarose gel using standard techniques which allow DNA ligation within the gel slice. Plant cells can then be transformed with this hybrid DNA molecule using the techniques described herein below.

IV. ##Recombinant Constructs Comprising Centromere Sequences ##

In light of the instant disclosure it will be possible for those of ordinary skill in the art to construct the recombinant DNA constructs described herein. Useful construction methods are well-known to those of skill in the art (see, for example, Maniatis et al., 1982). As constructed, the minichromosome will preferably include an autonomous replication sequence (ARS) functional in plants, a centromere functional in plants, and a telomere functional in plants.

The basic elements in addition to a plant centromere that may be used in constructing a minichromosome vector are known to those of skill in the art. For example, one type of telomere sequence that could be used is an *Arabidopsis* telomere, which consists of head to tail arrays of the monomer repeat CCCTAAA totaling a few (for example 3–4) kb in length. The telomeres of *Arabidopsis,* like those of other organisms, vary in length and do not appear to have a strict length requirement. An example of a cloned telomere can be found in GenBank accession number M20158 (Richards and Ausubel, 1988). Yeast telomere sequences have also been described (see, e.g., Louis, 1994; Genbank accession number S70807). Additionally, a method for isolating a higher eukaryotic telomere from *Arabidopsis thaliana* was described by Richards and Ausubel (1988).

It is commonly believed that higher eukaryotes do not possess a specific sequence that is used as a replication origin, but instead replicate their DNA from random sites distributed along the chromosome. In *Arabidopsis,* it is thought that the cell will form origins of replications about once every 70 kb (Van't Hof, 1978). Thus, because higher eukaryotes have origins of replication at potentially random positions on each chromosome, it is not possible to describe a specific origin sequence, but it may generally be assumed that a segment of plant DNA of a sufficient size will be recognized by the cell and origins will be generated on the construct. For example, any piece of *Arabidopsis* genomic DNA larger than 70 kb would be expected to contain an ARS. By including such a segment of DNA on a recombinant vector, ARS function may be provided to the vector. Additionally, many *S. cerevisiae* autonomous replicating sequences have been sequenced and could be used to fulfill the ARS function. One example is the *Saccharomyces cerevisiae* autonomously replicating sequence ARS131A (GenBank number L25319). Many origins of replications have been also been sequenced and cloned from *E. coli* and could be used with the invention, for example, the Col E1 origin of replication (Ohmori and Tomizawa, 1979; GenBank number V00270). One *Agrobacterium* origin that could be used is RiA4. The localization of origins of replication in the plasmids of *Agrobacterium rhizogenes* strain A4 was described by Jouanin et al. (1985).

(i) Considerations in the Preparation of Recombinant Constructs

In addition to the basic elements, positive or negative selectable plant markers (e.g., antibiotic or herbicide resistance genes), and a cloning site for insertion of foreign DNA may be included. In addition, a visible marker, such as green fluorescent protein, also may be desirable. In order to propagate the vectors in *E. coli,* it is necessary to convert the linear molecule into a circle by addition of a stuffer fragment between the telomeres. Inclusion of an *E. coli* plasmid replication origin and selectable marker also may be preferred. It also may be desirable to include *Agrobacterium* sequences to improve replication and transfer to plant cells. The inventors have described a number of exemplary minichromosome constructs in FIGS. 7A–7H, although it will be apparent to those in skill art that many changes may be made in the order and types of elements present in these constructs and still obtain a functional minichromosome within the scope of the instant invention.

Artificial plant chromosomes which replicate in yeast also may be constructed to take advantage of the large insert capacity and stability of repetitive DNA inserts afforded by this system (see Burke et al., 1987). In this case, yeast ARS and CEN sequences may be added to the vector. The artificial chromosome is maintained in yeast as a circular molecule using a stuffer fragment to separate the telomeres.

A fragment of DNA, from any source whatsoever, may be purified and inserted into a minichromosome at any appropriate restriction endonuclease cleavage site. The DNA segment usually will include various regulatory signals for the expression of proteins encoded by the fragment. Alternatively, regulatory signals resident in the minichromosome may be utilized.

The techniques and procedures required to accomplish insertion are well-known in the art (see Maniatis et al., 1982). Typically, this is accomplished by incubating a circular plasmid or a linear DNA fragment in the presence of a restriction endonuclease such that the restriction endonuclease cleaves the DNA molecule. Endonucleases preferentially break the internal phosphodiester bonds of polynucleotide chains. They may be relatively unspecific, cutting polynucleotide bonds regardless of the surrounding nucleotide sequence. However, the endonucleases which cleave only a specific nucleotide sequence are called restriction enzymes. Restriction endonucleases generally internally cleave DNA molecules at specific recognition sites, making breaks within "recognition" sequences that in many, but not all, cases exhibit two-fold symmetry around a given point. Such enzymes typically create double-stranded breaks.

Many of these enzymes make a staggered cleavage, yielding DNA fragments with protruding single-stranded 5' or 3' termini. Such ends are said to be "sticky" or "cohesive" because they will hydrogen bond to complementary 3' or 5' ends. As a result, the end of any DNA fragment produced by an enzyme, such as EcoRI, can anneal with any other fragment produced by that enzyme. This properly allows splicing of foreign genes into plasmids, for example. Some restriction endonucleases that may be particularly useful with the current invention include HindIII, PstI, EcoRI, and BamHI.

Some endonucleases create fragments that have blunt ends, that is, that lack any protruding single strands. An alternative way to create blunt ends is to use a restriction enzyme that leaves overhangs, but to fill in the overhangs with a polymerase, such as klenow, thereby resulting in blunt ends. When DNA has been cleaved with restriction enzymes that cut across both strands at the same position, blunt end ligation can be used to join the fragments directly together. The advantage of this technique is that any pair of ends may be joined together, irrespective of sequence.

Those nucleases that preferentially break off terminal nucleotides are referred to as exonucleases. For example, small deletions can be produced in any DNA molecule by treatment with an exonuclease which starts from each 3' end of the DNA and chews away single strands in a 3' to 5' direction, creating a population of DNA molecules with single-stranded fragments at each end, some containing terminal nucleotides. Similarly, exonucleases that digest DNA from the 5' end or enzymes that remove nucleotides from both strands have often been used. Some exonucleases which may be particularly useful in the present invention include Bal31, SI, and ExoIII. These nucleolytic reactions can be controlled by varying the time of incubation, the temperature, and the enzyme concentration needed to make deletions. Phosphatases and kinases also may be used to control which fragments have ends which can be joined. Examples of useful phosphatases include shrimp alkaline phosphatase and calf intestinal alkaline phosphatase. An example of a useful kinase is T4 polynucleotide kinase.

Once the source DNA sequences and vector sequences have been cleaved and modified to generate appropriate ends they are incubated together with enzymes capable of mediating the ligation of the two DNA molecules. Particularly useful enzymes for this purpose include T4 ligase, *E. coli* ligase, or other similar enzymes. The action of these enzymes results in the sealing of the linear DNA to produce a larger DNA molecule containing the desired fragment (see, for example, U.S. Pat. Nos. 4,237,224; 4,264,731; 4,273, 875; 4,322,499 and 4,336,336, which are specifically incorporated herein by reference).

It is to be understood that the termini of the linearized plasmid and the termini of the DNA fragment being inserted must be complementary or blunt in order for the ligation reaction to be successful. Suitable complementarity can be achieved by choosing appropriate restriction endonucleases (i.e., if the fragment is produced by the same restriction endonuclease or one that generates the same overhang as that used to linearize the plasmid, then the termini of both molecules will be complementary). As discussed previously, in one embodiment of the invention, at least two classes of the vectors used in the present invention are adapted to receive the foreign oligonucleotide fragments in only one orientation. After joining the DNA segment to the vector, the resulting hybrid DNA can then be selected from among the large population of clones or libraries.

A method useful for the molecular cloning of DNA sequences includes in vitro joining of DNA segments, fragmented from a source of high molecular weight genomic DNA, to vector DNA molecules capable of independent replication. The cloning vector may include plasmid DNA (see Cohen et al., 1973), phage DNA (see Thomas et al., 1974), SV40 DNA (see Nussbaum et al., 1976), yeast DNA, *E. coli* DNA and most significantly, plant DNA.

A variety of processes are known which may be utilized to effect transformation; i.e., the inserting of a heterologous DNA sequences into a host cell, whereby the host becomes capable of efficient expression of the inserted sequences.

(ii) Regulatory Elements

In one embodiment of the invention, constructs may include a plant promoter, for example, the CaMV 35S promoter (Odell et al., 1985), or others such as CaMV 19S (Lawton et al., 1987), nos (Ebert et al., 1987), Adh (Walker et al., 1987), sucrose synthase (Yang & Russell, 1990), a-tubulin, actin (Wang et al., 1992), cab (Sullivan et al., 1989), PEPCase (Hudspeth & Grula, 1989) or those associated with the R gene complex (Chandler et al., 1989). Tissue specific promoters such as root cell promoters (Conkling et al., 1990) and tissue specific enhancers (Fromm et al., 1989) are also contemplated to be useful, as are inducible promoters such as ABA- and turgor-inducible promoters. In particular embodiments of the invention, a Lat52 promoter may be used (Twell et al., 1991). A particularly useful tissue specific promoter is the SCARECROW (Scr) root-specific promoter (DiLaurenzio et al., 1996).

As the DNA sequence between the transcription initiation site and the start of the coding sequence, i.e., the untranslated leader sequence, can influence gene expression. Therefore, one may also wish to employ a particular leader sequence.

It is envisioned that a functional gene could be introduced under the control of novel promoters or enhancers, etc., or perhaps even homologous or tissue specific (for example, root-, collar/sheath-, whorl-, stalk-, earshank-, kernel- or leaf-specific) promoters or control elements. In particular embodiments of the invention, the functional gene may be in an antisense orientation relative to the promoter.

(ii) Terminators

It may also be desirable to link a functional gene to a 3' end DNA sequence that acts as a signal to terminate transcription and allow for the poly-adenylation of the mRNA produced by coding sequences. Such a terminator may be the native terminator of the functional gene or, alternatively, may be a heterologous 3' end. Examples of terminators that could be used with the invention are those from the nopaline synthase gene of *Agrobacterium tumefaciens* (nos 3' end) (Bevan et al., 1983), the terminator for the T7 transcript from the octopine synthase gene of *Agrobacterium tumefaciens*, and the 3' end of the protease inhibitor I or II genes from potato or tomato.

(iii) Marker Genes

It may be desirable to use one or more marker genes in accordance with the invention. Such markers may be adapted for use in prokaryotic, lower eukaryotic or higher eukaryotic systems, or may be capable of use in any combination of the foregoing classes of organisms. By employing a selectable or screenable marker protein, one can provide or enhance the ability to identify transformants. "Marker genes" are genes that impart a distinct phenotype to cells expressing the marker protein and thus allow such transformed cells to be distinguished from cells that do not have the marker. Such genes may encode either a selectable of screenable marker, depending on whether the marker confers a trait which one can "select" for by chemical means, i.e., through the use of a selective agent (e.g., a herbicide, antibiotic, or the like), or whether it is simply a trait that one can identify through observation or testing, i.e., by "screening" (e.g., the green fluorescent protein). Of course, many examples of suitable marker proteins are known to the art and can be employed in the practice of the invention.

Included within the terms selectable or screenable markers also are genes which encode a "secretable marker" whose secretion can be detected as a means of identifying or selecting for transformed cells. Examples include markers which are secretable antigens that can be identified by antibody interaction, or even secretable enzymes which can be detected by their catalytic activity. Secretable proteins fall into a number of classes, including small, diffusible proteins detectable, e.g., by ELISA; small active enzymes detectable in extracellular solution (e.g., α-amylase, β-lactamase, phosphinothricin acetyltransferase); and proteins that are inserted or trapped in the cell wall (e.g., proteins that include a leader sequence such as that found in the expression unit of extensin or tobacco PR-S).

With regard to selectable secretable markers, the use of a gene that encodes a protein that becomes sequestered in the cell wall, and which protein includes a unique epitope is considered to be particularly advantageous. Such a secreted antigen marker would ideally employ an epitope sequence that would provide low background in plant tissue, a promoter-leader sequence that would impart efficient expression and targeting across the plasma membrane, and would produce protein that is bound in the cell wall and yet accessible to antibodies. A normally secreted wall protein modified to include a unique epitope would satisfy all such requirements.

1. Selectable Markers

Many selectable marker genes may be used in accordance with invention including, but not limited to, neo (Potrykus et al., 1985), which provides kanamycin resistance and can be selected for using kanamycin, G418, paromomycin, etc.; bar, which confers bialaphos or phosphinothricin resistance; a mutant EPSP synthase protein (Hinchee et al., 1988) conferring glyphosate resistance; a nitrilase such as hxn from *Klebsiella ozaenae* which confers resistance to bromoxynil (Stalker et al., 1988); a mutant acetolactate synthase (ALS) which confers resistance to imidazolinone, sulfonylurea or other ALS inhibiting chemicals (European Patent Application 154,204, 1985); a methotrexate resistant DHFR (Thillet et al., 1988), a dalapon dehalogenase that confers resistance to the herbicide dalapon; or a mutated anthranilate synthase that confers resistance to 5-methyl tryptophan. Where a mutant EPSP synthase is employed, additional benefit may be realized through the incorporation of a suitable chloroplast transit peptide, CTP (U.S. Pat. No. 5,188,642) or OTP (U.S. Pat. No. 5,633,448) and use of a modified maize EPSPS (PCT Application WO 97/04103).

An illustrative embodiment of selectable marker capable of being used in systems to select transformants are those that encode the enzyme phosphinothricin acetyltransferase, such as the bar gene from *Streptomyces hygroscopicus* or the pat gene from *Streptomyces viridochromogenes*. The enzyme phosphinothricin acetyl transferase (PAT) inactivates the active ingredient in the herbicide bialaphos, phosphinothricin (PPT). PPT inhibits glutamine synthetase, (Murakami et al., 1986; Twell et al., 1989) causing rapid accumulation of ammonia and cell death. The use of bar as a selectable marker gene and for the production of herbicide-resistant rice plants from protoplasts was described by Rathore et al., (1993).

A number of *S. cerevisiae* marker genes are also known and could be used with the invention, such as, for example, the HIS4 gene (Donahue et al., 1982; GenBank number J01331). An example of an *E. coli* marker gene which has been cloned and sequenced and could be used in accordance with the invention is the Ap gene, which confers resistance to beta-lactam antibiotics such as ampacillin (nucleotides 4618 to 5478 of GenBank accession number U66885).

2. Screenable Markers

Screenable markers that may be employed include a β-glucuronidase (GUS) or uidA gene which encodes an enzyme for which various chromogenic substrates are known; an R-locus gene, which encodes a product that regulates the production of anthocyanin pigments (red color) in plant tissues (Dellaporta et al., 1988); a β-lactamase gene (Sutcliffe, 1978), which encodes an enzyme for which various chromogenic substrates are known (e.g., PADAC, a chromogenic cephalosporin); a xylE gene (Zukowsky et al., 1983) which encodes a catechol dioxygenase that can convert chromogenic catechols; an α-amylase gene (Ikuta et al., 1990); a tyrosinase gene (Katz et al., 1983) which encodes an enzyme capable of oxidizing tyrosine to DOPA and dopaquinone which in turn condenses to form the easily-detectable compound melanin; a β-galactosidase gene, which encodes an enzyme for which there are chromogenic substrates; a luciferase (lux) gene (Ow et al., 1986), which allows for bioluminescence detection; an aequorin gene (Prasher et al., 1985) which may be employed in calcium-sensitive bioluminescence detection; or a gene encoding for green fluorescent protein (Sheen et al., 1995; Haseloff et al., 1997; Reichel et al., 1996; Tian et al., 1997; WO 97/41228).

Genes from the maize R gene complex can also be used as screenable markers. The R gene complex in maize encodes a protein that acts to regulate the production of anthocyanin pigments in most seed and plant tissue. Maize strains can have one, or as many as four, R alleles which combine to regulate pigmentation in a developmental and tissue specific manner. Thus, an R gene introduced into such cells will cause the expression of a red pigment, and, if stably incorporated, can be visually scored as a red sector. If a maize line carries dominant alleles for genes encoding for the enzymatic intermediates in the anthocyanin biosynthetic pathway (C2, A1, A2, Bz1 and Bz2), but carries a recessive allele at the R locus, transformation of any cell from that line with R will result in red pigment formation. Exemplary lines include Wisconsin 22 which contains the rg-Stadler allele and TR112, a K55 derivative which is r-g, b, P1. Alternatively, any genotype of maize can be utilized if the C1 and R alleles are introduced together.

Another screenable marker contemplated for use in the present invention is firefly luciferase, encoded by the lux gene. The presence of the lux gene in transformed cells may be detected using, for example, X-ray film, scintillation counting, fluorescent spectrophotometry, low-light video cameras, photon counting cameras or multiwell luminometry. It also is envisioned that this system may be developed for populational screening for bioluminescence, such as on tissue culture plates, or even for whole plant screening. The gene which encodes green fluorescent protein (GFP) is contemplated as a particularly useful reporter gene (Sheen et al., 1995; Haseloff et al., 1997; Reichel et al., 1996; Tian et al., 1997; WO 97/41228). Expression of green fluorescent protein may be visualized in a cell or plant as fluorescence following illumination by particular wavelengths of light.

3. Negative Selectable Markers

Introduction of genes encoding traits that can be selected against may be useful for eliminating minichromosomes from a cell or for selecting against cells which comprise a particular minichromosome. An example of a negative selectable marker which has been investigated is the enzyme cytosine deaminase (Stouggard, 1993). In the presence of this enzyme the compound 5-fluorocytosine is converted to 5-fluorouracil which is toxic to plant and animal cells. Therefore, cells comprising a minichromosome with this gene could be directly selected against. Other genes that encode proteins that render the plant sensitive to a certain compound will also be useful in this context. For example, T-DNA gene 2 from *Agrobacterium tumefaciens* encodes a protein that catalyzes the conversion of α-naphthalene acetamide (NAM) to α-naphthalene acetic acid (NAA) renders plant cells sensitive to high concentrations of NAM (Depicker et al., 1988).

V. Isolation of Centromeres From Plants

The inventors have provided, for the first time, the nucleic acid sequence of a plant centromere. This will allow one of skill in the art to obtain centromere sequences from potentially any species. The inventors specifically provide herein below a number of methods which may be employed to isolate such centromeres.

(i) Utilization of Conserved Sequences

Numerous of the centromere sequences identified by the inventors were also shown by the inventors to be highly conserved (see e.g., Example 5B, Table 3, and Table 4). The novel finding of the inventors that a number of genes reside within the *Arabidopsis* centromere can therefore be used to find synthetic genes in other organisms (i.e., evolutionarily conserved relationships in gene order from species to species). For example, the sequence of each *Arabidopsis* gene can be used to search through sequence databases from other plants. An exemplary list of such sequences that could be used is a sequence given by SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, and SEQ ID NO:21. Also useful would be the genes listed in Tables 3 and 4. Finding identical or similar genes would identify candidates that may reside within or near centromeric regions. Mapping these genes using linked markers would identify potential centromeric regions.

Where hybridization is used to obtain centromere sequences, it may be desirable to use less stringent hybridization conditions to allow formation of a heteroduplex. In these circumstances, one may desire to employ conditions such as about 0.15 M to about 0.9 M salt, at temperatures ranging from about 20° C. to about 55° C. Cross-hybridizing species can thereby be readily identified as positively hybridizing signals with respect to control hybridizations. In any case, it is generally appreciated that conditions can be rendered more stringent by the addition of increasing amounts of formamide, which serves to destabilize the hybrid duplex in the same manner as increased temperature or decreased salt. Thus, hybridization conditions can be readily manipulated, and thus will generally be a method of choice depending on the desired results.

(ii) Identification of Centromere-Associated Characteristics

The second method takes advantage of the unique DNA properties that the inventors have discovered at the *Arabidopsis* centromere and adjacent pericentromere regions. The centromeres are composed of long arrays of 180 bp repeats flanked by regions that are 10–70% retroelements, up to 15% pseudogenes and up to 29% transposons (see FIGS. 12A–T). This is unique to the centromere since retroelements, transposons and pseudogenes are very rare outside the centromere and pericentromere region. Furthermore, gene density decreases from an average of a gene every 4.5 kb on the chromosomal arm down to one in 150 kb at the centromere. This unique centromere composition could be exploited in a number of ways to find centromere regions in other species, for example:

1) Markers specific for retroelements, transposons, repeat DNA elements and pseudogenes can be devised to genetically map regions which are dense with similar elements.

2) The second method involves in situ hybridization, and preferably, fluorescent in situ hybridization (FISH). Fluorescently labeled DNA probes consisting of retroelements, transposons and/or repetitive DNA native to a particular species can be combined with microscopy to identify parts of a chromosome with a similar percentage of DNA elements as that found at the *Arabidopsis* centromere.

3) Utilizing sequence databases, regions of genomes that have increased numbers of repetitive DNA, pseudogenes, retroelements and transposons, similar to the composition of *Arabidopsis* identified by the inventors, can be used to identify regions of an organisms' chromosome that are centromeric.

(iii) Utilization of Centromere-Associated Proteins

The third method involves immunoprecipitating known centromere proteins or kinetochore proteins and analyzing bound DNA. Antibodies specific to centromere proteins can be incubated with proteins extracted from cells. Extracts can be native or previously treated to cross-link DNA to proteins. The antibodies and bound proteins can be purified away from the protein extracts and the DNA isolated. The DNA can then be used as a probe for FISH (as talked about above) or to probe libraries to find neighboring centromere sequences.

1. Centromere-Associated Protein Specific Antibodies

By identifying, for the first time, centromere-associated genes, the inventors have enabled the production of antibodies to the proteins encoded by such centromere-associated genes. The antibodies may be either monoclonal or polyclonal which bind to centromere-associated proteins of the current invention. The centromere-associated protein targets of the antibodies, include proteins which bind to the centromere region. Further, it is specifically contemplated that these centromere-associated protein specific antibodies would allow for the further isolation and characterization of the centromere-associated proteins. For example, proteins may be isolated which are encoded by the centromeres. Recombinant production of such proteins provides a source of antigen for production of antibodies.

Alternatively, the centromere may be used as a ligand to isolate, using affinity methods, centromere binding proteins. Once isolated, these protein can be used as antigens for the production polyclonal and monoclonal antibodies. A variation on this technique has been demonstrated by Rattner (1991), by cloning of centromere-associated proteins through the use of antibodies which bind in the vicinity of the centromere.

Means for preparing and characterizing antibodies are well known in the art (see, e.g., Antibodies: A Laboratory Manual, Cold Spring Harbor Laboratory, 1988; incorporated herein by reference). The methods for generating monoclonal antibodies (mAbs) generally begin along the same lines as those for preparing polyclonal antibodies. Briefly, a polyclonal antibody is prepared by immunizing an animal with an immunogenic composition in accordance with the present invention and collecting antisera from that immunized animal. A wide range of animal species can be used for the production of antisera. Typically the animal used for production of antisera is a rabbit, a mouse, a rat, a hamster, a guinea pig or a goat. A rabbit is a preferred choice for production of polyclonal antibodies because of the ease of handling, maintenance and relatively large blood volume.

As is well known in the art, a given composition may vary in its immunogenicity. It is often necessary therefore to boost the host immune system, as may be achieved by coupling a peptide or polypeptide immunogen to a carrier. Exemplary and preferred carriers are keyhole limpet hemocyanin (KLH) and bovine serum albumin (BSA). Other albumins such as ovalbumin, mouse serum albumin or rabbit serum albumin also can be used as carriers. Means for conjugating a polypeptide to a carrier protein are well known in the art and include glutaraldehyde, m-maleimidobencoyl-N-hydroxysuccinimide ester, carbodimide and bis-biazotized benzidine.

As is also well known in the art, the immunogenicity of a particular immunogen composition can be enhanced by the use of non-specific stimulators of the immune response, known as adjuvants. Exemplary and preferred adjuvants include complete Freund's adjuvant (a non-specific stimulator of the immune response containing killed *Mycobacterium tuberculosis*), incomplete Freund's adjuvants and aluminum hydroxide adjuvant.

The amount of immunogen composition used in the production of polyclonal antibodies varies upon the nature of the immunogen as well as the animal used for immunization. A variety of routes can be used to administer the immunogen (subcutaneous, intramuscular, intradermal, intravenous and intraperitoneal). The production of polyclonal antibodies may be monitored by sampling blood of the immunized animal at various points following immunization. A second, booster, injection also may be given. The process of boosting and titering is repeated until a suitable titer is achieved. When a desired level of immunogenicity is obtained, the immunized animal can be bled and the serum isolated and stored, and/or the animal can be used to generate mAbs.

Monoclonal antibodies may be readily prepared through use of well-known techniques, such as those exemplified in U.S. Pat. No. 4,196,265, incorporated herein by reference. Typically, this technique involves immunizing a suitable animal with a selected immunogen composition, e.g., a purified or partially purified minichromosome-associated protein, polypeptide or peptide. The immunizing composition is administered in a manner effective to stimulate antibody producing cells. Rodents such as mice and rats are preferred animals, however, the use of rabbit, sheep, or frog cells also is possible. The use of rats may provide certain advantages (Goding 1986), but mice are preferred, with the BALB/c mouse being most preferred as this is most routinely used and generally gives a higher percentage of stable fusions.

Following immunization, somatic cells with the potential for producing antibodies, specifically B lymphocytes (B cells), are selected for use in the mAb generating protocol. These cells may be obtained from biopsied spleens, tonsils or lymph nodes, or from a peripheral blood sample. Spleen cells and peripheral blood cells are preferred, the former because they are a rich source of antibody-producing cells that are in the dividing plasmablast stage, and the latter because peripheral blood is easily accessible. Often, a panel of animals will have been immunized and the spleen of animal with the highest antibody titer will be removed and the spleen lymphocytes obtained by homogenizing the spleen with a syringe. Typically, a spleen from an immunized mouse contains approximately $5 \times 10^7$ to $2 \times 10^8$ lymphocytes.

The antibody-producing B lymphocytes from the immunized animal are then fused with cells of an immortal myeloma cell, generally one of the same species as the animal that was immunized. Myeloma cell lines suited for use in hybridoma-producing fusion procedures preferably are non-antibody-producing, have high fusion efficiency, and enzyme deficiencies that render them incapable of growing in certain selective media which support the growth of only the desired fused cells (hybridomas).

Any one of a number of myeloma cells may be used, as are known to those of skill in the art (Goding 1986; Campbell 1984). For example, where the immunized animal is a mouse, one may use P3-X63/Ag8, X63-Ag8.653, NS1/1.Ag 4 1, Sp210-Ag14, FO, NSO/U, MPC-11, MPC11-X45-GTG 1.7 and S194/5XX0 Bul; for rats, one may use R210.RCY3, Y3-Ag 1.2.3, IR983F and 4B210; and U-266, GM1500-GRG2, LICR-LON-HMy2 and UC729-6 are all useful in connection with human cell fusions.

One preferred murine myeloma cell is the NS-1 myeloma cell line (also termed P3-NS-1-Ag4-1), which is readily available from the NIGMS Human Genetic Mutant Cell Repository by requesting cell line repository number GM3573. Another mouse myeloma cell line that may be used is the 8-azaguanine-resistant mouse murine myeloma SP2/0 non-producer cell line.

Methods for generating hybrids of antibody-producing spleen or lymph node cells and myeloma cells usually comprise mixing somatic cells with myeloma cells in a 2:1 ratio, though the ratio may vary from about 20:1 to about 1:1, respectively, in the presence of an agent or agents (chemical or electrical) that promote the fusion of cell membranes. Fusion methods using Sendai virus have been described (Kohler et al., 1975; 1976), and those using polyethylene glycol (PEG), such as 37% (v/v) PEG, (Gefter et al., 1977). The use of electrically induced fusion methods also is appropriate (Goding 1986).

Fusion procedures usually produce viable hybrids at low frequencies, about $1 \times 10^{-6}$ to $1 \times 10^{-8}$. However, this does not pose a problem, as the viable, fused hybrids are differentiated from the parental, unfused cells (particularly the unfused myeloma cells that would normally continue to divide indefinitely) by culturing in a selective medium. The selective medium is generally one that contains an agent that blocks the de novo synthesis of nucleotides in the tissue culture media. Exemplary and preferred agents are aminopterin, methotrexate, and azaserine. Aminopterin and methotrexate block de novo synthesis of both purines and pyrimidines, whereas azaserine blocks only purine synthesis. Where aminopterin or methotrexate is used, the media is supplemented with hypoxanthine and thymidine as a source of nucleotides (HAT medium). Where azaserine is used, the media is supplemented with hypoxanthine.

The preferred selection medium is HAT. Only cells capable of operating nucleotide salvage pathways are able to survive in HAT medium. The myeloma cells are defective in key enzymes of the salvage pathway, e.g., hypoxanthine phosphoribosyl transferase (HPRT), and they cannot survive. The B-cells can operate this pathway, but they have a limited life span in culture and generally die within about two weeks. Therefore, the only cells that can survive in the selective media are those hybrids formed from myeloma and B-cells.

This culturing provides a population of hybridomas from which specific hybridomas are selected. Typically, selection of hybridomas is performed by culturing the cells by single-clone dilution in microtiter plates, followed by testing the individual clonal supernatants (after about two to three weeks) for the desired reactivity. The assay should be sensitive, simple and rapid, such as radioimmunoassays, enzyme immunoassays, cytotoxicity assays, plaque assays, dot immunobinding assays, and the like.

The selected hybridomas would then be serially diluted and cloned into individual antibody-producing cell lines, which clones can then be propagated indefinitely to provide mAbs. The cell lines may be exploited for mAb production in two basic ways. A sample of the hybridoma can be injected (often into the peritoneal cavity) into a histocompatible animal of the type that was used to provide the somatic and myeloma cells for the original fusion. The injected animal develops tumors secreting the specific monoclonal antibody produced by the fused cell hybrid. The body fluids of the animal, such as serum or ascites fluid, can then be tapped to provide mAbs in high concentration. The individual cell lines also could be cultured in vitro, where the mAbs are naturally secreted into the culture medium from which they can be readily obtained in high concentrations. mAbs produced by either means may be further purified, if desired, using filtration, centrifugation and various chromatographic methods such as HPLC or affinity chromatography.

2. ELISAs and Immunoprecipitation

ELISAs may be used in conjunction with the invention, for example, in identifying expression of a centromere-associated protein in a candidate centromere sequence. Such an assay could thereby facilitate the isolation of centromeres from species other than *Arabidopsis*. By identifying conserved, centromere-associated coding sequences, the inventors have provided the essential tools for such a screen.

In an ELISA assay, proteins or peptides comprising minichromosome-encoded protein antigen sequences are immobilized onto a selected surface, preferably a surface exhibiting a protein affinity such as the wells of a polystyrene microtiter plate. After washing to remove incompletely adsorbed material, it is desirable to bind or coat the assay plate wells with a nonspecific protein that is known to be antigenically neutral with regard to the test antisera such as bovine serum albumin (BSA), casein or solutions of milk powder. This allows for blocking of nonspecific adsorption sites on the immobilizing surface and thus reduces the background caused by nonspecific binding of antisera onto the surface.

After binding of antigenic material to the well, coating with a non-reactive material to reduce background, and washing to remove unbound material, the immobilizing surface is contacted with the antisera or clinical or biological extract to be tested in a manner conducive to immune complex (antigen/antibody) formation. Such conditions preferably include diluting the antisera with diluents such as BSA, bovine gamma globulin (BGG) and phosphate buffered saline (PBS)/Tween®. These added agents also tend to assist in the reduction of nonspecific background. The layered antisera is then allowed to incubate for from about 2 to about 4 hours, at temperatures preferably on the order of about 25° to about 27° C. Following incubation, the antisera-contacted surface is washed so as to remove non-immunocomplexed material. A preferred washing procedure includes washing with a solution such as PBS/Tween®, or borate buffer.

Following formation of specific immunocomplexes between the test sample and the bound antigen, and subsequent washing, the occurrence and even amount of immunocomplex formation may be determined by subjecting same to a second antibody having specificity for the first. To provide a detecting means, the second antibody will preferably have an associated enzyme that will generate color or light development upon incubating with an appropriate chromogenic substrate. Thus, for example, one will desire to contact and incubate the antisera-bound surface with a urease or peroxidase-conjugated anti-human IgG for a period of time and under conditions which favor the development of immunocomplex formation (e.g., incubation for 2 hours at room temperature in a PBS-containing solution).

After incubation with the second enzyme-tagged antibody, and subsequent to washing to remove unbound material, the amount of label is quantified by incubation with a chromogenic substrate such as urea and bromocresol purple or 2,2'-azino-di-(3-ethyl benzthiazoline)-6-sulfonic acid (ABTS) and $H_2O_2$, in the case of peroxidase as the enzyme label. Quantitation is then achieved by measuring the degree of color generation, e.g., using a visible spectra spectrophotometer.

3. Western Blots

Centromere-associated antibodies may find use in immunoblot or western blot analysis, for example, for the identification of proteins immobilized onto a solid support matrix, such as nitrocellulose, nylon or combinations thereof. In conjunction with immunoprecipitation, followed by gel electrophoresis, these may be used as a single step reagent for use in detecting antigens against which secondary reagents used in the detection of the antigen cause an adverse background. This is especially useful when the antigens studied are immunoglobulins (precluding the use of immunoglobulins binding bacterial cell wall components), the antigens studied cross-react with the detecting agent, or they migrate at the same relative molecular weight as a cross-reacting signal.

Immunologically-based detection methods for use in conjunction with Western blotting include enzymatically-, radiolabel-, or fluorescently-tagged secondary antibodies against the protein moiety are considered to be of particular use in this regard.

(iv) Genetic Mapping Based Approaches

The genetic mapping techniques outlined here for the identification of centromeres in *Arabidopsis* may find use in other species. In one aspect, this may comprise actual use of the mapping data provided herein, based on synteny between *Arabidopsis* chromosomes and those of other species. Further, new mapping data may be obtained using the techniques described herein. For example, in any plant that makes tetrads, the detailed methodology described herein for tetrad analysis could be used for the isolation of centromeres. Briefly, tetrad analysis measures the recombination frequency between genetic makers and a centromere by analyzing all four products of individual meiosis. A particular advantage arises from the quartet (qrt I) mutation in *Arabidopsis*, which causes the four products of pollen mother cell meiosis in *Arabidopsis* to remain attached.

Several naturally occurring plant species in addition to *Arabidopsis* are known to release pollen clusters, including water lilies, cattails, heath (*Ericaceae* and *Epacridceae*), evening primrose (*Onagraceae*), sundews (*Droseraceae*), orchids (*Orchidaceae*), and acacias (*Mimosaceae*) (Preuss 1994, Smyth 1994). However, none of these species has been developed into an experimental system, limiting their use for genetic analysis. However, it is contemplated by the inventors that the cloning and introduction of the quartet mutation, or an antisense copy of a non-mutated Quartet gene, could allow the use of tetrad analysis in potentially any species.

Southern genomic DNA blots in combination with RFLP analysis may be used to map centromeres with a high degree of resolution. The stored seedling tissue provides the necessary amount of DNA for analysis of the restriction fragments. Southern blots are hybridized to probes labeled by radioactive or non-radioactive methods.

It may, in many cases, be desired to identify new polymorphic DNA markers which are closely linked to the target region. In some cases this can be readily done. For example, in many plant genomes, a polymorphic Sau3A site can be found for about every 8 to 20 kB surveyed. Subtractive methods are available for identifying such polymorphisms (Rosenberg et al., 1994), and these subtractions may be performed using DNA from selected, centromeric YAC or BAC clones. Screens for RFLP markers potentially linked to centromeres also can be performed using DNA fragments from a centromere-linked YAC clone to probe blots of genomic DNA from a target organism that has been digested with a panel of restriction enzymes.

To be certain that an entire centromeric region has been cloned, clones or a series of clones, are identified that hybridize to markers on either side of each centromere. These effects can be complicated by the presence of repetitive DNA in the centromere, as well as by the potential instability of centromere clones. Thus, identification of large clones with unique sequences that will serve as useful probes simplifies a chromosome walking strategy.

Blot hybridization allows comparison of the structure of the clones with that of genomic DNA, and thus determines whether the clones have suffered deletions or rearrangements. The centromeric clones identified are useful for hybridization experiments that can be used to determine whether they share common sequences, whether they localize in situ to the cytologically defined centromeric region, and whether they contain repetitive sequences thought to map near *Arabidopsis* centromeres (Richards et al., 1991; Maluszynska et al., 1991).

Exemplary methods for conducting PFGE and YAC genome analysis described (Ecker, 1990). A large insert YAC library for genome mapping in *Arabidopsis thaliana* was described in Creusot (1995). The analysis of clones carrying repeated DNA sequences in two YAC libraries of *Arabidopsis thaliana* DNA was discussed by Schmidt et al., (1994). The construction and characterization of a yeast artificial chromosome library of *Arabidopsis* was described by Grill and Somerville (1991).

A particularly useful type of clone is the bacterial artificial chromosome (BAC), as data has suggested that YAC clones may sometimes not span centromeres (Willard, 1997). The construction and characterization of a bacterial artificial chromosome library from, for example, *Arabidopsis thaliana* has been described (Choi et al., 1995). The complementation of plant mutants with large genomic DNA fragments can be achieved using transformation-competent minichromosome vectors, thereby speeding positional cloning. (Liu et al., 1999). The construction and characterization of the IGF *Arabidopsis* BAC library was described by Mozo et al., (1998.). A complete BAC-based physical map of the *Arabidopsis thaliana* genome has been described (Mozo et al., 1998).

VI. Site Specific Integration and Excision of Nucleic Acid Segments

It is specifically contemplated by the inventors that one could employ techniques for the site-specific integration or excision of nucleic acid segments for the construction of minichromosomes (see, e.g., Example 8B, below). Such techniques also could be used for the site-specific integration or excision of transgenes which are introduced into a plant, including minichromosome vectors.

Site-specific integration or excision of nucleic acid molecules can be achieved by means of homologous recombination (see, for example, U.S. Pat. No. 5,527,695, specifically incorporated herein by reference in its entirety). Homologous recombination is a reaction between any pair of DNA sequences having a similar sequence of nucleotides, where the two sequences interact (recombine) to form a new recombinant DNA species. The frequency of homologous recombination increases as the length of the shared nucleotide DNA sequences increases, and is higher with linearized plasmid molecules than with circularized plasmid molecules. Homologous recombination can occur between two DNA sequences that are less than identical, but the recombination frequency declines as the divergence between the two sequences increases.

Introduced DNA sequences can be targeted via homologous recombination by linking a DNA molecule of interest to sequences sharing homology with endogenous sequences of the host cell. Once the DNA enters the cell, the two homologous sequences can interact to insert the introduced DNA at the site where the homologous genomic DNA sequences were located. Therefore, the choice of homologous sequences contained on the introduced DNA will determine the site where the introduced DNA is integrated via homologous recombination. For example, if the DNA sequence of interest is linked to DNA sequences sharing homology to a single copy gene of a host plant cell, the DNA sequence of interest will be inserted via homologous recombination at only that single specific site. However, if the DNA sequence of interest is linked to DNA sequences sharing homology to a multicopy gene of the host eukaryotic cell, then the DNA sequence of interest can be inserted via homologous recombination at each of the specific sites where a copy of the gene is located.

DNA can be inserted into a host chromosome or vector by a homologous recombination reaction involving either a single reciprocal recombination (resulting in the insertion of the entire length of the introduced DNA) or through a double reciprocal recombination (resulting in the insertion of only the DNA located between the two recombination events). For example, if one wishes to insert a foreign gene into the genomic site where a selected gene is located, the introduced DNA should contain sequences homologous to the selected gene. A single homologous recombination event would then result in the entire introduced DNA sequence being inserted into the selected gene. Alternatively, a double recombination event can be achieved by flanking each end of the DNA sequence of interest (the sequence intended to be inserted into the genome) with DNA sequences homologous to the selected gene. A homologous recombination event involving each of the homologous flanking regions will result in the insertion of the foreign DNA. Thus only those DNA sequences located between the two regions sharing genomic homology become integrated into the genome.

Although introduced sequences can be targeted for insertion into a specific site via homologous recombination, in higher eukaryotes homologous recombination is a relatively rare event compared to random insertion events. In plant cells, foreign DNA molecules find homologous sequences in the cell's genome and recombine at a frequency of approximately $0.5-4.2\times10^{-4}$. Thus any transformed cell that contains an introduced DNA sequence integrated via homologous recombination will also likely contain numerous copies of randomly integrated introduced DNA sequences. Therefore, it may be desirable to use more precise mechanisms for site-specific recombination. A preferred manner for carrying out site-specific recombination comprises use of a site-specific recombinase system. In general, a site specific recombinase system consists of three elements: two pairs of DNA sequence (first and second site-specific recombination sequences) and a specific enzyme (the site-specific recombinase). The site-specific recombinase will catalyze a recombination reaction only between two site-specific recombination sequences.

A number of different site specific recombinase systems could be employed in accordance with the instant invention, including, but not limited to, the Cre/lox system of bacteriophage P1 (Hoess et al., 1982; U.S. Pat. No. 5,658,772, specifically incorporated herein by reference in its entirety), the FLP/FRT system of yeast (Golic and Lindquist, 1989), the Gin recombinase of phage Mu (Maeser and Kahmann, 1991), the Pin recombinase of *E. coli* (Enomoto et al., 1983), the recombinase encoded by the sre gene (ORF469) and which is capable of mediating integration of the R4 phage genome. (Matsuura et al., 1996), the site-specific recombinase encoded by pinD of *Shigella dysenteriae* (Tominaga, 1997), the site-specific recombinase encoded in the major pathogenicity island of *Salmonella typhi* (Zhang et al., 1997) the Int-B13 site-specific recombinase of the bacteriophage P4 integrase family (Ravatn et al., 1998), as well as the and the R/RS system of the pSR1 plasmid (Araki et al., 1992). The bacteriophage P1 Cre/lox and the yeast FLP/FRT systems constitute two particularly useful systems for site specific recombination. In these systems, a recombinase (Cre or FLP) will interact specifically with its respective site-specific recombination sequence (lox or FRT, respectively) to invert or excise the intervening sequences. The sequence for each of these two systems is relatively short (34 bp for lox and 47 bp for FRT) and therefore, convenient for use with transformation vectors.

The FLP/FRT recombinase system has been demonstrated to function efficiently in plant cells, but could also be used in, for example, a bacterial cell or in vitro. The performance of the FLP/FRT system indicates that FRT site structure, and amount of the FLP protein present affect excision activity. In general, short incomplete FRT sites lead to higher accumulation of excision products than the complete full-length FRT sites. The systems can catalyze both intra- and intermolecular reactions, indicating their utility for DNA excision as well as integration reactions. The recombination reaction is reversible and this reversibility can compromise the efficiency of the reaction in each direction. Altering the structure of the site-specific recombination sequences is one approach to remedying this situation. The site-specific recombination sequence can be mutated in a manner that the product of the recombination reaction is no longer recognized as a substrate for the reverse reaction, thereby stabilizing the integration or excision event.

In the Cre-lox system, discovered in bacteriophage P1, recombination between loxP sites occurs in the presence of the Cre recombinase (see, e.g., U.S. Pat. No. 5,658,772, specifically incorporated herein by reference in its entirety). This system has been utilized to excise a gene located between two lox sites which had been introduced into a yeast genome (Sauer, 1987). Cre was expressed from an inducible yeast GAL1 promoter and this Cre gene was located on an autonomously replicating yeast vector.

Since the lox site is an asymmetrical nucleotide sequence, lox sites on the same DNA molecule can have the same or opposite orientation with respect to each other. Recombination between lox sites in the same orientation results in a deletion of the DNA Segment located between the two lox sites and a connection between the resulting ends of the original DNA molecule. The deleted DNA segment forms a circular molecule of DNA. The original DNA molecule and the resulting circular molecule each contain a single lox site. Recombination between lox sites in opposite orientations on the same DNA molecule result in an inversion of the nucleotide sequence of the DNA segment located between the two lox sites. In addition, reciprocal exchange of DNA segments proximate to lox sites located on two different DNA molecules can occur. All of these recombination events are catalyzed by the product of the Cre coding region.

VII. Transformed Host Cells and Transgenic Plants

Methods and compositions for transforming a bacterium, a yeast cell, a plant cell, or an entire plant with one or more minichromosomes are further aspects of this disclosure. A transgenic bacterium, yeast cell, plant cell or plant derived from such a transformation process or the progeny and seeds from such a transgenic plant also are further embodiments of the invention.

Means for transforming bacteria and yeast cells are well known in the art. Typically, means of transformation are similar to those well known means used to transform other bacteria or yeast such as *E. coli* or *Saccharomyces cerevisiae*. Methods for DNA transformation of plant cells include *Agrobacterium*-mediated plant transformation, protoplast transformation (as used herein "protoplast transformation" includes PEG-mediated transformation, electroporation and protoplast fusion transformation), gene transfer into pollen, injection into reproductive organs, injection into immature embryos and particle bombardment. Each of these methods has distinct advantages and disadvantages. Thus, one particular method of introducing genes into a particular plant strain may not necessarily be the most effective for another plant strain, but it is well known in the art which methods are useful for a particular plant strain.

There are many methods for introducing transforming DNA segments into cells, but not all are suitable for delivering DNA to plant cells. Suitable methods are believed to include virtually any method by which DNA can be introduced into a cell, such as by *Agrobacterium* infection, direct delivery of DNA such as, for example, by PEG-mediated transformation of protoplasts (Omirulleh et al., 1993), by desiccation/inhibition-mediated DNA uptake, by electroporation, by agitation with silicon carbide fibers, by acceleration of DNA coated particles, etc. In certain embodiments, acceleration methods are preferred and include, for example, microprojectile bombardment and the like.

Technology for introduction of DNA into cells is well-known to those of skill in the art. Four general methods for delivering a gene into cells have been described: (1) chemical methods (Graham et al., 1973; Zatloukal et al., 1992); (2) physical methods such as microinjection (Capecchi, 1980), electroporation (Wong et al., 1982; Fromm et al., 1985; U.S. Pat. No. 5,384,253) and the gene gun (Johnston et al., 1994; Fynan et al., 1993); (3) viral vectors (Clapp 1993; Lu et al., 1993; Eglitis et al., 1988a; 1988b); and (4) receptor-mediated mechanisms (Curiel et al., 1991; 1992; Wagner et al., 1992).

(i) Electroporation

The application of brief, high-voltage electric pulses to a variety of animal and plant cells leads to the formation of nanometer-sized pores in the plasma membrane. DNA is taken directly into the cell cytoplasm either through these pores or as a consequence of the redistribution of membrane components that accompanies closure of the pores. Electroporation can be extremely efficient and can be used both for transient expression of cloned genes and for establishment of cell lines that carry integrated copies of the gene of interest. Electroporation, in contrast to calcium phosphate-mediated transfection and protoplast fusion, frequently gives rise to cell lines that carry one, or at most a few, integrated copies of the foreign DNA.

The introduction of DNA by means of electroporation, is well-known to those of skill in the art. In the method, certain cell wall-degrading enzymes, such as pectin-degrading enzymes, are employed to render the target recipient cells more susceptible to transformation by electroporation than untreated cells. Alternatively, recipient cells are made more susceptible to transformation, by mechanical wounding. To effect transformation by electroporation one may employ either friable tissues such as a suspension culture of cells, or embryogenic callus, or alternatively, one may transform immature embryos or other organized tissues directly. One would partially degrade the cell walls of the chosen cells by exposing them to pectin-degrading enzymes (pectolyases) or mechanically wounding in a controlled manner. Such cells would then be recipient to DNA transfer by electroporation, which may be carried out at this stage, and transformed cells then identified by a suitable selection or screening protocol dependent on the nature of the newly incorporated DNA.

(ii) Microprojectile Bombardment

A further advantageous method for delivering transforming DNA segments to plant cells is microprojectile bombardment. In this method, particles may be coated with nucleic acids and delivered into cells by a propelling force. Exemplary particles include those comprised of tungsten, gold, platinum, and the like.

An advantage of microprojectile bombardment, in addition to it being an effective means of reproducibly stably transforming moncots, is that neither the isolation of protoplasts (Cristou et al., 1988) nor the susceptibility to *Agrobacterium* infection is required. An illustrative embodiment of a method for delivering DNA into maize cells by acceleration is a Biolistic Particle Delivery System, which can be used to propel particles coated with DNA or cells through a screen, such as stainless steel or Nytex screen, onto a filter surface covered with plant cells cultured in suspension. The screen disperses the particles so that they are not delivered to the recipient cells in large aggregates. It is believed that a screen intervening between the projectile apparatus and the cells to be bombarded reduces the size of projectiles aggregate and may contribute to a higher frequency of transformation by reducing damage inflicted on the recipient cells by projectiles that are too large.

For the bombardment, cells in suspension are preferably concentrated on filters or solid culture medium. Alternatively, immature embryos or other target cells may be arranged on solid culture medium. The cells to be bombarded are positioned at an appropriate distance below the macroprojectile stopping plate. If desired, one or more screens also are positioned between the acceleration device and the cells to be bombarded. Through the use of techniques set forth herein one may obtain up to 1,000 or more foci of cells transiently expressing a marker gene. The number of cells in a focus which express the exogenous gene product 48 hours post-bombardment often range from 1 to 10 and average 1 to 3.

In bombardment transformation, one may optimize the prebombardment culturing conditions and the bombardment parameters to yield the maximum numbers of stable transformants. Both the physical and biological parameters for bombardment are important in this technology. Physical factors are those that involve manipulating the DNA/ microprojectile precipitate or those that affect the flight and velocity of either the macro- or microprojectiles. Biological factors include all steps involved in manipulation of cells before and immediately after bombardment, the osmotic adjustment of target cells to help alleviate the trauma associated with bombardment, and also the nature of the transforming DNA, such as linearized DNA or intact supercoiled plasmids. It is believed that pre-bombardment manipulations are especially important for successful transformation of immature embryos.

Accordingly, it is contemplated that one may wish to adjust various of the bombardment parameters in small scale studies to fully optimize the conditions. One may particularly wish to adjust physical parameters such as gap distance, flight distance, tissue distance, and helium pressure. One also may minimize the trauma reduction factors (TRFs) by modifying conditions which influence the physiological state of the recipient cells and which may therefore influence transformation and integration efficiences. For example, the osmotic state, tissue hydration and the subculture stage or cell cycle of the recipient cells may be adjusted for optimum transformation. The execution of other routine adjustments will be known to those of skill in the art in light of the present disclosure.

(iii) *Agrobacterium*-Mediated Transfer

*Agrobacterium*-mediated transfer is a widely applicable system for introducing genes into plant cells because the DNA can be introduced into whole plant tissues, thereby bypassing the need for regeneration of an intact plant from a protoplast. The use of *Agrobacterium*-mediated plant integrating vectors to introduce DNA into plant cells is well known in the art. See, for example, the methods described (Fraley et al., 1985; Rogers et al., 1987). Advances in *Agrobacterium*-mediated transfer now allow introduction of large segments of DNA (Hamilton, 1997; Hamilton et al., 1996).

Using conventional transformation vectors, chromosomal integration is required for stable inheritance of the foreign DNA. However, the vector described herein may be used for transformation with or without integration, as the centromere function required for stable inheritance is encoded within the minichromosome. In particular embodiments, transformation events in which the minichromosome is not chromosomally integrated may be perfect, in that problems with site-specific variations in expression and insertional mutagenesis may be avoided.

The integration of the Ti-DNA is a relatively precise process resulting in few rearrangements. The region of DNA to be transferred is defined by the border sequences, and intervening DNA is usually inserted into the plant genome as described (Spielmann et al., 1986; Jorgensen et al., 1987). Modern *Agrobacterium* transformation vectors are capable of replication in *E. coli* as well as *Agrobacterium*, allowing for convenient manipulations as described (Klee et al., 1985). Moreover, recent technological advances in vectors for *Agrobacterium*-mediated gene transfer have improved the arrangement of genes and restriction sites in the vectors to facilitate construction of vectors capable of expressing various polypeptide coding genes. The vectors described (Rogers et al., 1987), have convenience multi-linker regions flanked by a promoter and a polyadenylation site for direct expression of inserted polypeptide coding genes and are suitable for present purposes. In addition, *Agrobacterium* containing both armed and disarmed Ti genes can be used for the transformation. In those plant strains where *Agrobacterium*-mediated transformation is efficient, it is the method of choice because of the facile and defined nature of the gene transfer.

*Agrobacterium*-mediated transformation of leaf disks and other tissues such as cotyledons and hypocotyls appears to be limited to plants that *Agrobacterium* naturally infects. *Agrobacterium*-mediated transformation is most efficient in dictoyledonous plants. Few monocots appear to be natural hosts for *Agrobacterium*, although transgenic plants have been produced in asparagus and more significantly in maize using *Agrobacterium* vectors as described (Bytebier et al., 1987; U.S. Pat. No. 5,591,616, specifically incorporated herein by reference). Therefore, commercially important cereal grains such as rice, corn, and wheat must usually be transformed using alternative methods. However, as mentioned above, the transformation of asparagus using *Agrobacterium* also can be achieved (see, for example, Bytebier et al., 1987). *Acrogacterium*-mediated transfer may be made more efficient through the use of a mutant that is defective in integration of the *Agrobacterium* T-DNA but competent for delivery of the DNA into the cell (Mysore et al., 2000a). Additionally, even in *Arabidopsis* ecotypes and mutants that are recalcitrant to *Agrobacterium* root transformation, germline transformation may be carried out (Mysore et al., 2000b)

A transgenic plant formed using *Agrobacterium* transformation methods typically contains a single gene on one chromosome. Such transgenic plants can be referred to as being hemizyogous for the added gene. A more accurate name for such a plant is an independent segregant, because each transformed plant represents a unique T-DNA integration event.

Most preferred is a transgenic plant that is homozygous for the added foreign DNA; i.e., a transgenic plant that contains two copies of a transgene, one gene at the same locus on each chromosome of a chromosome pair. A homozygous transgenic plant can be obtained by sexually mating (selfing) an independent segregant transgenic plant that contains a single added transgene, germinating some of the seed produced and analyzing the resulting plants produced for enhanced activity relative to a control (native, non-transgenic) or an independent segregant transgenic plant.

Even more preferred is a plant in which the minichromosome has not been chromosomally integrated. Such a plant may be termed 2n+x, where 2n is the diploid number of chromosomes and where x is the number of minichromosomes. Initially, transformants may be 2n+1, i.e. having 1 additional minichromosome. In this case, it may be desirable to self the plant or to cross the plant with another 2n+1 plant to yield a plant which is 2n+2. The 2n+2 plant is preferred in that it is expected to pass the minichromosome through meiosis to all its offspring.

It is to be understood that two different transgenic plants also can be mated to produce offspring that contain two independently segregating added, exogenous minichromosomes. Selfing of appropriate progeny can produce plants that are homozygous for both added, exogenous minichromosomes that encode a polypeptide of interest. Backcrossing to a parental plant and out-crossing with a non-transgenic plant also are contemplated.

(iv) Other Transformation Methods

Transformation of plant protoplasts can be achieved using methods based on calcium phosphate precipitation, polyethylene glycol treatment, electroporation, and combinations of these treatments (see, e.g., Potrykus et al., 1985; Lorz et al., 1985; Fromm et al., 1986; Uchimiya et al., 1986; Callis et al., 1987; Marcotte et al., 1998).

Application of these systems to different plant strains for the purpose of making transgenic plants depends upon the ability to regenerate that particular plant strain from protoplasts. Illustrative methods for the regeneration of cereals from protoplasts are described (Fujimura et al., 1985; Toriyama et al., 1986; Yamada et al., 1986; Abdullah et al., 1986).

To transform plant strains that cannot be successfully regenerated from protoplasts, other ways to introduce DNA into intact cells or tissues can be utilized. For example, regeneration of cereals from immature embryos or explants can be effected as described (Vasil 1988). In addition, "particle gun" or high-velocity microprojectile technology can be utilized (Vasil 1992).

Using that latter technology, DNA is carried through the cell wall and into the cytoplasm on the surface of small metal particles as described (Klein et al., 1987; Klein et al., 1988; McCabe et al., 1988). The metal particles penetrate through several layers of cells and thus allow the transformation of cells within tissue explants.

Protoplast fusion, for example, could be used to integrate a minichromosome constructed in a host cell, such as a yeast cell, and then fuse those cells to plant protoplasts. The chromosomes lacking plant centromeres (such as yeast chromosomes in this example) would be eliminated by the plant cell while the minichromosome would be stably maintained. Numerous examples of protocols for protoplast fusion that could be used with the invention have been described (see, e.g., Negrutiu et al., 1992, and Peterson).

Liposome fusion could be used to introduce a recombinant construct comprising a centromere, such as a minichromosome, by, for example, packaging the recombinant construct into small droplets of lipids (liposomes) and then fusing these liposomes to plant protoplasts thus delivering the AC into the plant cell (see Lurqui and Rollo, 1993).

VIII. Exogenous Genes for Expression in Plants

One particularly important advance of the present invention is that it provides methods and compositions for expression of exogeneous genes in plant cells. One advance of the constructs of the current invention is that they enable the introduction of multiple genes, potentially representing an entire biochemical pathway. Significantly, the current invention allows for the transformation of plant cells with a minichromosome comprising a number of structural genes. Another advantage is that more than one minichromosome could be introduced, allowing combinations of genes to be moved and shuffled. Moreover, the ability to eliminate a minichromosome from a plant would provide additional flexibility, making it possible to alter the set of genes contained within a plant. Further, by using site-specific recombinases, it should be possible to add genes to an existing minichromosome once it is in a plant.

Added genes often will be genes that direct the expression of a particular protein or polypeptide product, but they also may be non-expressible DNA segments, e.g., transposes such as Ds that do not direct their own transposition. As used herein, an "expressible gene" is any gene that is capable of being transcribed into RNA (e.g., mRNA, antisense RNA, etc.) or translated into a protein, expressed as a trait of interest, or the like, etc., and is not limited to selectable, screenable or non-selectable marker genes. The inventors also contemplate that, where both an expressible gene that is not necessarily a marker gene is employed in combination with a marker gene, or may employ the separate genes on either the same or different DNA segments for transformation. In the latter case, the different vectors are delivered concurrently to recipient cells to maximize cotransformation.

The choice of the particular DNA segments to be delivered to the recipient cells often will depend on the purpose of the transformation. One of the major purposes of transformation of crop plants is to add some commercially desirable, agronomically important traits to the plant. Such traits include, but are not limited to, herbicide resistance or tolerance; insect resistance or tolerance; disease resistance or tolerance (viral, bacterial, fungal, nematode); stress tolerance and/or resistance, as exemplified by resistance or tolerance to drought, heat, chilling, freezing, excessive moisture, salt stress; oxidative stress; increased yields; food content and makeup; physical appearance; male sterility; drydown; standability; prolificacy; starch quantity and quality; oil quantity and quality; protein quality and quantity; amino acid composition; and the like. One may desire to incorporate one or more genes conferring any such desirable trait or traits, such as, for example, a gene or genes encoding herbicide resistance.

In certain embodiments, the present invention contemplates the transformation of a recipient cell with minichromosomes comprising more than one exogenous gene. As used herein, an "exogeneous gene," is a gene not normally found in the host genome in an identical context. By this, it is meant that the gene may be isolated from a different species than that of the host genome, or alternatively, isolated from the host genome but operably linked to one or more regulatory regions which differ from those found in the unaltered, native gene. Two or more exogenous genes also can be supplied in a single transformation event using either distinct transgene-encoding vectors, or using a single vector incorporating two or more gene coding sequences. For example, plasmids bearing the bar and aroA expression units in either convergent, divergent, or collinear orientation, are considered to be particularly useful. Further preferred combinations are those of an insect resistance gene, such as Bt gene, along with a protease inhibitor gene such as pinII, or the use of bar in combination with either of the above genes. Of course, any two or more transgenes of any description, such as those conferring herbicide, insect, disease (viral, bacterial, fungal, nematode) or drought resistance, male sterility, drydown, standability, prolificacy, starch properties, oil quantity and quality, or those increasing yield or nutritional quality may be employed as desired.

(i) Herbicide Resistance

The genes encoding phosphinothricin acetyltransferase (bar and pat), glyphosate tolerant EPSP synthase genes, the glyphosate degradative enzyme gene gox encoding glyphosate oxidoreductase, deh (encoding a dehalogenase enzyme that inactivates dalapron), herbicide resistant (e.g., sulfonylurea and imidazolinone) acetolacetate synthase, and bxn genes (encoding a nitrilase enzyme that degrades bromozynil) are good examples of herbicide resistant genes for use in transformation. The bar and pat genes code for an enzyme, phosphinothricin acetyltransferase (PAT), which inactivates the herbicide phosphinothricin and prevents this compound from inhibiting glutamine synthetase enzymes. The enzyme 5-enolpyruvylshikimate 3-phosphate synthase (EPSP Synthase), is normally inhibited by the herbicide N-(phosphonomethyl)glycine (glyphosate). However, genes are known that encode glyphosate-resistant EPSP synthase enzymes. These genes are particularly contemplated for use in plant transformation. The deh gene encodes the enzyme dalapon dehalogenase and confers resistance to the herbicide dalapon. The bxn gene codes for a specific nitrilase enzyme that converts bromoxynil to a non-herbicideal degradation product.

(ii) Insect Resistance

Potential insect resistance genes that can be introduced *Bacillus thuringiensis* crystal toxin genes or Bt genes (Watrud et al., 1985). By genes may provide resistance to lepidopteran or coleopteran pests such as European Corn Borer (ECB). Preferred Bt toxin genes for use in such embodiments include the CryIA(b) and CryIA(c) genes. Endotoxin genes from other species of *B. thuringiensis* which affect insect growth or development also may be employed in this regard.

It is contemplated that preferred Bt genes for use in the transformation protocols disclosed herein will be those in which the coding sequence has been modified to effect increased expression in plants, and more particularly, in monocot plants. Means for preparing synthetic genes as well known in the art and are disclosed in, for example, U.S. Pat. No. 5,500,365 and U.S. Pat. No. 5,689,052, each of the disclosures of which are specifically incorporated herein by reference in their entirety. Examples of such modified Bt toxin genes include a synthetic Bt (CryIA(b) gene (Perlak et al., 1991), and the synthetic CryIA(c) gene termed 1800b (PCT Application WO 95/06128). Some examples of other Bt toxin genes known to those of skill in the art are given in Table 1 below.

TABLE 1

*Bacillus thuringiensis* δ-Endotoxin Genes[a]

| New Nomenclature | Old Nomenclature | GenBank Accession |
|---|---|---|
| Cry1Aa | CryIA(a) | M11250 |
| Cry1Ab | CryIA(b) | M13898 |
| Cry1Ac | CryIA(c) | M11068 |
| Cry1Ad | CryIA(d) | M73250 |
| Cry1Ae | CryIA(e) | M65252 |
| Cry1Ba | CryIB | X06711 |
| Cry1Bb | ET5 | L32020 |
| Cry1Bc | PEG5 | Z46442 |
| Cry1Bd | CryEl | U70726 |
| Cry1Ca | CryIC | X07518 |
| Cry1Cb | CryIC(b) | M97880 |
| Cry1Da | CryID | X54160 |
| Cry1Db | PrtB | Z22511 |
| Cry1Ea | CryIE | X53985 |
| Cry1Eb | CryIE(b) | M73253 |
| Cry1Fa | CryIF | M63897 |
| Cry1Fb | PrtD | Z22512 |
| Cry1Ga | PrtA | Z22510 |
| Cry1Gb | CryH2 | U70725 |
| Cry1Ha | PrtC | Z22513 |
| Cry1Hb |  | U35780 |
| Cry1Ia | CryV | X62821 |

TABLE 1-continued

*Bacillus thuringiensis* δ-Endotoxin Genes[a]

| New Nomenclature | Old Nomenclature | GenBank Accession |
|---|---|---|
| Cry1Ib | CryV | U07642 |
| Cry1Ja | ET4 | L32019 |
| Cry1Jb | ET1 | U31527 |
| Cry1K |  | U28801 |
| Cry2Aa | CryIIA | M31738 |
| Cry2Ab | CryIIB | M23724 |
| Cry2Ac | CryIIC | X57252 |
| Cry3A | CryIIIA | M22472 |
| Cry3Ba | CryIIIB | X17123 |
| Cry3Bb | CryIIIB2 | M89794 |
| Cry3C | CryIIID | X59797 |
| Cry4A | CryIVA | Y00423 |
| Cry4B | CryIVB | X07423 |
| Cry5Aa | CryVA(a) | L07025 |
| Cry5Ab | CryVA(b) | L07026 |
| Cry6A | CryVIA | L07022 |
| Cry6B | CryVIB | L07024 |
| Cry7Aa | CryIIIC | M64478 |
| Cry7Ab | CryIIICb | U04367 |
| Cry8A | CryIIIE | U04364 |
| Cry8B | CryIIIG | U04365 |
| Cry8C | CryIIIF | U04366 |
| Cry9A | CryIG | X58120 |
| Cry9B | CryIX | X75019 |
| Cry9C | CryIH | Z37527 |
| Cry10A | CryIVC | M12662 |
| Cry11A | CryIVD | M31737 |
| Cry11B | Jeg80 | X86902 |
| Cry12A | CryVB | L07027 |
| Cry13A | CryVC | L07023 |
| Cry14A | CryVD | U13955 |
| Cry15A | 34kDa | M76442 |
| Cry16A | cbm71 | X94146 |
| Cry17A | cbm71 | X99478 |
| Cry18A | CryBP1 | X99049 |
| Cry19A | Jeg65 | Y08920 |
| Cyt1Aa | CytA | X03182 |
| Cyt1Ab | CytM | X98793 |
| Cyt2A | CytB | Z14147 |
| Cyt2B | CytB | U52043 |

[a]Adapted from epunix.biols.susx.ac.uk/Home/Neil_Crickmore/Bt/index.html

*Adapted from: epunix.biols.susx.ac.uk/Home/Neil_Crickmore/Bt/index.html

Protease inhibitors also may provide insect resistance (Johnson et al., 1989), and will thus have utility in plant transformation. The use of protease inhibitor II gene, pinII, from tomato or potato is envisioned to be particularly useful. Even more advantageous is the use of a pinII gene in combination with a Bt toxin gene, the combined effect of which has been discovered to produce synergistic insecticidal activity. Other genes which encode inhibitors of the insect's digestive system, or those that encode enzymes or co-factors that facilitate the production of inhibitors, also may be useful. This group may be exemplified by oryzacystatin and amylase inhibitors such as those from wheat and barley.

Also, genes encoding lectins may confer additional or alternative insecticide properties. Lectins (originally termed phytohemagglutinins) are multivalent carbohydrate-binding proteins which have ability to agglutinate red blood cells from a range of species. Lectins have been identified recently as insecticidal agents with activity against weevils, ECB and rootworm (Murdock et al., 1990; Czapla & Lang, 1990). Lectin genes contemplated to be useful include, for example, barley and wheat germ agglutinin (WGA) and rice lectins (Gatehouse et al., 1984), with WGA being preferred.

Genes controlling the production of large or small polypeptides active against insects when introduced into the insect pests, such as, e.g., lytic peptides, peptide hormones and toxins and venoms, form another aspect of the invention. For example, it is contemplated that the expression of juvenile hormone esterase, directed towards specific insect pests, also may result in insecticidal activity, or perhaps cause cessation of metamorphosis (Hammock et al., 1990).

Transgenic plants expressing genes which encode enzymes that affect the integrity of the insect cuticle form yet another aspect of the invention. Such genes include those encoding, e.g., chitinase, proteases, lipases and also genes for the production of nikkomycin, a compound that inhibits chitin synthesis, the introduction of any of which is contemplated to produce insect resistant plants. Genes that code for activities that affect insect molting, such as those affecting the production of ecdysteroid UDP-glucosyl transferase, also fall within the scope of the useful transgenes of the present invention.

Genes that code for enzymes that facilitate the production of compounds that reduce the nutritional quality of the host plant to insect pests also are encompassed by the present invention. It may be possible, for instance, to confer insecticidal activity of a plant by altering its sterol composition. Sterol are obtained by insects from their diet and are used for hormone synthesis and membrane stability. Therefore alterations in plant sterol composition by expression of novel genes, e.g., those that directly promote the production of undesirable sterols and those that convert desirable sterols into undesirable forms, could have a negative effect on insect growth and/or development and hence endow the plant with insecticidal activity. Lipoxygenases are naturally occurring plant enzymes that have been shown to exhibit anti-nutritional effects on insects and to reduce the nutritional quality of their diet. Therefore, further embodiments of the invention concern transgenic plants with enhanced lipoxygenase activity which may be resistant to insect feeding.

Tripsacum dactyloidesis a species of grass that is resistant to certain insects, including corn root worm. It is anticipated that genes encoding proteins that are toxic to insects or are involved in the biosynthesis of compounds toxic to insects will be isolated from *Tripsacum* and that these novel genes will be useful in conferring resistance to insects. It is known that the basis of insect resistance in *Tripsacum* is genetic, because said resistance has been transferred to *Zea mays* via sexual crosses (Branson and Guss, 1972). It is further anticipated that other cereal, monocot or dicot plant species may have genes encoding proteins that are toxic to insects which would be useful for producing insect resistant plants.

Further genes encoding proteins characterized as having potential insecticidal activity also may be used as transgenes in accordance herewith. Such genes include, for example, the cowpea trypsin inhibitor (CpTI; Hilder et al., 1987) which may be used as a rootworm deterrent; genes encoding *avermectin (Avermectin and Abamectin,* Campbell, W.C., Ed., 1989; Ikeda et al., 1987) which may prove particularly useful as a corn rootworm deterrent; ribosome inactivating protein genes; and even genes that regulate plant structures. Transgenic plants including anti-insect antibody genes and genes that code for enzymes that can convert a non-toxic insecticide (pro-insecticide) applied to the outside of the plant into an insecticide inside the plant also are contemplated.

(iii) Environment or Stress Resistance

Improvement of a plants ability to tolerate various environment stresses such as, but not limited to, drought, excess moisture, chilling, freezing, high temperature, salt, and oxidative stress, also can be effected through expression of novel genes. It is proposed that benefits may be realized in terms of increased resistance to freezing temperatures through the introduction of an "antifreeze" protein such as that of the Winter Flounder (Cutler et al., 1989) or synthetic gene derivatives thereof. Improved chilling tolerance also may be conferred through increased expression of glycerol-3-phosphate acetyltransferase in chloroplasts (Wolter et al., 1992). Resistance to oxidative stress (often exacerbated by conditions such as chilling temperatures in combination with high light intensities) can be conferred by expression of superoxide dismutase (Gupta et al., 1993), and may be improved by glutathione reductase (Bowler et al., 1992). Such strategies may allow for tolerance to freezing in newly emerged fields as well as extending later maturity higher yielding varieties to earlier relative maturity zones.

It is contemplated that the expression of novel genes that favorably effect plant water content, total water potential, osmotic potential, and turgor will enhance the ability of the plant to tolerate drought. As used herein, the terms "drought resistance" and "drought tolerance" are used to refer to a plants increased resistance or tolerance to stress induced by a reduction in water availability, as compared to normal circumstances, and the ability of the plant to function and survive in lower-water environments. In this aspect of the invention it is proposed, for example, that the expression of genes encoding for the biosynthesis of osmotically-active solutes, such as polyol compounds, may impart protection against drought. Within this class are genes encoding for mannitol-L-phosphate dehydrogenase (Lee and Saier, 1982) and trehalose-6-phosphate synthase (Kaasen et al., 1992). Through the subsequent action of native phosphatases in the cell or by the introduction and coexpression of a specific phosphatase, these introduced genes will result in the accumulation of either mannitol or trehalose, respectively, both of which have been well documented as protective compounds able to mitigate the effects of stress. Mannitol accumulation in transgenic tobacco has been verified and preliminary results indicate that plants expressing high levels of this metabolite are able to tolerate an applied osmotic stress (Tarczyniski et al., 1992, 1993).

Similarly, the efficacy of other metabolites in protecting either enzyme function (e.g., alanopine or propionic acid) or membrane integrity (e.g., alanopine) has been documented (Loomis et al., 1998), and therefore expression of genes encoding for the biosynthesis of these compounds might confer drought resistance in a manner similar to or complimentary to mannitol. Other examples of naturally occurring metabolites that are osmotically active and/or provide some direct protective effect during drought and/or desiccation include fructose, erythritol (Coxson et al., 1992), sorbitol, dulcitol (Karsten et al., 1992), glucosylglycerol (Reed et al., 1984; ErdMann et al., 1992), sucrose, stachyose (Koster and Leopold, 1988; Blackman et al., 1992), raffinose (Bernal-Lugo and Leopold, 1992), proline (Rensburg et al., 1993), glycine betaine, ononitol and pinitol (Vernon and Bohnert, 1992). Continued canopy growth and increased reproductive fitness during time of stress will be augmented by introduction and expression of genes such as those controlling the osmotically active compounds discussed above and other such components. Currently preferred genes which promote the synthesis of an osmotically active polyol compound are genes which encode the enzymes mannitol-1-phosphate dehydrogenase, trehalose-6-phosphate synthase and myo-inositol 0-methyltransferase.

It is contemplated that the expression of specific proteins also may increase drought tolerance. Three classes of Late Embryogenic Proteins have been assigned based on structural similarities (see Dure et al., 1989). All three classes of LEAs have been demonstrated in maturing (i.e. desiccating) seeds. Within these 3 types of LEA proteins, the Type-II (dehydrin-type) have generally been implicated in drought and/or desiccation tolerance in vegetative plant parts (i.e. Mundy and Chua, 1998; Piatkowski et al., 1990; Yamaguchi-Shinozaki et al., 1992). Recently, expression of a Type-III LEA (HVA-1) in tobacco was found to influence plant height, maturity and drought tolerance (Fitzpatrick, 1993). In rice, expression of the HVA-1 gene influenced tolerance to water deficit and salinity (Xu et al., 1996). Expression of structural genes from all three LEA groups may therefore confer drought tolerance. Other types of proteins induced during water stress include thiol proteases, aldolases and transmembrane transporters (Guerrero et al., 1990), which may confer various protective and/or repair-type functions during drought stress. It also is contemplated that genes that effect lipid biosynthesis and hence membrane composition might also be useful in conferring drought resistance on the plant.

Many of these genes for improving drought resistance have complementary modes of action. Thus, it is envisaged that combinations of these genes might have additive and/or synergistic effects in improving drought resistance in plants. Many of these genes also improve freezing tolerance (or resistance); the physical stresses incurred during freezing and drought are similar in nature and may be mitigated in similar fashion. Benefit may be conferred via constitutive expression of these genes, but the preferred means of expressing these novel genes may be through the use of a turgor-induced promoter (such as the promoters for the turgor-induced genes described in Guerrero et al, 1990 and Shagan et al., 1993 which are incorporated herein by reference). Spatial and temporal expression patterns of these genes may enable plants to better withstand stress.

It is proposed that expression of genes that are involved with specific morphological traits that allow for increased water extractions from drying soil would be of benefit. For example, introduction and expression of genes that alter not characteristics may enhance water update. It also is contemplated that expression of genes that enhance reproductive fitness during times of stress would be of significant value. For example, expression of genes that improve the synchrony of pollen shed and receptiveness of the female flower parts, i.e., silks, would be of benefit. In addition it is proposed that expression of genes that minimize kernel abortion during times of stress would increase the amount of grain to be harvested and hence be of value.

Given the overall role of water in determining yield, it is contemplated that enabling plants to utilize water more efficiently, through the introduction and expression of novel genes, will improve overall performance even when soil water availability is not limiting. By introducing genes that improve the ability of plants to maximize water usage across a full range of stresses relating to water availability, yield stability of consistency of yield performance may be realized.

(iv) Disease Resistance

It is proposed that increased resistance to disease may be realized through introduction of genes into plants, for example, into monocotyledonous plants such as maize. It is possible to produce resistance to diseases caused by viruses, bacteria, fungi and nematodes. It also is contemplated that control of mycotoxin producing organisms may be realized through expression of introduced genes.

Resistance to viruses may be produced through expression of novel genes. For example, it has been demonstrated that expression of a viral coat protein in a transgenic plant can impart resistance to infection of the plant by that virus and perhaps other closely related viruses (Cuozzo et al., 1988, Hemenway et al., 1988, Abel et al., 1986). It is contemplated that expression of antisense genes targeted at essential viral functions may also impart resistance to viruses. For example, an antisense gene targeted at the gene responsible for replication of viral nucleic acid may inhibit replication and lead to resistance to the virus. It is believed that interference with other viral functions through the use of antisense genes also may increase resistance to viruses. Further, it is proposed that it may be possible to achieve resistance to viruses through other approaches, including, but not limited to the use of satellite viruses.

It is proposed that increased resistance to diseases caused by bacteria and fungi may be realized through introduction of novel genes. It is contemplated that genes encoding so-called "peptide antibiotics," pathogenesis related (PR) proteins toxin resistance, and proteins affecting host-pathogen interactions such as morphological characteristics will be useful. Peptide antibiotics are polypeptide sequences which are inhibitory to growth of bacteria and other microorganisms. For example, the classes of peptides referred to as cecropins and magainins inhibit growth of many species of bacteria and fungi. It is proposed that expression of PR proteins in monocotyledonous plants such as maize may be useful in conferring resistance to bacterial disease. These genes are inducted following pathogen attack on a host plant and have been divided into at least five classes of proteins (Bol, Linthorst, and Cornelissen, 1990). Included amongst the PR proteins are $\beta$-1, 3-glucanases, chitinases, and osmotin and other proteins that are believed to function in plant resistance to disease organisms. Other genes have been identified that have antifungal properties, e.g., UDA (stinging nettle lectin) and herein (Broakaert et al., 1989; Barkai-Golan et al., 1978). It is known that certain plant diseases are caused by the production of phytotoxins. It is proposed that resistance to these diseases would be achieved through expression of a novel gene that encodes an enzyme capable of degrading or otherwise inactivating the phytotoxin. It also is contemplated that expression of novel genes that alter the interactions between the host plant and pathogen may be useful in reducing the ability of the disease organism to invade the tissues of the host plant, e.g., an increase in the waxiness of the leaf cuticle or other morphological characteristics.

(v) Plant Agronomic Characteristics

Two of the factors determining where crop plants can be grown are the average daily temperature during the growing season and the length of time between frosts. Within the areas where it is possible to grow a particular crop, there are varing limitations on the maximal time it is allowed to grow to maturity and be harvested. For example, a variety to be grown in a particular area is selected for its ability to mature and dry down to harvestable moisture content within the required period of time with maximum possible yield. Therefore, crops of varying maturities is developed for different growing locations. Apart from the need to dry down sufficiently to permit harvest, it is desirable to have maximal drying take place in the field to minimize the amount of energy required for additional drying post-harvest. Also, the more readily a product such as grain can dry down, the more time there is available for growth and kernel fill. It is considered that genes that influence maturity and/or dry down can be identified and introduced into plant lines using transformation techniques to create new varieties adapted to different growing locations or the same growing location, but having improved yield to moisture ratio at harvest. Expression of genes that are involved in regulation of plant development may be especially useful.

It is contemplated that genes may be introduced into plants that would improve standability and other plant growth characteristics. Expression of novel genes in plants which confer stronger stalks, improved root systems, or prevent or reduce ear droppage would be of great value to the farmer. It is proposed that introduction and expression of genes that increase the total amount of photoassimilate available by, for example, increasing light distribution and/or interception would be advantageous. In addition, the expression of genes that increase the efficiency of photosynthesis and/or the leaf canopy would further increase gains in productivity. It is contemplated that expression of a phytochrome gene in crop plants may be advantageous. Expression of such a gene may reduce apical dominance, confer semidwarfism on a plant, and increase shade tolerance (U.S. Pat. No. 5,268,526). Such approaches would allow for increased plant populations in the field.

(vi) Nutrient Utilization

The ability to utilize available nutrients may be a limiting factor in growth of crop plants. It is proposed that it would be possible to alter nutrient uptake, tolerate pH extremes, mobilization through the plant, storage pools, and availability for metabolic activities by the introduction of novel genes. These modifications would allow a plant such a maize to more efficiently utilize available nutrients. It is contemplated that an increase in the activity of, for example, an enzyme that is normally present in the plant and involved in nutrient utilization would increase the availability of a nutrient. An example of such an enzyme would be phytase. It is further contemplated that enhanced nitrogen utilization by a plant is desirable. Expression of a glutamate dehydrogenase gene in plants, e.g., *E. coli* gdhA genes, may lead to increased fixation of nitrogen in organic compounds. Furthermore expression of gdhA in plants may lead to enhanced resistance to the herbicide glufosinate by incorporation of excess ammonia into glutamate, thereby detoxifying the ammonia. It also is contemplated that expression of a novel gene may make a nutrient source available that was previously not accessible, e.g., an enzyme that releases a component of nutrient value from a more complex molecule, perhaps a macromolecule.

(vii) Male Sterility

Male sterility is useful in the production of hybrid seed. It is proposed that male sterility may be produced through expression of novel genes. For example, it has been shown that expression of genes that encode proteins that interfere with development of the male inflorescence and/or gametophyte result in male sterility. Chimeric ribonuclease genes that express in the anthers of transgenic tobacco and oilseed rape have been demonstrated to lead to male sterility (Mariani et al., 1990).

A number of mutations were discovered in maize that confer cytoplasmic male sterility. One mutation in particular, referred to as T cytoplasm, also correlates with sensitivity to Southern corn leaf blight. A DNA sequence, designated TURF-13 (Levings, 1990), was identified that correlates with T cytoplasm. It is proposed that it would be possible through the introduction of TURF-13 via transformation, to separate male sterility from disease sensitivity. As it is necessary to be able to restore male fertility for breeding purposes and for grain production, it is proposed that genes encoding restoration of male fertility also may be introduced.

(viii) Improved Nutritional Content

Genes may be introduced into plants to improve the nutrient quality or content of a particular crop. Introduction of genes that alter the nutrient composition of a crop may greatly enhance the feed or food value. For example, the protein of many grains is suboptimal for feed and food purposes, especially when fed to pigs, poultry, and humans. The protein is deficient in several amino acids that are essential in the diet of these species, requiring the addition of supplements to the grain. Limiting essential amino acids may include lysine, methionine, tryptophan, threonine, valine, arginine, and histidine. Some amino acids become limiting only after corn is supplemented with other inputs for feed formulations. The levels of these essential amino acids in seeds and grain may be elevated by mechanisms which include, but are not limited to, the introduction of genes to increase the biosynthesis of the amino acids, decrease the degradation of the amino acids, increase the storage of the amino acids in proteins, or increase transport of the amino acids to the seeds or grain.

The protein composition of crop may be altered to improve the balance of amino acids in a variety of ways including elevating expression of native proteins, decreasing expression of those with poor composition, changing the composition of native proteins, or introducing genes encoding entirely new proteins possessing superior composition.

The introduction of genes that alter the oil content of a crop plant may also be of value. Increases in oil content may result in increases in metabolizable-energy-content and density of the seeds for use in feed and food. The introduced genes may encode enzymes that remove or reduce rate-limitations or regulated steps in fatty acid or lipid biosynthesis. Such genes may include, but are not limited to, those that encode acetyl-CoA carboxylase, ACP-acyltransferase, β-ketoacyl-ACP synthase, plus other well known fatty acid biosynthetic activities. Other possibilities are genes that encode proteins that do not possess enzymatic activity such as acyl carrier protein. Genes may be introduced that alter the balance of fatty acids present in the oil providing a more healthful or nutritive feedstuff. The introduced DNA also may encode sequences that block expression of enzymes involved in fatty acid biosynthesis, altering the proportions of fatty acids present in crops.

Genes may be introduced that enhance the nutritive value of the starch component of crops, for example by increasing the degree of branching, resulting in improved utilization of the starch in livestock by delaying its metabolism. Additionally, other major constituents of a crop may be altered, including genes that affect a variety of other nutritive, processing, or other quality aspects. For example, pigmentation may be increased or decreased.

Feed or food crops may also possesses insufficient quantities of vitamins, requiring supplementation to provide adequate nutritive value. Introduction of genes that enhance vitamin biosynthesis may be envisioned including, for example, vitamins A, E, $B_{12}$, choline, and the like. Mineral content may also be sub-optimal. Thus genes that affect the accumulation or availability of compounds containing phosphorus, sulfur, calcium, manganese, zinc, and iron among others would be valuable.

Numerous other examples of improvements of crops may be used with the invention. The improvements may not necessarily involve grain, but may, for example, improve the value of a crop of silage. Introduction of DNA to accomplish this might include sequences that alter lining production such as those that result in the "brown midrib" phenotype associated with superior feed value for cattle.

In addition to direct improvements in feed or food value, genes also may be introduced which improve the processing of crops and improve the value of the products resulting from the processing. One use of crops of via wetmilling. Thus novel genes that increase the efficiency and reduce the cost of such processing, for example by decreasing steeping time, may also find use. Improving the value of wetmilling products may include altering the quantity or quality of starch, oil, corn gluten meal, or the components of gluten feed. Elevation of starch may be achieved through the identification and elimination of rate limiting steps in starch biosynthesis or by decreasing levels of the other components of crops resulting in proportional increases in starch.

Oil is another product of wetmilling, the value of which may be improved by introduction and expression of genes. Oil properties may be altered to improve its performance in the production and use of cooking oil, shortenings, lubricants or other oil-derived products or improvement of its health attributes when used in the food-related applications. Novel fatty acids also may be synthesized which upon extraction can serve as starting materials for chemical syntheses. The changes in oil properties may be achieved by altering the type, level, or lipid arrangement of the fatty acids present in the oil. This in turn may be accomplished by the addition of genes that encode enzymes that catalyze the synthesis of novel fatty acids and the lipids possessing them or by increasing levels of native fatty acids while possibly reducing levels of precursors. Alternatively, DNA sequences may be introduced which slow or block steps in fatty acids biosynthesis resulting in the increase in precursor fatty acid intermediates. Genes that might be added include desaturases, epoxidases, hydratases, dehydratases, and other enzymes that catalyze reactions involving fatty acid intermediates. Representative examples of catalytic steps that might be blocked include the desaturations from stearic to oleic acid and oleic to linolenic acid resulting in the respective accumulations of stearic and oleic acids. Another example is the blockage of elongation steps resulting in the accumulation of $C_8$ to $C_{12}$ saturated fatty acids.

(ix) Production of Assimilation of Chemicals or Biologicals

It may further be considered that a transgenic plant prepared in accordance with the invention may be used for the production or manufacturing of useful biological compounds that were either not produced at all, or not produced at the same level, in the corn plant previously. Alternatively, plants produced in accordance with the invention may be made to metabolize certain compounds, such as hazardous wastes, thereby allowing bioremediation of these compounds.

The novel plants producing these compounds are made possible by the introduction and expression of one or potentially many genes with the constructs provided by the invention. The vast array of possibilities include but are not limited to any biological compound which is presently produced by any organism such as proteins, nucleic acids, primary and intermediary metabolites, carbohydrate polymers, enzymes for uses in bioremediation, enzymes for modifying pathways that produce secondary plant metabolites such as flavonoids or vitamins, enzymes that could produce pharmaceuticals and for introducing enzymes that could produce compounds of interest to the manufacturing industry such as speciality chemicals and plastics. The compounds may be produced by the plant, extracted upon harvest and/or processing, and used for any presently recognized useful purpose such as pharmaceuticals, fragrances, and industrial enzymes to name a few.

(x) Non-Protein-Expressing Sequences

DNA may be introduced into plants for the purpose of expressing RNA transcripts that function to affect plant phenotype yet are not translated into protein. Two examples are antisense RNA and RNA with ribozyme activity. Both may serve possible functions in reducing or eliminating expression of native or introduced plant genes. However, as detailed below, DNA need not be expressed to effect the phenotype of a plant.

1. Antisense RNA

Genes may be constructed or isolated, which when transcribed, produce antisense RNA that is complementary to all or part(s) of a targeted messenger RNA(s). The antisense RNA reduces production of the polypeptide product of the messenger RNA. The polypeptide product may be any protein encoded by the plant genome. The aforementioned genes will be referred to as antisense genes. An antisense gene may thus be introduced into a plant by transformation methods to produce a novel transgenic plant with reduced expression of a selected protein of interest. For example, the protein may be an enzyme that catalyzes a reaction in the plant. Reduction of the enzyme activity may reduce or eliminate products of the reaction which include any enzymatically synthesized compound in the plant such as fatty acids, amino acids, carbohydrates, nucleic acids and the like. Alternatively, the protein may be a storage protein, such as a zein, or a structural protein, the decreased expression of which may lead to changes in seed amino acid composition or plant morphological changes respectively. The possibilities cited above are provided only by way of example and do not represent the full range of applications.

2. Ribozymes

Genes also may be constructed or isolated, which when transcribed, produce RNA enzymes (ribozymes) which can act as endoribonucleases and catalyze the cleavage of RNA molecules with selected sequences. The cleavage of selected messenger RNAs can result in the reduced production of their encoded polypeptide products. These genes may be used to prepare novel transgenic plants which possess them. The transgenic plants may possess reduced levels of polypeptides including, but not limited to, the polypeptides cited above.

Ribozymes are RNA-protein complexes that cleave nucleic acids in a site-specific fashion. Ribozymes have specific catalytic domains that possess endonuclease activity (Kim and Cech, 1987; Gerlach et al., 1987; Forster and Symons, 1987). For example, a large number of ribozymes accelerate phosphoester transfer reactions with a high degree of specificity, often cleaving only one of several phosphoesters in an oligonucleotide substrate (Cech et al., 1981; Michel and Westhof, 1990; Reinhold-Hurek and Shub, 1992). The specificity has been attributed to the requirement that the substrate bind via specific base-pairing interactions to the internal guide sequence ("IGS") of the ribozyme prior to chemical reaction.

Ribozyme catalysis has primarily been observed as part of sequence-specific cleavage/ligation reactions involving nucleic acids (Joyce, 1989; Cech et al., 1981). For example, U.S. Pat. No. 5,354,855 reports that certain ribozymes can act as endonucleases with a sequence specificity greater than that of known ribonucleases and approaching that of the DNA restriction enzymes.

Several different ribozyme motifs have been described with RNA cleavage activity (Symons, 1992). Examples include sequences from the Group I self splicing introns including Tobacco Ringspot Virus (Prody et al., 1986), Avocado Sunblotch Viroid (Palukaitis et al., 1979; Symons, 1981), and Lucerne Transient Streak Virus (Forster and Symons, 1987). Sequences from these and related viruses are referred to as hammerhead ribozyme based on a predicted folded secondary structure.

Other suitable ribozymes include sequences from RNase P with RNA cleavage activity (Yuan et al., 1992, Yuan and Altman, 1994, U.S. Pat. Nos. 5,168,053 and 5,624,824), hairpin ribozyme structures (Berzal-Herranz et al., 1992; Chowrira et al., 1993) and Hepatitis Delta virus based ribozymes (U.S. Pat. No. 5,625,047). The general design and optimization of ribozymes directed RNA cleavage activity has been discussed in detail (Haseloff and Gerlach, 1988, Symons, 1992, Chowrira et al., 1994; Thompson et al., 1995).

The other variable on ribozyme design is the selection of a cleavage site on a given target RNA. Ribozymes are targeted to a given sequence by virtue of annealing to a site by complimentary base pair interactions. Two stretches of homology are required for this targeting. These stretches of homologous sequences flank the catalytic ribozyme structure defined above. Each stretch of homologous sequence can vary in length from 7 to 15 nucleotides. The only requirement for defining the homologous sequences is that, on the target RNA, they are separated by a specific sequence which is the cleavage site. For hammerhead ribozyme, the cleavage site is a dinucleotide sequence on the target RNA is a uracil (U) followed by either an adenine, cytosine or uracil (A,C or U) (Perriman et al., 1992; Thompson et al., 1995). The frequency of this dinucleotide occurring in any given RNA is statistically 3 out of 16. Therefore, for a given target messenger RNA of 1,000 bases, 187 dinucleotide cleavage sites are statistically possible.

Designing and testing ribozymes for efficient cleavage of a target RNA is a process well known to those skilled in the art. Examples of scientific methods for designing and testing ribozymes are described by Chowrira et al., (1994) and Lieber and Strauss (1995), each incorporated by reference. The identification of operative and preferred sequences for use in down regulating a given gene is simply a matter of preparing and testing a given sequence, and is a routinely practiced "screening" method known to those of skill in the art.

3. Induction of Gene Silencing

It also is possible that genes may be introduced to produce novel transgenic plants which have reduced expression of a native gene product by the mechanism of co-suppression. It has been demonstrated in tobacco, tomato, and petunia (Goring et al., 1991; Smith et al., 1990; Napoli et al., 1990; van der Krol et al., 1990) that expression of the sense transcript of a native gene will reduce or eliminate expression of the native gene in a manner similar to that observed for antisense genes. The introduced gene may encode all or part of the targeted native protein but its translation may not be required for reduction of levels of that native protein.

4. Non-RNA-Expressing Sequences

DNA elements including those of transposable elements such as Ds, Ac, or Mu, may be inserted into a gene to cause mutations. These DNA elements may be inserted in order to inactivate (or activate) a gene and thereby "tag" a particular trait. In this instance the transposable element does not cause instability of the tagged mutation, because the utility of the element does not depend on its ability to move in the genome. Once a desired trait is tagged, the introduced DNA sequence may be used to clone the corresponding gene, e.g., using the introduced DNA sequence as a PCR primer together with PCR gene cloning techniques (Shapiro, 1983; Dellaporta et al., 1988). Once identified, the entire gene(s) for the particular trait, including control or regulatory regions where desired, may be isolated, cloned and manipulated as desired. The utility of DNA elements introduced into an organism for purposes of gene tagging is independent of the DNA sequence and does not depend on any biological activity of the DNA sequence, i.e., transcription into RNA or translation into protein. The sole function of the DNA element is to disrupt the DNA sequence of a gene.

It is contemplated that unexpressed DNA sequences, including novel synthetic sequences, could be introduced into cells as proprietary "labels" of those cells and plants and seeds thereof. It would not be necessary for a label DNA element to disrupt the function of a gene endogenous to the hot organism, as the sole function of this DNA would be to identify the origin of the organism. For example, one could introduce a unique DNA sequence into a plant and this DNA element would identify all cells, plants, and progeny of these cells as having arisen from that labeled source. It is proposed that inclusion of label DNAs would enable one to distinguish proprietary germplasm or germplasm derived from such, from unlabelled germplasm.

Another possible element which may be introduced is a matrix attachment region element (MAR), such as the chicken lysozyme. A element (Stief, 1989), which can be positioned around an expressible gene of interest to effect an increase in overall expression of the gene and diminish position dependent effects upon incorporation into the plant genome (Stief et al., 1989; Phi-Van et al., 1990).

Other examples of non-protein expressing sequences specifically envisioned for use with the invention include tRNA sequences, for example, to alter condon usage, and rRNA variants, for example, which may confer resistance to various agents such as antibiotics.

IX. Biological Functional Equivalents

Modification and changes may be made in the centromeric DNA segments of the current invention and still obtain a functional molecule with desirable characteristics. The following is a discussion based upon changing the nucleic acids of a centromere to create an equivalent, or even an improved, second-generation molecule.

In particular embodiments of the invention, mutated centromeric sequences are contemplated to be useful for increasing the utility of the centromere. It is specifically contemplated that the function of the centromeres of the current invention may be based upon the secondary structure of the DNA sequences of the centromere and/or the proteins which interact with the centromere. By changing the DNA sequence of the centromere, one may alter the affinity of one or more centromere-associated protein(s) for the centromere and/or the secondary structure of the centromeric sequences, thereby changing the activity of the centromere. Alternatively, changes may be made in the centromeres of the invention which do not effect the activity of the centromere. Changes in the centromeric sequences which reduce the size of the DNA segment needed to confer centromere activity are contemplated to be particularly useful in the current invention, as would changes which increased the fidelity with which the centromere was transmitted during mitosis and meiosis.

X. Plants

The term "plant," used herein, refers to any type of plant. The inventors have provided below an exemplary description of some plants that may be used with the invention. However, the list is not in any way limiting, as other types of plants will be known to those of skill in the art and could be used with the invention.

A common class of plants exploited in agriculture are vegetable crops, including artichokes, kohlrabi, arugula, leeks, asparagus, lettuce (e.g., head, leaf, romaine), bok choy, malanga, broccoli, melons (e.g., muskmelon, watermelon, crenshaw, honeydew, cantaloupe), brussel sprouts, cabbage, cardoni, carrots, napa, cauliflower, okra, onions, celery, parsley, chick peas, parsnips, chicory, chinese cabbage, peppers, collards, potatoes, cucumber plants (marrows, cucumbers), pumpkins, cucurbits, radishes, dry bulb onions, rutabaga, eggplant, salsify, escarole, shallots, endive, garlic, spinich, green onions, squash, greens, beet (sugar beet and folder beet), sweet potatoes, swiss chard, horseradish, tomatoes, kale, turnips, and spices.

Other types of plants frequently finding commercial use include fruit and vine crops such as apples, apricots, cherries, nectarines, peaches, pears, plums, prunes, quince almonds, chestnuts, fiberts, pecans, pistachios, walnuts, citrus, blueberries, boysenberries, cranberries, currants, loganberries, raspberries, strawberries, blackberries, grapes, avocados, banans, kiwi, persimmons, pomegranate, pineapple, tropical fruits, pomes, melon, mango, papaya, and lychee.

Many of the most widely grown plants are field crop plants such as evening primrose, meadow foam, corn (field, sweet, popcorn), hops, jojoba, peanuts, rice, safflower, small grains (barley, oats, rye, wheat, etc.), sorghum, tobacco, kapok leguminous plants (beans, lentils, peas, soybeans), oil plants (rape, mustard, poppy, olives, sunflowers, coconut, castor oil plants, cocoa beans, groundnuts), fibre plants (cotton, flax, hemp, jute), lauraceae (cinnamon, camphor), or plants such as coffee, sugarcane, tea, and natural rubber plants.

Still other examples of plants include bedding plants such as flowers, cactus, succelents and ornametal plants, as well as tree such as forest (broad-leaved trees and evergreens, such as conifers), fruit, ornamental, and nut-bearing trees, as well as shrubs and other nursery stock.

XI. Definitions

As used herein, the terms "autonomous replicating sequence" or "ARS" or "origin of replication" refer to an origin of DNA replication recognized by proteins that initiate DNA replication.

As used herein, the terms "binary BAC" or "binary bacterial artificial chromosome" refer to a bacterial vector that contains the T-DNA border sequences necessary for *Agrobacterium* mediated transformation (see, for example, Hamilton, et al., 1996; Hamilton, 1997; and Liu et al., 1999.

As used herein, the term "candidate centromere sequence" refers to a nucleic acid sequence which one wishes to assay for potential centromere function.

As used herein, a "centromere" is any DNA sequence that confers an ability to segregate to daughter cells through cell division. In one context, this sequence may produce a segregation efficiency to daughter cells ranging from about 1% to about 100%, including to about 5%, 10%, 20%, 30%, 40%, 50%, 60%, 70%, 80%, 90% or about 95% of daughter cells. Variations in such a segregation efficiency may find important applications within the scope of the invention; for example, mini-chromosomes carrying centromeres that confer 100% stability could be maintained in all daughter cells without selection, while those that confer 1% stability could be temporarily introduced into a transgenic organism, but be eliminated when desired. In particular embodiments of the invention, the centromere may confer stable segregation of a nucleic acid sequence, including a recombinant construct comprising the centromere, through mitotic or meiotic divisions, including through both meiotic and meitotic divisions. A plant centromere is not necessarily derived from plants, but has the ability to promote DNA segregation in plant cells.

As used herein, the term "centromere-associated protein" refers to a protein encoded by a sequence of the centromere or a protein which is encoded by host DNA and binds with relatively high affinity to the centromere.

As used herein, "eukaryote" refers to living organisms whose cells contain nuclei. A eukaryote may be distinguished from a "prokaryote" which is an organism which lacks nuclei. Prokaryotes and eukaryotes different fundamentally in the way their genetic information is organized, as well as their patterns of RNA and protein synthesis.

As used herein, the term "expression" refers to the process by which a structural gene produces an RNA molecule, typically termed messenger RNA (mRNA). The mRNA is typically, but not always, translated into polypeptide(s).

As used herein, the term "genome" refers to all of the genes and DNA sequences that comprise the genetic information within a given cell of an organism. Usually, this is taken to mean the information contained within the nucleus, but also includes the organelles.

As used herein, the term "higher eukaryote" means a multicellular eukaryote. typically characterized by its greater complex physiological mechanisms and relatively large size. Generally, complex organisms such as plants and animals are included in this category. Preferred higher eukaryotes to be transformed by the present invention include, for example, monocot and dicot angiosperm species, gymnosperm species, fern species, plant tissue culture cells of these species, animal cells and algal cells. it will of course be understood that prokaryotes and eukaryotes alike may be transformed by the methods of this invention.

As used herein, the term "host" refers to any organism that is the recipient of a replicable plasmid, or expression vector comprising a plant chromosome. Ideally, host strains used for cloning experiments should be free of any restriction enzyme activity that might degrade the foreign DNA used. Preferred examples of host cells for cloning, useful in the present invention, are bacteria such as *Escherichia coli, Bacillus subtilis, Pseudomonas, Streptomyces, Salmonella,* and yeast cells such as *S. cerevisiae*. Host cells which can be targeted for expression of a minichromosome may be plant cells of any source and specifically include *Arabidopisis,* maize, rice, sugarcane, sorghum, barley, soybeans, tobacco, wheat, tomato, potato, citrus, or any other agronomically or scientifically important species.

As used herein, the term "hybridization" refers to the pairing of complementary RNA and DNA strands to produce an RNA-DNA hybrid, or alternatively, the pairing of two DNA single strands from genetically different or the same sources to produce a double stranded DNA molecule.

As used herein, the term "linker" refers to a DNA molecule, generally up to 50 or 60 nucleotides long and synthesized chemically, or cloned from other vectors. In a preferred embodiment, this fragment contains one, or preferably more than one restriction enzyme site for a blunt-cutting enzyme and a staggered-cutting enzyme, such as BamHI. One end of the linker fragment is adapted to be ligatable to one end of the linear molecule and the other end is adapted to be ligatable to the the end of the linear molecule.

As used herein, a "library" is a pool of random DNA fragments which are cloned. In principle, any gene can be isolated by screening the library with a specific hybridization probe (see, for example, Young et al., 1977). Each library may contain the DNA of a given organism inserted as discrete restriction enzyme-generated fragments or as randomly sheered fragments into many thousands of plasmid vectors. For purposes of the present invention, *E. coli,* yeast, and *Salmonella* plasmids are particularly useful when the genome inserts come from other organisms.

As used herein, the term "lower eukaryote" refers to a eukaryote characterized by a comparatively simple physiology and composition, and most often unicellularity. Examples of lower eukaryotes include flagellates, ciliates, and yeast.

As used herein, a "minichromosome" is a recombinant DNA construct including a centromere and capable of transmission to daughter cells. The stability of this construct through cell division could range between from about 1% to about 100%, including about 5%, 10%, 20%, 30%, 40%, 50%, 60%, 70%, 80%, 90% and about 95%. The minichromosome construct may be a circular or linear molecule. It may include elements such as one or more telomeres, ARS sequences, and genes. The number of such sequences included is only limited by the physical size limitations of the construct itself. It could contain DNA derived from a natural centromere, although it may be preferable to limit the amount of DNA to the minimal amount required to obtain a segregation efficiency in the range of 1–100%. The minichromosome may be inherited through mitosis or meiosis, or through both meiosis and mitosis. As used herein, the term minichromosome specifically encompasses and includes the terms "plant artificial chromosome" or "PLAC," and all teachings relevant to a PLAC or plant artificial chromosome specifically apply to constructs within the meaning of the term minichromosome.

As used herein, by "minichromosome-encoded protein" it is meant a polypeptide which is encoded by a sequence of a minichromosome of the current invention. This includes sequences such as selectable markers, telomeres, etc., as well as those proteins encoded by any other selected functional genes on the minichromosome.

A "180 base pair repeat" is defined as any one of the specific repeats disclosed in SEQ ID NOS:184–212, or a "consensus" sequence derived therefrom. Thus, a given "180 base pair repeat" may include more or less than 180 base pairs, and may reflect a sequence not represented by any of the specific sequences provided herein.

As used herein, the term "plant" includes plant cells, plant protoplasts, plant calli, and the like, as well as whole plants regenerated therefrom.

As used herein, the term "plasmid" or "cloning vector" refers to a closed covalently circular extrachromosomal DNA or linear DNA which is able to autonomously replicate in a host cell and which is normally nonessential to the survival of the cell. A wide variety of plasmids and other vectors are known and commonly used in the art (see, for example, Cohen et al., U.S. Pat. No. 4,468,464, which discloses examples of DNA plasmids, and which is specifically incorporated herein by reference).

As used herein, a "probe" is any biochemical reagent (usually tagged in some way for ease of identification), used to identify or isolate a gene, a gene product, a DNA segment or a protein.

As used herein, the term "recombination" refers to any genetic exchange that involves breaking and rejoining of DNA strands.

As used herein the term "regulatory sequence" refers to any DNA sequence that influences the efficiency of transcription or translation of any gene. The term includes, but is not limited to, sequences comprising promoters, enhancers and terminators.

As used herein, a "selectable marker" is a gene whose presence results in a clear phenotype, and most often a growth advantage for cells that contain the marker. This growth advantage may be present under standard conditions, altered conditions such as elevated temperature, or in the presence of certain chemicals such as herbicides or antibiotics. Use of selectable markers is described, for example, in Broach et al. (1979). Examples of selectable markers include the thymidine kinase gene, the cellular adenine-phosphoribosyltransferase gene and the dihydrylfolate reductase gene, hygromycin phosphotransferase gene, the bar gene and neomycin phosphotransferase genes, among others. Preferred selectable markers in the present invention include genes whose expression confer antibiotic or herbicide resistance to the host cell, sufficient to enable the maintenance of a vector within the host cell, and which facilitate the manipulation of the plasmid into new host cells. Of particular interest in the present invention are proteins conferring cellular resistance to ampicillin, chloramphenicol, tetracycline, G-418, bialaphos, and glyphosate for example.

As used herein, a "screenable marker" is a gene whose presence results in an identifiable phenotype. The phenotype may be observable under standard conditions, altered conditions such as elevated temperature, or in the presence of certain chemicals used to detect the phenotype.

As used herein, the term "site-specific recombination" refers to any genetic exchange that involves breaking and rejoining of DNA strands at a specific DNA sequence.

As used herein, a "structural gene" is a sequence which codes for a polypeptide or RNA and includes 5' and 3' ends. The structural gene may be from the host into which the structural gene is transformed or from another species. A structural gene will preferably, but not necessarily, include one or more regulatory sequences which modulate the expression of the structural gene, such as a monomer, terminator or enhancer. A structural gene will preferably, but not necessarily, confer some useful phenotype upon an organism comprising the structural gene, for example, herbicide resistance. In one embodiment of the invention, a structural gene may encode an RNA sequence which is not translated into a protein, for example a tRNA or rRNA gene.

As used herein, the term "telomere" refers to a sequence capable of capping the ends of a chromosome, thereby preventing degradation of the chromosome end, ensuring replication and preventing fusion to other chromosome sequences.

As used herein, the terms "transformation" or "transfection" refer to the acquisition in cells of new DNA sequences through the chromosomal or extra-chromosomal addition of DNA. This is the process by which naked DNA, DNA coated with protein, or whole minichromosomes are introduced into a cell, resulting in a potentially heritable change.

XII. Examples

The following examples are included to demonstrate preferred embodiments of the invention. It should be appreciated by those of skilled the art that the techniques disclosed in the examples which follow represent techniques discovered by the inventors to function well in the practice of the invention, and thus can be considered to constitute preferred modes for its practice. However, those of skill in the art should, in light of the present disclosure, appreciate that many changes can be made in the specific embodiments which are disclosed and still obtain a like or similar result without departing from the concept, spirit and scope of the invention. More specifically, it will be apparent that certain agents which are both chemically and physiologically related may be substituted for the agents described herein while the same or similar results would be achieved. All such similar substitutes and modifications apparent to those

EXAMPLE 1

Generation of an *Arabidopsis thaliana* Mapping Population

To generate a pollen donor plant, two parental lines carrying qrtl were crossed to one another. The qrtl-1 allele was in the Landsberg ecotype background and the qrtl-2 allele was in the Columbia ecotype background. The Landsberg ecotype was readily discernible from the Columbia ecotype because it carries a recessive mutation, erecta, which causes the stems to thicken, inflorescences to be more compact, and the leaves to be more rounded and small than wildtype. To utilize this as a marker of a donor plant, qrtl-2 pollen was crossed onto a qrtl-1 female stigma. The $F_1$ progeny were heterozygous at all molecular markers yet the progeny retain the quartet phenotype of a tetrad of fused pollen grains. In addition, progeny display the ERECTA phenotype of the Columbia plant. This visible marker serves as an indication that the crossing was successful in generating plants segregating ecotype specific markers. Further testing was done to the donor plants by performing PCR analysis to insure the progeny were heterozygous at molecular loci.

Due to the fact that the pollen grains cannot be directly assayed for marker segregation and because of the desire to create a long-term resource available for multiple marker assays, it was necessary to cross individual tetrads generated by the donor plant. This created sets of progeny plants which yielded both large quantities of tissue and seed. These crosses were accomplished efficiently by generating a recipient plant homozygous for male sterility (msl). The recessive msl was chosen to guard against the possibility of the recipient plant sefl-fertilizing and the progeny being mistaken from tetrad plants. Due to the fact that the homozygous plant does not self, a stock speed generated by a heterozygous male sterility I plant needs to be maintained from which sterile recipient plants can be selected.

EXAMPLE 2

Tetrad Pollinations

Tetrad pollinations were carried out as follows. A mature flower was removed from the donor plant and tapped upon a glass microscope slide to release mature tetrad pollen grains. This slide was then placed under a 20–40× Zeiss dissecting microscope. To isolate individual tetrad pollen grains, a small wooden dowel was used to which an eyebrow hair with rubber cement was mounted. Using the light microscope, a tetrad pollen unit was chosen and touched to the eyebrow hair. The tetrad preferentially adhered to the eyebrow hair and was thus lifted from the microscope slide and transported the recipient plant sigmatic surface. The transfer was carried out without the use of the microscope, and the eyebrow hair with adhereing tetrad was then placed against the recipient stigmatic surface and the hair was manually dragged across the stigma surface. Then tetrad then preferentially adhered to the stigma of the recipient and the cross pollination was completed.

Initially, 57 tetrad seed sets consisting of 3–4 seeds each, were collected. Plants were grown from these tetrad seed sets, and tissue was collected. DNA was extracted from a small portion of the stored tissue for PCR based segregation analysis. Additionally the segregation of the visible erecta phenotype was scored. When the plants set seed, the seed was collected as a source for the large amount of DNA required to analyze RFLP segregation by Southern blotting.

EXAMPLE 3

Preparation and Analysis of Centromere-Spanning Contigs

Previously, DNA fingerprint and hybridization analysis of two bacterial artificial chromosome (BAC) libraries let to the assembly of physical maps covering nearly all single copy portions of the *Arabidopsis* genome (Marra et al., 1999). However, the presence of repetitive DNA near the *Arabidopsis* centromeres, including 180 bp repeats, retroelements, and middle repetitive sequences complicated effort to anchor centromeric BAC contigs to particular chromosomes (Murata et al., 1997; Heslop-Harrison et al., 1999; Brandes et al., 1997; Franz et al., 1998; Wright et al., 1996; Koniecznyet al., 1991; Pelissier et al., 1995; Voytas and Ausubel, 1988; Chye et al., 1997; Tsay et al., 1993; Richards et al., 1991; Simoens et al., 1988; Thompson et al., 1996; Pelissier et al., 1996). The inventors used genetic mapping to unambiguously assign these unanchored contigs to specific centromeres, scoring polymorphic markers in 48 plants with crossovers informative for the entire genomic (Copenhaver et al., 1998). In this manner, several centromeric contigs were connected to the physical maps of the chromosome arms (see EXAMPLE 6 and Table 4), and a large set of DNA markers defining centromere boundaries were generated. DNA sequence analysis confirmed the structure of the contigs for chromosomes II and IV (Lin et al., 1999).

CEN2 and CEN4 were selected in particular for analysis. Both reside on structurally similar chromosomes with a 3.5 Mb rDNA arrays on their distal tips, with regions measuring 3 and 2 Mb, respectively, between the rDNA and centromeres, and 16 and 13 Mb regions on their long arms (Copenhaver and Pikaard, 1996).

The virtually complete and annotated sequence of chromosomes II and IV was used to conduct an analysis of centromeres at the nucleotide level (www.ncbi.nlm.nih.gov/Entrez/nucleotide.html). The sequence composition was analyzed within the genetically-defined centromere boundaries and compared to the adjacent pericentromeric regions (FIGS. 12A–T). Analysis of the two centromeres facilitated comparisons of sequence patterns and identification of conserved sequence elements.

The centromere sequences were found to harbour 180 bp repeat sequences. These sequences were found to reside in the gaps of each centromeric contig (FIG. 3, FIGS. 12B, 12L), with few repeats and no long arrays elsewhere in the genome. BAC clones near these gaps have end sequences corresponding to repetitive elements and likely constitute the bulk of the DNA between the contigs, including 180 bp repeats, 55 rDNa or 160-bp repeats (FIG. 3). Fluorescent in situ hybridization has shown these repetitive sequences are abundant components of *Arabidopsis centromeres (Murata et al.,* 1997; Heslop-Harrison et al., 1999; Brandes et al., 1997). Genetic mapping and pulsed-field gel electrohoresis indicate that many 180 bp repeats reside in long arrays measuring between 0.4 and 1.4 Mb in the centromeric regions (Round et al., 1997); sequence analysis revealed additional interspersed copies near the gaps. The inventors specifically contemplate the use of such 180 bp repeats for construction of minichromosomes. The annotated sequence of chromosomes II and IV identified regions with homology to middle repetitive DNA, both within the functional centromeres and in the adjacent regions (FIGS. 12B–12E and 12L–12O).

In a 4.3 Mb sequenced regions that includes CEN2 and a 2.8 Mb sequenced region that includes CEN4, retrotransposon homology was found to account for >10% of the DNA sequence, with a maximum of 62% and 70%, respectively (FIGS. 12C, 12M). Sequences with similarity to transposons or middle repetitive elements were found to occupy a similar zone, but were less common (29% and 11% maximum density for chromosomes II and IV respectively (FIGS. 12D–12E and FIG. 12N–12O). Finally, unlike in the case of Drosophila and Neurospora centromeres (Sun et al., 1997; Cambareri et al., 1998) low complexity DNA, including microsatellites, homopolymer tracts, and AT rich iscohores, were not found to be enriched in the centromeres of Arabidopsis. Near CEN2, simple repeat sequence densities were comparable to those on the distal chromosome arms, occupying 1.5% of the sequence within the centromere, 3.2% in the flanking regions, and ranging from 20 to 319 bp in length (71 bp on average). Except for an insertion of mitochrondrial DNA at CEN2 and DNA in and around the centromeres did not contain any large regions that deviated significantly from the genomic average of ~64% A+T (FIGS. 12F, 12P) (Bevan et al., 1999).

Unlike the 180 bp repeats, all other repetitive elements near CEN2 and CEN4 were less abundant within the genetically-defined centromeres than in the flanking regions. The high concentration of repetitive elements outside of the functional centromere domain suggest they may be insufficient for centromere activity. Thus, identifying segments of the Arabidopsis genome that are enriched in these repetitive sequences does not pinpoint the regions that provide centromere function; a similar situation may occur in the genomes of other higher eukaryotes.

The repetitive DNA flanking the centromeres may plan an important role, forming an altered chromatin conformation that serves to nucleate or stabilize centromere structure. Alternatively, other mechanisms could result in the accumulation of repetitive elements near centromeres. Though evolutionary models predict repetitive DNA accumulates in regions of low recombination (Charlesworth et al., 1986; Charlesworth et al., 1994), many Arabidopsis repetitive elements are more abundant in the recombinationally active pericentromeric regions than in the centromeres themselves. Instead, retroelements and other transposons may preferentially insert into regions flanking the centromeres or be eliminated from the rest of the genome at a higher rate.

EXAMPLE 4

Genetic Mapping of Centromeres

To map centromeres, $F_1$ plants which were heterozygous for hundreds of polymorphic DNA markers were generated by crossing quartet mutants from the Landsberg and Columbia ecotypes (Chang et al. 1988; Ecker, 1994; Konieczy and Ausubel, 1993). In tetrads from these plants, genetic markers segregate in a 2:2 ratio (FIG. 6; Preuss et al. 1994). The segregation of markers was then determined in plants which were generated by crossing pollen tetrads from the $F_1$ plants onto a Landsberg homozygote. The genotype of the pollen grains within a tetrad was inferred from the genotype of the progeny. Initially, seeds were generated from greater than 100 successful tetrad pollinations, and tissue and seeds were collectioned from 57 of these. This provided sufficient material for PCR, as well as seeds necessary for producing the large quantities of tissue required for Southern hybridization and RFLP mapping. In order to obtain a more precise localization of the centromeres the original tetrade population was increased from 57 tetrads to over >1,000 tetrads.

PCR analysis was performed to determine marker segregation. To account for the contribution of the Landsberg background from the female parent, one Landsberg complement from each of the four tetrad plants was subtracted. As shown in FIG. 5, markers from sites spanning the entire genome were used for pair-wise comparisons of all other markers. Tetratypes indicate a crossover between one or both markers and their centromeres where as ditypes indicate the absence of crossovers (or presence of a double crossover).

Thus, at every genetic locus, the resulting diploid progeny was either L/C or C/C. The map generated with these plants is based solely on male meioses, unlike the existing map, which represents an average of recombination's in both males and females. Therefore, several well-established genetic distances were recalculated and thus will determine whether recombination frequencies are significantly altered.

The large quantities of genetic data generated by the analysis must be compared pair-wise to perform tetrad analysis. All of the data was managed in a Microsoft Excel spread-sheet format, assigning Landsberg alleles a value of "1" and Columbia alleles a value of "0". Within a tetrad, the separation of markers on one chromosome was compared to centromere-linked reference loci on a different chromosome (see Table 2 below). Multiplying the values of each locus by an appropriate reference, and adding the results for each tetrad easily distinguished PD, NPD, and TT tetrads with values of 2, 0, and 1, respectively.

Monitoring the position of crossovers in this population identified chromosomal regions that could be separated by recombination from centromeres (tetratype), as well as regions that always cosegregated with centromeres (ditype) (Copenhaver et al., 1998; Copenhaver et al., 1999). Tetratype frequencies decrease to zero at the centromere; consequently, centromere boundaries were defined as the positions that exhibited small but detectable numbers of tetratype patterns. By scoring the segregation of centromere linked markers in approximately 400 tetrads, centromeres 1–5 were localized to regions on the physical map corresponding to contigs of 550,1445, 1600, 1790 and 1770 kb, respectively (FIG. 3). Additionally, for each centromeric interval, a number of useful recombinants were identified. The results of the analysis indicated that centromeres reside within large domains that restrict recombination machinery activity and that the transition between these domains and the surrounding recombination-proficient DNA is markedly abrupt.

TABLE 2

Scoring protocol for tetratypes.

| Individual members of a tetrad | Locus 1 | Reference Locus | Locus 2 | Reference Locus | Locus 3 | Reference Locus |
|---|---|---|---|---|---|---|
| A | 1 | x 1 = 1 | 0 | x 1 = 0 | 0 | x 1 = 0 |
| B | 1 | x 1 = 1 | 0 | x 1 = 0 | 1 | x 1 = 1 |
| C | 0 | x 0 = 0 | 1 | x 0 = 0 | 0 | x 0 = 0 |
| D | 0 | x 0 = 0 | 1 | x 0 = 0 | 1 | x 0 = 0 |
|   |   | 2 |   | 0 |   | 1 |
|   |   | PD |   | NPD |   | TT |

Analysis of polymorphisms corresponding to 180 bp repeats (RCEN markers, Round et al., 1997) confirmed that these repeats map within the genetically-defined centromeres. Polymorphisms associated with the 180 bp repeats were analyzed by pulsed field gel electrophoresis as described previously (Round et al., 1997). Segregation of these polymorphisms in tetrads with informative crossovers confirmed complete linkage of a 180 bp repeat array at each centromere. In genetic units, the centromere intervals averaged 0.44 cM, (% recombination=½ tetratype frequency), reflecting recombination rates at least 10–30 fold below the genomic average of 221 kb/cM (Somerville and Somerville, 1999; nasc.nott.ac.uk/new_ri_map.html).

The low recombination frequencies typically observed near higher eukaryotic centromeres may be due to DNA modifications or unusual chromatin states (Choo, 1998; Puechberty, 1999; Mahtani and Willard, 1998; Charlesworth et al., 1986; Charlesworth et al., 1994). To modify these states, and thus improve centromere mapping resolution by raising recombination frequencies, F1 Landsberg/Columbia plants were treated with one of a series of compounds known to cause DNA damage, modify chromatin structure, or alter DNA modifications. F1 Landsberg qrtl/Columbia qrtl plants were grown under 24 hour light in 1" square pots and treated with methanesulfonic acid ethyl ester (0.05%), 5-aza-2'-deoxycytidine (25 or 100 mg/l), Zeocin (1 ug/ml), methanesulfonic acid methyl ester (75 ppm), cis-diamminedichloroplatinum (20 ug/ml), mitomycin C (10 mg/l), n-nitroso-n-ethylurea (100 uM), n-butyric acid (20 uM), trichostatin A (10 uM), or 3-methoxybenzamide (2 mM). Plants were watered and flower-bearing stems were immersed in these solutions. Alternatively, plants were exposed to 350 nm UV (7 or 10 seconds), or heat shock (38 or 42° C. for 2 hours). Pollen tetrads from these plants were used to pollinate Landsberg stigmas 3–5 days after each treatment; the F1 plants were subsequently subjected to additional treatments (up to 5 times per plant, every 3–5 days).

Tetrads from treated plants were crossed to Landsberg stigmas, and progeny from 8–107 tetrads subjected to each treatment were recovered and analyzed, yielding >600 additional tetrads. These tetrads exhibited higher recombination in regions immediately flanking the centromeres (1.6 vs. 3.4% recombination in untreated and treated plants, respectively), although the sample size was insufficient to determine if any individual treatment has a profound affect. The map locations of centromeres were refined on chromosomes 2 to 5 (FIG. 1), yielding intervals spanned by contigs of 880, 1150, 1260, and 1070 kg, respectively, with all tetrads consistently localizing centromere functions to the same region (Copenhaver et al., 1999).

Efforts to increase recombination yielded a large number of tetrads with crossovers near the centromeres; these crossovers clustered within a narrow region at the centromere boundaries. Five crossovers occurred over a 70 kb region near CEN2, and 7 over a 200 kb region near CEN1, yet no crossovers were detected in the adjacent centromeric intervals of 880 and 550 kb respectively (FIG. 3). Thus, the centromeres were found within large domains that restrict recombination machinery activity; the transition between these domains and surrounding, recombination-proficient DNA is remarkably abrupt (FIG. 12A and K). Although analysis of more tetrads would yield additional recombination events, the observed distribution of crossovers indicate that centromere positions would not be significantly refined.

EXAMPLE 5

Sequence Analysis of Arabidopsis Centromeres
A. Abundance of genes in the centromeric regions Expressed genes are located within 1 kb of essential centromere sequences in *S. cerevisiae,* and multiple copies of tRNA genes reside within an 80 kb fragment necessary for centromere function in *S. pombe* (Kuhn et al., 1991). In contrast, genes are thought to be relatively rare in the centromeres of higher eukaryotes, though there are notable exceptions. The Drosophila light, concertina, responder, and rolled loci all map to the centromeric region of chromosome 2, and translations that remove light from its native heterochromatic context inhibit gene expression. In contrast, many Drosophila and human genes that normally reside in euchromatin become inactive when they are inserted near a centromere. Thus, genes that reside near centromeres likely have special control elements that allow expression (Karpen, 1994; Lohe and Hilliker, 1995). The sequences of Arabidopsis CEN2 and CEN4, provided herein, provide a powerful resource for understanding how gene density and expression correlate with centromere position and associated chromatin.

Annotation of chromosome II and IV (www.ncbi.nlm.nih.gov/Entrez/nucleotide.html) identified many genes within and adjacent to CEN2 and CEN4 (FIG. 8, FIGS. 12A–12T). The density of predicted genes on Arabidopsis chromosome arms averages 25 per 100 kb, and in the repeat-rich regions flanking CEN2 and CEN4 this decreases to 9 and 7 genes per 100 kb, respectively (Bevan et al. 1999). Many predicted genes also reside within the recombination-deficient, genetically-defined centromeres. Within CEN2, these were 5 predicted genes per 100 kb; while CEN4 was strikingly different, with 12 genes per 100 kb.

There was strong evidence that several of the predicted centromeric genes are transcribed. The phosphoenolpyruvate gene (CUE1) defines on CEN5 border; mutations in this gene cause defects in light-regulated gene expression (Li et al., 1995). Within the sequenced portions of CEN2 and CEN4, 17% (27/160) of the predicted genes shared >95% identity with cloned cDNAs (ESTs) with three-fold more matches in CEN4 than in CEN2 (wwww.tigr.org/tdb/at/agad/). Twenty-four of these genes have multiple exons, and four correspond to single-copy genes with known functions. A list of the predicted genes identified is given in Table 3, below. A list of additional genes encoded within the boundaries of CEN4 are listed in Table 4. The identification of these genes is significant in that the genes may themselves contain unique regulatory elements or may reside in genomic locations flanking unique control or regulatory elements involved in centromere function or gene expression. In particular, the current inventors contemplate use of these genes, or DNA sequences 0 to 5 kb upstream or downstream of these sequences, for insertion into a gene of choice in a minichromosome. It is expected that such elements could potentially yield beneficial regulatory controls of the expression of these genes, even when in the unique environment of a centromere.

To investigate whether the remaining 23 genes were uniquely encoded at the centromere, a search was made in the database of annotated genomic Arabidopsis sequences. With the exception of two genes, no homologs with >95% identity were found elsewhere in the 80% of the genome that has been sequence. The number of independent cDNA clones that correspond to a single-copy gene provides an estimate of the level of gene expression. On chromosome II, predicted genes with high quality matches to the cDNA database (>95% identity) match an average of four independent cDNA clones (range 1–78). Within CEN2 and CEN4, 11/27 genes exceed this average (Table 3). Finally, genes encoded at CEN2 and CEN4 are not members of a single gene family, nor do they correspond to genes predicted to play a role in centromere functions, but instead have diverse roles.

Many genes in the Arabidopsis centrometric regions are nonfunctional due to early stop codons or disrupted open reading frames, but few pseudogenes were found on the chromosome arms. Though a large fraction of these pseudogenes have homology to mobile elements, many correspond to genes that are typically not mobile (FIGS. 12I–J and FIGS. 12S–T). Within the genetically-defined centromeres there were 1.0 (CEN2) and 0.7 (CEN4) of these nonmobile pseudogenes per 100 kb; the repeat-rich regions bordering the centromeres have 1.5 and 0.9 per 100 kb respectively. The distributions of pseudogenes and transposable elements are overlapping, indicting that DNA insertions in these regions contributed to gene disruptions.

TABLE 3

Predicted genes within CEN2 and CEN4 that correspond to the cDNA database.

| Putative function | GenBank protein accession | # of EST matches* |
|---|---|---|
| CEN2 | | |
| Unknown | AAC69124 | 1 |
| SH3 domain protein | AAD15528 | 5 |
| Unknown | AAD15529 | 1 |
| unknown† | AAD37022 | 1 |
| RNA helicase‡ | AAC26676 | 2 |
| 40S ribosomal protein S16 | AAD22696 | 9 |
| CEN4 | | |
| Unknown | AAD36948 | 1 |
| Unknown | AAD36947 | 4 |
| leucyl tRNA synthetase | AAD36946 | 4 |
| aspartic protease | AAD29758 | 6 |
| Peroxisomal membrane protein (PPM2) § | AAD29759 | 5 |
| 5'-adenylylsulfate reductase § | AAD29775 | 14 |
| symbiosis-related protein | AAD29776 | 3 |
| ATP synthase gamma chain 1 (APC1) § | AAD48955 | 3 |
| protein kinase and EF hand | AAD03453 | 3 |
| ABC transporter | AAD03441 | 1 |
| Transcriptional regulator | AAD03444 | 14 |
| Unknown | AAD03446 | 12 |
| human PCF11p homolog | AAD03447 | 6 |
| NSF protein | AAD17345 | 2 |
| 1,3-beta-glucan synthase | AAD48971 | 2 |
| pyridine nucleotide-disulphide oxidoreductase | AAD48975 | 4 |
| Polyubiquitin (UBQ11) § | AAD48980 | 72 |
| wound induced protein | AAD48981 | 6 |
| short chain dehydrogenase/reductase | AAD48959 | 7 |
| SL15† | AAD48939 | 2 |
| WD40-repeat protein | AAD48948 | 2 |

*Independent cDNAs with >95% identity, †related gene present in non-centromeric DNA, ‡potentially associated with a mobile DNA element, § characterized gene (B. Tugal, 1999; J. F. Gutierrez-Marcos, 1996; N. Inohara, 1991; J. Callis, 1995).

TABLE 4

List of additional genes encoded within the boundaries of CEN4.

| Putative Function | GenBank accession | Nucleotide Position |
|---|---|---|
| 3'(2'),5'-Bisphosphate Nucleotidase | AC012392 | 71298–73681 |
| Transcriptional regultor | AC012392 | 80611–81844 |
| Equilibrative nucleoside transporter 1 | AC012392 | 88570–90739 |
| Equilibrative nucleoside transporter 1 | AC012392 | 94940–96878 |
| Equilibrative nucleoside transporter 1 | AC012392 | 98929–10109 |
| Equilibrative nucleoside transporter 1 | AC012392 | 113069–115262 |
| unknown | AC012392 | 122486–124729 |
| 4-coumarate--CoA ligase | AC012392 | 126505–128601 |
| ethylene responsive protein | AC012392 | 130044–131421 |
| Oxygen-evolving enhancer protein precursor | AC012392 | 134147–135224 |
| Kinesin | AC012392 | 137630–141536 |
| receptor-like protein kinase | AC012392 | 141847–144363 |
| LpxD-like protein | AC012392 | 144921–146953 |
| hypersensitivity induced protein | AC012392 | 147158–147838 |
| ubiquitin | AC012392 | 149057–149677 |
| unknown | AC012392 | 150254–151072 |
| ubiquitin-like protein | AC012392 | 153514–154470 |
| ubiquitin-like protein | AC012392 | 155734–156513 |
| ubiquitin-like protein | AC012392 | 156993–157382 |
| unknown | AC012392 | 159635–165559 |
| unknown | AC012392 | 166279–166920 |
| unknown | AC012392 | 167724–170212 |
| ubiquitin-like protein | AC012392 | 176819–178066 |
| polyubiquitin (UBQ10) § | AC012392 | 180613–182007 |
| phosphatidylinositol-3,4,5-triphosphate binding protein | AC012477 | 89384–91291 |
| Mitochondrial ATPase | AC012477 | 94302–94677 |
| RING-H2 finger protein | AC012477 | 95522–96142 |
| unknown | AC012477 | 104747–105196 |
| Mitochondrial ATPase | AC012477 | 105758–106595 |
| ferredoxin--NADP + reductase | AC012477 | 107451–109095 |
| unknown | AC012477 | 109868–110620 |
| U3 snoRNP-associated protein | AC012477 | 111841–114133 |
| UV-damaged DNA binding factor | AC012477 | 114900–121275 |
| Glucan endo-1,3-Beta-Glucosidase precursor | AC012477 | 122194–122895 |
| D123-like protein | AC012477 | 125886–126887 |
| Adrenodoxin Precursor | AC012477 | 127660–129246 |
| N7 like-protein | AC012477 | 129718–131012 |
| N7 like-protein | AC012477 | 131868–133963 |
| N7 like-protein | AC012477 | 134215–136569 |
| N7 like-protein | AC012477 | 139656–140864 |

§ characterized gene (J. Callis, 1995).

B. Conservation of centromeric DNA

To investigate the conservation of CEN2 and CEN4 sequences, PCR primer pairs were designed that correspond to unique regions in the Columbia sequence and used to survey the centrometric regions of Landsberg and Columbia at ~20 kb intervals (FIGS. 14A, B). The primers used for the analysis are listed in FIGS. 15A, B. Amplification products of the appropriate length were obtained in both ecotypes for most primer pairs (85%), indicating that the amplified regions were highly similar. In the remaining cases, primer pairs amplified Columbia, but not Landsberg DNA, even at very low stringencies. In these regions, additional primers were designed to determine the extent of nonhomology. In addition to a large insertion of mitochondrial DNA in CEN2, two other non-conserved regions were identified (FIGS. 14A, B). Because this DNA is absent from Landsberg centromeres, it is unlikely to be required for centromere functions; consequently, the relevant portion of the centromeric sequence is reduced to 577 kb (CEN2) and 1250 kb (CEN4). The high degree of sequence conservation between Landsberg and Columbia centromeres indicated that the inhibition of recombination frequencies was not due to large regions of non-chromology, but instead was a property of the centromeres themselves.

C. Sequence similarity between CEN2 and CEN4

In order to discern centromere function, a search was conducted for novel sequence motifs shared between CEN2 and CEN4, excluding from the comparison retroelements, transposons, characterized centromeric repeats, and coding sequences resembling mobile genes. After masking simple repetitive sequences, including homopolymer tracts and microsatellites, contigs of unique sequence measuring 417 kb and 851 kb for CEN2 and CEN4, respectively, were compared with BLAST (blast.wustl.edu).

The comparison showed that the complex DNA within the centromere regions was not homologous over the entire sequence length. However, 16 DNA segments in CEN2 matched 11 regions in CEN4 with >60% identity (FIG. 16). The sequences were grouped into families of related sequences, and were designated AtCCS1-7 (*Arabidopsis thaliana* centromere conserved sequences 1–7). these sequences were not previously known to be repeated in the Arabidopsis genome. The sequences comprised a total of 17 kb (4%) of CEN2 DNA, had an average length of 1017 bp, and had an A+T content of 65%. Based on similarlity, the matching sequences were sorted into groups, including two families containing 8 sequences each (AtCCS1 and AtCCS2; SEQ ID NOS:1–14), 3 sequences from a small family encoding a putative open reading frame (AtCCS3; SEQ ID NOS;21–22), and 4 sequences found once within the centromeres (AtCCS4-AtCCS7; SEQ ID NOS:15–20), one of which (AtCCS6; SEQ ID NO:17) corresponds to predicted CEN2 and CEN4 proteins with similarity throughout their exons and introns (FIG. 16).

Searches of the Arabidopsis genomic sequence database demonstrated that AtCCS1–AtCCS5 were moderately repeated sequences that appear in centromeric and pericentromeric regions. The remaining sequences were present only in the genetically-defined centromeres. Similar comparisons of all 16 *S. cerevisiae* centromeres defined a consensus consisting of a conserved 8 bp CDEI motif, an AT-rich 85 bp CDEII element, and a 26 bp CDEII region with 7 highly conserved nucleotides (Fleig et al., 1995). In contrast, surveys of the tree *S. pombe* centromeres revealed conservation of overall centromere structure, but no universally conserved motifs (Clark, 1998).

EXAMPLE 6

Mapping Results: Arbidopsis Chromosomes 1–5

The centromere on chromosome 1 was mapped between mi342 (56.7 cM) and T27K12 (59.1 cM). A more refined position places the centromere between the marker T22C23-t7 (~58.5 cM) and T3P8-sp6 (~59.1 cM). Contained within this interval are the previously described markers EKRIV and RCEN1.

The centromere on chromosome 2 was mapped between mi310 (18.6 cM) and g4133 (23.8 cM). A more refined position places the centromere between the markers F5JI1-sp6 (~19.1 cM) and T15D9 (~19.3 cM). The following sequenced (www.ncbi.nlm.nih.gov/Entre//nucleotide.html) BAC (bacterial artificial chromosome) clones are known to span the region between the markers F5J15-sp6 and T15D9: T13E11, F27C21, F9A16, T5M2, T17H1, T18C6, T5E7, T12J2, F27B22, T6C20, T14C8, F7B19 and T15D9.

Three is a gap in BAC coverage between T12J2 and F27B22. RARE cleavage, pulse field gels or DNA sequence tiling will be used to isolate DNA in the gap for sequencing.

The centromere on chromosome 3 was mapped between atpox (48.6 cM) and ATA (53.8 cM). A more refined position places the centromere between the marker T9G9-sp6 (~53.1 cM) and T5M14-sp6 (~53.3 cM). Contained within this interval is the previously described marker: RCEN3.

The centromere on chromosome 4 was mapped between mi233 (18.8 cM) and mi167 (21.5 cM). A more refined position places the centromere between the markers T24H24.30k3 (~20.3 cM) and F13H14-t7 (~21.0 cM). The following sequenced (www.ncbi.nlm.nih.gov/Entrez/nucleotide.html) BAC (bacterial artificial chromosome) clones are known to span the region between the markers F5J15-sp6 and T6A13-sp6: T27D20, T19B17, T26N6, F4H6, T19J18, T4B21, T1J1, T32N4, C17L7, C6L9, F6H8, F2I12, F14G16, and F28D6.

There is a gap in BAC coverage between F2II2 and F14G16. RARE cleavage, pulse field gels or DNA sequence tiling will be used to isolate DNA in the gap for sequencing.

The centromere on chromosome 5 was mapped between nga76 (71.6 cM) and PhyC (74.3 cM). A more refined position places the centromere between the markers F13K20-t7 (~69.4 cM) and CUE1 (~69.5 cM). Contained within this interval are the publicly available markers: um579D, mi291b, CMs1.

A table listing the BAC clones known to reside within the centromeres on chromosomes I–V given as well as Genbank Accession numbers for the sequences of these clones, is given below, in Table 5 and Table 6.

Genetic positions (i.e. cM values) correspond to the Lister and Dean Recombinant Inbred Genetic map, available on-line at nasc.nott.ac.uk/new_ri_map.html. Markers are available at genome-www.stanford.edu/Arabidopsis/aboutcaps.html.

TABLE 5

BAC clones residing within *A. thaliana* centromeres and associated Genbank accession numbers

| | GENBANK ACCESSION # |
|---|---|
| CENTROMERE 1 | |
| F24P1 | B23044* |
| F13J4 | AL086967* and AL086966* |
| F7G10 | AL083686* and AL083685* |
| F28L22 | AC007505 |
| F17A20 | B23767* |
| F13G14 | AL086828* and AL086827* |
| F13O18 | AL087175* and AL087174* |
| F24A15 | AQ011599* and B98125* and B98124* |
| F25C4 | B23065* and B23064* |
| F3A6 | none |
| T32E20 | AC020646 |
| F20O7 | B22665 and B22664* |
| F16K23 | B97718* and B25748* and B23714* |
| F8L2 | AL084364* and AL084363* |
| F6C2 | AL083089* and AL083088* |
| F1H9 | AL080601* and AL080600* |
| F27O22 | AQ011488* and B25518* |
| F15P3 | B97045* and B22971* and B22970* |
| F24O6 | B23041* |
| F20P22 | AQ251396* and AQ251287* |
| F2C1 | AL081001* and AL081000* |
| F15F11 | B23547* |
| F1F24 | AL080554* and AL080553* |
| F6J1 | AL083277* |
| F26H20 | none |
| F16J24 | none |
| F19M18 | AQ011034* |
| F20K7 | AQ251392* and AQ251282* |
| F12G6 | AC007781† |
| F23F21 | none |
| F28G17 | none |
| F28G13 | none |
| F27A14 | AQ251243* and AQ251137* |
| F28G9 | B23346* and B23345* |
| F21F1 | B95997* and B22704* |
| F16K24 | B97719* and B25749* |
| F20C15 | AQ251381* and AQ251272* |
| F9G18 | AL084752* and AL084751* and B26534* |
| F10G23 | AL085268* and AL085267* |
| F22O16 | AQ250131* and AQ249777* and B96460* and B96459* and B12588* and B08235* |
| F23P24 | AQ011594* and B98116* and B98115* |
| F24A9 | AQ010513* and B96134* and B96133* |
| F26B21 | B25313* |
| F28O19 | B25706* |
| F19J21 | AQ011011* |
| F28E13 | B25592* and B25591* |
| F24G19 | B28443* |
| F15H9 | B22577* and B22576* |
| F28A11 | B25540* |
| F26N17 | B25374* |
| F15J24 | AQ011049* and B97568* |
| F25J4 | B23109* and B23108* |
| F28P16 | AQ011538* and B25713* |
| F12E11 | AL086267* and AL086266* |
| F28G8 | B23344* and B23343* |

TABLE 5-continued

BAC clones residing within *A. thaliana* centromeres and associated Genbank accession numbers

| | GENBANK ACCESSION # |
|---|---|
| F22L3 | B22875* and B22874* |
| F25C2 | B23063* |
| F22B13 | B29456* and B28433* |
| F13I14 | AL086945* and AL086944* |
| F11L16 | AL085969* and AL085968* |
| F25B1 | B23057* and B23056* |
| F26H18 | AQ010880* and AQ010879* |
| F20P4 | B22672* |
| F11K13 | AL085923* and AL085922* |
| F19G5 | AQ251104* |
| F15F7 | B22200* and B22199* |
| F16C4 | B98549* and B98548* and B23399* |
| GAP | |
| F19M16 | AQ011032* |
| F22M21 | B96432* and B96431* |
| F27K16 | none |
| F21K24 | B97937* |
| F13P3 | AL087187* and AL087186* |
| F15P18 | none |
| F28G19 | B25637* |
| F5E5 | AL082645* and AL082644* |
| F5K9 | AL082841* and AL082840* |
| F5E12 | AL082657* and AL082656* |
| F21N15 | B61476* |
| F5L13 | AL082880* and AL082879* |
| F17L20 | B23905* and B23904* |
| F14K1 | AL087586* and AL087585* |
| F16J4 | B98573* |
| F15M18 | none |
| F14I16 | AL087535* and AL087534* |
| F21K13 | none |
| F16E23 | none |
| F14O5 | AL087748* and AL087747* |
| F20G9 | B22553* and B22552* |
| F27I19 | AQ011427* and B25464* |
| F1I18 | AL080658* |
| F16C8 | B98552* and B22985* |
| F20O1 | B22655* |
| F13H12 | AL086902* and AL086901* |
| F13B12 | none |
| F27D7 | none |
| F21B16 | B24625* |
| F8F1 | AL084170* and AL084169* |
| F9A12 | |
| F22I11 | B24855* and B24854* |
| F16N17 | B25774* and B23737* |
| F17H11 | B23833* |
| F15A12 | none |
| F20M21 | none |
| F19E19 | B24191* |
| F25O15 | B25275* and B25274* |
| F27J13 | AQ011435* and B25468* |
| F15J7 | B22603* and B22602* |
| F13J1 | AL086961* and AL086960* |
| F9D18 | AC007183† |
| F9M8 | AL084923* |
| F5I9 | AL082775* |
| F3L22 | AL081822* and AL081821* |
| F5P23 | AL083021* |
| F10O23 | AL085527* and AL085526* |
| F20J1 | AQ010790* and B22625* |
| F7K22 | AL083828* and AL083827* |
| F6J23 | AL083299* and AL083298* |
| T4I21 | AC022456† |
| F1I6 | AL080639* and AL080638* |
| F28B8 | AQ010984* |
| F20B1 | B22488* and B22487* |
| F26F14 | None |
| F18C13 | B28362* |
| F20K13 | AQ011116* and B24519* |
| F10K7 | AL085379* |
| F5A13 | AC008046 |
| F12B23 | AL086177* |

TABLE 5-continued

BAC clones residing within *A. thaliana* centromeres and associated Genbank accession numbers

| | GENBANK ACCESSION # |
|---|---|
| F9I21 | AL084816* and AL084815* |
| F17I20 | B23850* and B23849* |
| CENTROMERE 2 | |
| T13E11 | AC006217 |
| F27C21 | AC006527 |
| F9A16 | AC007662 |
| T5M2 | AC007730 |
| T17H1 | AC007143 |
| T18C6 | AC007729 |
| T5E7 | AC006225 |
| T12J2 | AC004483 |
| GAP | |
| T14C8 | AC006219 |
| F7B19 | AC006586 |
| T15D9 | AC007120 |
| CENTROMERE 3 | |
| F6H5 | AL083229* and AL083228* |
| F6G13 | AL083215* and AL083214* |
| F21G23 | B97922* and B24664* |
| F3J24 | B19129* and B12732* |
| F25I7 | AQ010570* and B23104* |
| F14O12 | B22064* and B22004* |
| F1O10 | AL080869* and AL080868* |
| F11N16 | AL086039* and AL086038* |
| F19M19 | none |
| F3O1 | AL081890* and AL081889* |
| F1D9 | B21602* and B21631* and AQ248831* and AL080449* and AL080450* |
| F8F8 | none |
| F23A15 | none |
| F2O1 | AL081375* and AL081374* |
| F7I1 | AL083741* and AL083740* |
| F25D24 | B25156* and B25155* |
| F10L19 | AL085429* and AL085428* |
| F28J14 | B25860* and B25859* |
| F17D19 | B23796* and B23795* |
| F27O11 | B25508* |
| F27P23 | AQ011498* and B25537* |
| F11N11 | B28323* and B28322* |
| F16I17 | B97693* |
| GAP | |
| F1L15 | AL080750* and AL080749* |
| F2A9 | AL080941* and AL080940* |
| F2D1 | AL081028* and AL081027* |
| F2D22 | AL081046* and AL081045* |
| F2O8 | AL081387* and AL081386* |
| F2O14 | AL081393* and AL081392* |
| F3G24 | none |
| F9A7 | AL084546* and AL084545* |
| F10N9 | AL085473* and AL085472* |
| T1I15 | AL088212* and AL088211* and B19832* and B19707* |
| T1J6 | AL088233* and AL088232* and B19834* and B19709* |
| T2G13 | AL088663* and AL088662* |
| T6D10 | AL090573* and AL090572* and B27383* and B27382* and B19977* and B19790* |
| T7K14 | AL091315* and B27422* and B27421* and B20115* and B19895* |
| T8O12 | B21405* and B21348* |
| T9J24 | AL092268* and AL092267* and B20132* and B19911* |
| T9K2 | AL092269* and B20133* and B19912* |
| T10F10 | AL092618* and AL092617* and B20076* and B19918* |
| T15N4 | AL095818* and AL095817* and B20044* and B19856* |
| T16C1 | AL095981* and AL095980* |
| T16F22 | AL096108* |

TABLE 5-continued

BAC clones residing within A. thaliana centromeres and associated Genbank accession numbers

GENBANK ACCESSION #

| | |
|---|---|
| T16M9 | AL096289* and AL096288* and B20053* and B19865* |
| T18P7 | B60875* and B60874* |
| T21I24 | B62398* and B20320* and B20288* |
| T22E7 | B61351* and B20426* and B20394* |
| T24I9 | B67385* and B67384* and B20450* and B20419* |
| T24O5 | B67422* and B20454* |
| T25C15 | AQ225286* and B67937* and B20460* |
| T25F15 | AC009529† |
| F23H6 | AC011621 |
| T26J6 | B76816* and B76815* |
| T28G19 | AC009328† |
| GAP | |
| F6K8 | AL083310* and AL083309* |
| F25M24 | B25253* |
| F25F9 | B23085* |
| F28F20 | B25620* |
| F16C22 | B97681* and B23646* |
| F24M20 | B25096* |
| F27B5 | B23236* and B23235* |
| F21A14 | AC016828† |
| T4P3 | AC009992 |
| T14A11 | AC012327 |
| T26P13 | AC009261 |
| T18B3 | AC011624† |
| F12P5 | AL086610* and AL086609* |
| F22N7 | AQ251226* |
| F21N12 | B24707* |
| F7N6 | none |
| F12E16 | none |
| F21J13 | AQ251199* and AQ011170* |
| F25M18 | B25251* |
| F9B18 | AL084600* and AL084599* |
| F20J23 | AQ011113* and B24515* |
| F1G6 | AL080561* and AL080560* and AQ251107* |
| F7O4 | AL083940* and AL083939* |
| F1D4 | AL080441* and AL080440* and B22163* |
| F19P10 | AQ251376* and AQ251268* |
| F4P10 | AL082481* and AL082480* |
| F9I23 | AL084818* and AL084817* |
| F3I18 | AL081711* and AL081710* |
| F13K14 | AL087018* and AL087017* |
| F13K8 | AL087008* and AL087007* |
| F13J3 | AL086965* and AL086964* |
| F20F5 | B22533* |
| F1K22 | AL080723* and AL080722* |
| F3H19 | AL081679* and AL081678* |
| F23M13 | B98039* |
| F23N10 | B98054* and B98053* |
| F8M14 | AL084410* and AL084409* |
| F7C16 | AL083567* and AL083566* |
| F26D5 | none |
| F10J2 | AL085340* |
| F16L6 | B23418* |
| F26P16 | B25396* and B25395* |

TABLE 5-continued

BAC clones residing within A. thaliana centromeres and associated Genbank accession numbers

GENBANK ACCESSION #

GAP

| | |
|---|---|
| F28D17 | none |
| F27E12 | AQ251248* and AQ251142* and AQ011376* and AQ011375* |
| F4M19 | AL082399* and AL082398* |
| T27B3 | AL137079 |
| F26B15 | AL138645 |
| T14K23 | AL132909 |
| T32A11 | AL138653 |
| F3O21 | AL081924* and AL081923* |
| F3I14 | AL081705* and AL081704* |
| F20C5 | AQ251382* and AQ251273* |
| F14B7 | AL087267* and AL087266* |
| F14K13 | AL087604* and AL087603* |
| F21L14 | B97938* and B24690* |
| F23O12 | B98080* and B98079* |
| F14G1 | AL087450* and AL087449* |
| F19I17 | AQ225333* |
| F7C3 | AL083548* and AL083547* |
| F4I11 | AL082258* and AL082257* |
| F7J17 | AL083789* and AL083788* |
| F18L6 | B22332* and B22331* |
| F16N18 | B25775* |
| F28J6 | B23358* |
| F7C6 | AL083554* and AL083553* |
| F28C1 | B23304* and B23303* |
| F18I17 | B24063* |
| F10P16 | AL085555* and AL085554* |
| F24G17 | none |
| F4K4 | AL082320* and AL082319* |
| F26B15 | B25309* and B25308* |
| F12P9 | AL086614* and AL086613* |
| F8C3 | AL084070* and AL084069* |
| F25D21 | B25153* and B25152* |
| F27C7 | AQ010648* and AQ010647* and B23240* |
| F23G13 | none |
| F15B16 | AL087857* and AL087856* |
| CENTROMERE 4 | |
| T27D20 | AF076274 |
| T19B17 | AF069441 |
| T26N6 | AF076243 |
| F4H6 | AF074021 |
| T19J18 | AF149414 |
| T4B21 | AF118223 |
| T1J1 | AF128393 |
| T32N4 | AF162444 |
| C17L7 | none |
| C6L9 | none |
| T1J24 | AF147263 |
| F6H8 | AF178045 |
| F21I2 | AF147261 |
| GAP | |
| F14G16 | AF147260 |
| F28D6 | AF147262 |
| CENTROMERE 5 | |
| F3F24 | AC018632 |
| F13K20 | AL087030* and AL087029* |
| F6L19 | none |
| F23C8 | AC018928 |
| F18F14 | B10562* |
| F22D5 | AQ251214* |
| F12P18 | none |
| F6C14 | none |
| GAP | |
| F28N5 | B23377* |
| F2C13 | none |
| F12P1 | AL086602* |
| F9K2 | AL084855* |
| F23F23 | AL086757 |

TABLE 5-continued

BAC clones residing within *A. thaliana* centromeres and associated Genbank accession numbers

| | GENBANK ACCESSION # |
|---|---|
| F13D7 | AL086757* and AL086756* |
| F4C11 | AL082053* and AL082052* |
| F28G24 | none |
| F7C4 | AL083550* and AL083549* |
| F4B15 | AL082023* and AL082022* |
| F19I11 | AQ010999* |
| F3M22 | AL081848* and AL081847* |
| F1M22 | AL080803* and AL080802* |
| F21A22 | B24614* and B24613* |
| F8P23 | AL084535* and AL084534* |
| F17M7 | B22216* and B22215* |
| F21B21 | B24632* |
| F17G22 | B23828* and B23827* |
| F11P4 | AL086088* and AL086087* |
| F14J11 | AL087566* and AL087565* |
| F7J19 | AL083792* and AL083791* |
| F20G20 | none |
| F27H14 | AQ251251* and AQ251145* |
| F25E10 | none |
| F24I23 | B25815* and B25066* |
| T3D5 | AL089085* and AL089084* |
| T17G5 | AL096632* and AL096631* |
| F20C16 | B24433* |
| F27M22 | none |
| F27K1 | B23257* |
| F21N24 | B61479* and B24716* |
| F11F13 | AL085745* and AL085744* |
| F5O15 | AL082980* and AL082979* |
| F8G15 | AL084218* and AL084217* |
| F9A17 | B12265* and B10646* |
| F25E19 | none |
| F24C5 | AQ010525* and AQ010524* |
| F27L2 | AQ010708* and B96166* |
| F10A6 | AL085056* and AL085055* |
| F23B23 | AQ011184* |
| F1E3 | AL0804828* and AL080481* and B22171* and B22170* |
| GAP | |
| F20J17 | AQ011108* and B24510* |
| F21O22 | B24736* and B24735* |
| F26O21 | none |
| F25M11 | B25245* and B25244* |
| F18F8 | B26318* and B22290* |
| F17M12 | B23910* |
| F22M20 | B96430* |
| F9K6 | AL084860* |
| F13J20 | AL086992* and AL086991* |
| F12E24 | AL086282* and AL086281* |
| F26K6 | AQ010623* and AQ010622* |
| F12L5 | AL086477* and AL086476* |
| F11B6 | AL085606* and AL085605* |
| F21M19 | B24701* |
| F3N7 | AL081864* and AL081863* |
| F10J11 | none |
| F11F9 | AL085739* and AL085738* |
| F3G22 | AL081647* and AL081646* |
| F15E15 | B23535* |
| F10K18 | AL085397* and AL085396* |
| F5B20 | AL082559* and AL082558* |
| F1F13 | AL080535* |
| F26M13 | none |
| F18D9 | B26307* and B22283* |
| F28D1 | B23312* |
| F13C19 | AL086736* and AL086735* |
| F28I1 | none |
| F26D1 | B23180* |
| F16J19 | B97706* and B25740* |
| F2D20 | AL081042* |
| F22N6 | B98712* and B98711* |
| F27K3 | AQ010703* |
| F19I24 | AQ011005* |
| F19J19 | none |
| F24E18 | AQ011661* and AQ011660* and B25052* |
| F27K6 | AQ010706* and AQ010705* and B96164* and B23259* |
| F25L7 | AQ010583* |
| F28M5 | B23516* and B23371* |
| F18L3 | none |
| F14C23 | AL087326* and AL087325* |
| F11C6 | AL085640* and AL085639* |
| F6O24 | AL083442* and AL083441* |
| F1M8 | AL080782* and AL080781* |
| F16J23 | B97710* and B23709* |
| F18O9 | B98639* and B98638* and B98691* and B22349* |
| F26L23 | AQ011321* and AQ011320* |
| F3B13 | AL081491* and AL081490* |
| F22D12 | B24795* |
| F1G16 | none |
| F10M21 | AL085461* |
| F2A14 | AL080946* and AL080945* |
| F13M20 | AL087096* and AL087095* |
| F19J6 | none |
| F9O15 | AL085006* and AL085005* |
| F5A6 | AL082510* and AL082509* |
| F17D12 | B97751* and B23790* |
| F11C12 | AL085648* and AL085647* |
| F26P20 | B25400* and B25399* |
| F13I18 | AL086953* and AL086952* |
| F2I22 | B12725* and B08590* |
| F21B11 | B24621* and B24620* |
| F28A24 | AQ011507* and B25554* |
| F13O14 | AL087167* and AL087166* |
| F14A22 | AL087257* and AL087256* |
| F21G14 | B97912* |
| F18M12 | B09450* and B09052* |
| F3D18 | AL081552* |
| F28K14 | B25874* and B25873* |
| F28L21 | B25895* and B25894* |
| F1D3 | AL080439* and AL080438* |
| F16O19 | B97731* |
| F15I15 | AQ251156* and AQ251026* |
| F27G1 | AQ010677* and B23247* and B23246* |
| F22C19 | B97947* |
| F1E16 | AQ251175* |
| F18F18 | AQ251089 |
| F12P2 | AL086604* and AL086603* |
| F15O18 | B23621* and B23620* |
| F13D8 | AL086759* and AL086758* |
| F23J22 | AQ011543* and AQ011257* |
| F3K18 | none |
| F17O22 | AQ251082* |
| F25A22 | B25136* |
| F15G12 | AQ251153* and AQ251023* |
| F23A7 | B95912* and B95911* |
| F26L22 | AQ011319* and AQ011318* and B62693* |
| F11B20 | AL085623* and AL085622* |
| T28K13 | B61711* |
| T19L12 | B61940* and B61939* |
| F25A15 | AQ251405* and AQ251342* |
| F22H10 | AQ251219* |
| F3N13 | AL081870* and AL081869* |
| F27F24 | AQ251249* and AQ251143* |
| F27J18 | AQ011439* |
| F20K22 | AQ011121* and B24528* |
| F2J19 | AL081240* and AL081239* and B26437* |
| F9F4 | AL084708* and AL084707* and B30281* |
| F8P17 | AL084523* and AL084522* |
| F7E14 | AL083629* and AL083628* |
| F26J23 | AQ011270 |
| F19N2 | None |
| F27G5 | AQ010682* and AQ010681* |

*= partial (BAC end) sequence
†= full sequence in more than one part

TABLE 6

Fully sequenced BAC clones containing *A. thaliana* centromere sequences*

| Clone† | Genbank Accession No. | Date Of Availability# | Comment |
|---|---|---|---|
| CENTROMERE 1 | | | |
| F28L22 | AC007505 | Feb. 7, 2000; May 6, 1999 | |
| T32E20 | AC020646 | 10 Feb. 2000; Jan. 8, 2000 | |
| F12G6 | AC007781 | June 11, 1999 | 3 unordererd pieces |
| F9D18 | AC007183 | Mar. 30, 1999 | 6 unordererd pieces |
| T4I21 | AC022456 | Feb. 28, 2000; Feb. 3, 2000 | |
| FSA13 | AC008046 | Feb. 8, 2000; July 14, 1999 | |
| CENTROMERE 2 | | | |
| T13E11 | AC006217 | Dec. 17, 1999; Dec. 24, 1998 | |
| F27C21 | AC006527 | Dec. 17, 1999; Feb. 5, 1999 | |
| F9A16 | AC007662 | Dec. 17, 1999; May 27, 1999 | |
| T5M2 | AC007730 | Dec. 17, 1999; June 5, 1999 | |
| T17H1 | AC007143 | Dec. 17, 1999; Mar. 17, 1999 | |
| T18C6 | AC007729 | Dec. 17, 1999; June 5, 1999 | |
| T5E7 | AC006225 | Dec. 17, 1999; June 5, 1999 | |
| T12J2 | AC004483 | Dec. 17, 1999; July 17, 1999 | |
| GAP | | | |
| T6C20 | AC005898 | Mar. 20, 1999; Dec. 7, 1998 | 10 unordererd pieces |
| T14C8 | AC006219 | Dec. 17, 1999; Feb. 9, 1999 | |
| F7B19 | AC006586 | Dec. 17, 1999; Feb. 19, 1999 | |
| T15D9 | AC007120 | Dec. 17, 1999; Mar. 19, 1999 | |
| entire chromosome II | AE002093 | Dec. 17, 1999; Dec. 16, 1999 | |
| CENTROMERE 3 | | | |
| T25F15 | AC009529 | Dec. 3, 1999; Aug. 16, 1999 | 2 unordererd pieces |
| F23H6 | AC011621 | Nov. 24, 1999; Oct. 8, 1999 | |
| T28G19 | AC009328 | Oct. 26, 1999; Aug. 16, 1999 | 16 unordererd pieces |
| T18B3 | AC011624 | Nov. 18, 1999; Oct. 8, 1999 | 14 unordererd pieces |
| T26P13 | AC009261 | Nov. 3, 1999; Aug. 10, 1999 | |
| T14A11 | AC012327 | Nov. 20, 1999; Oct. 23, 1999 | |
| T4P3 | AC009992 | Oct. 21, 1999; Sep. 9, 1999 | |
| F21A14 | AC016828 | Jan. 13, 2000; Dec. 3, 1999 | 6 unordererd pieces |
| T27B3 | AL137079 | Jan. 21, 2000 | |
| F26B15 | AL138645 | Feb. 2, 2000 | |
| T14K23 | AL132909 | Nov. 12, 1999 | |
| T32A11 | AL138653 | Feb. 2, 2000 | |
| CHROMOSOME 4 | | | |
| T27D20 | AF076274 | Aug. 3, 1998 | |
| T19B17 | AF069441 | June 3, 1999 | |
| T26N6 | AF076243 | May 11, 1999 | |
| F4H6 | AF074021 | May 11, 1999 | |
| T19J18 | AF149414 | Aug. 13, 1999 | |
| T4B21 | AF118223 | Aug. 10, 1999; Jan. 7, 1999 | |
| T1J1 | AF128393 | Nov. 12, 1999 | |

TABLE 6-continued

Fully sequenced BAC clones containing A. thaliana centromere sequences*

| Clone† | Genbank Accession No. | Date Of Availability# | Comment |
|---|---|---|---|
| T32N4 | AF162444 | Aug. 13, 1999 | |
| C17L7 | AC012392 | Oct. 27, 1999 | |
| C6L9 | AC012477 | Nov. 6, 1999 | |
| T1J24 | AF147263 | Aug. 13, 1999 | |
| F6H8 | AF178045 | Aug. 19, 1999 | |
| F21I2 | AF147261 | May 11, 1999 | |
| GAP | | | |
| F14G16 | AF147260 | Aug. 13, 1999 | |
| F28D6 | AF147262 | Aug. 13, 1999 | |
| entire chromosome IV | websvr.mips.biochem.mpg.de/proj/thal/chr4_announcement/ | Dec. 17, 1999 | |
| CENTROMERE 5 | | | |
| F3F24 | AC018632 | Dec. 15, 1999 | |
| F23C8 | AC018928 | Dec. 24, 1999 | |

*The sequences for clones from centromeres 1, 3 and 5 are given in SEQ ID NOS:184–208. Sequences for contigs including the centromere 2 and 4 clones are given by SEQ ID NOS:209–212.
†BAC clone number designations are given. The centromere number origin of the clone is as indicated.
Where a second date is given, the second date indicates the date for the revised sequence.

EXAMPLE 7

Construction BAC Vectors for Testing Centromere Function

A BAC clone may be retrofitting with one or more plant telomeres and selectable markers together with the DNA elements necessary for Agrobacterium transformation (FIG. 9). This method will provide a means to deliver any BAC clone into plant cells and to test it for centromere function.

The method works in the following way. The conversion vector contains a retrofitting cassette. The retrofitting cassette is flanked by Tn10, Tn5, Tn7, Mu or other transposable elements and contains an origin of replication and a selectable marker for Agrobacterium, a plant telomere array followed by T-DNA right and left borders followed by a second plant telomere array and a plant selectable marker (FIG. 9). The conversion vector is transformed into an E. coli strain carrying the target BAC. The transposable elements flanking the retrofitting cassette then mediate transposition of the cassette randomly in to the BAC clone. The retrofitted BAC clone can now be transformed into an appropriate strain of Agrobacterium and then into plant cells were it can be tested for high fidelity meiotic and mitotic transmission which would indicate that the clone contained a complete functional plant centromere.

EXAMPLE 8

Construction of Plant Minichromosomes

Minichromosomes are constructed by combining the previously isolated essential chromosomal elements. Exemplary minichromosome vectors include those designed to be "shuttle vectors"; i.e., they can be maintained in a convenient host (such as E. coli, Agrobacterium or yeast) as well as plant cells.

A. General Techniques for Minichromosomes Construction

A minichromosome can be maintained in E. coli or other bacterial cells as a circular molecule by placing a removable stuffer fragment between the telomeric sequence blocks. The stuffer fragment is a dispensable DNA sequence, bordered by unique restriction sites, which can be removed by restriction digestion of the circular DNAs to create linear molecules with telomeric ends. The linear minichromosome can then be isolated by, for example, gel electrophoresis. In addition to the stuffer fragment and the plant telomeres, the minichromosome contains a replication origin and selectable marker than can function in plants to allow the circular molecules to be maintained in bacterial cells. The minichromosomes also include a plant selectable marker, a plant centromere, and a plant ARS to allow replication and maintenance of the DNA molecules in plant cells. Finally, the minichromosome includes several unique restriction sites where additional DNA sequence inserts can be cloned. The most expeditious method of physically constructing such a minichromosome, i.e., ligating the various essential elements together for example, will be apparent to those of ordinary skill in this art.

A number of minichromosome vectors have been designed by the current inventors and are disclosed herein for the purpose of illustration (FIGS. 7A–7H). These vectors are not limiting however, as it will be apparent to those of skill in the art that many changes and alterations may be made and still obtain a functional vector.

B. Modified Technique for Minichromosome Construction

Figure 11A:
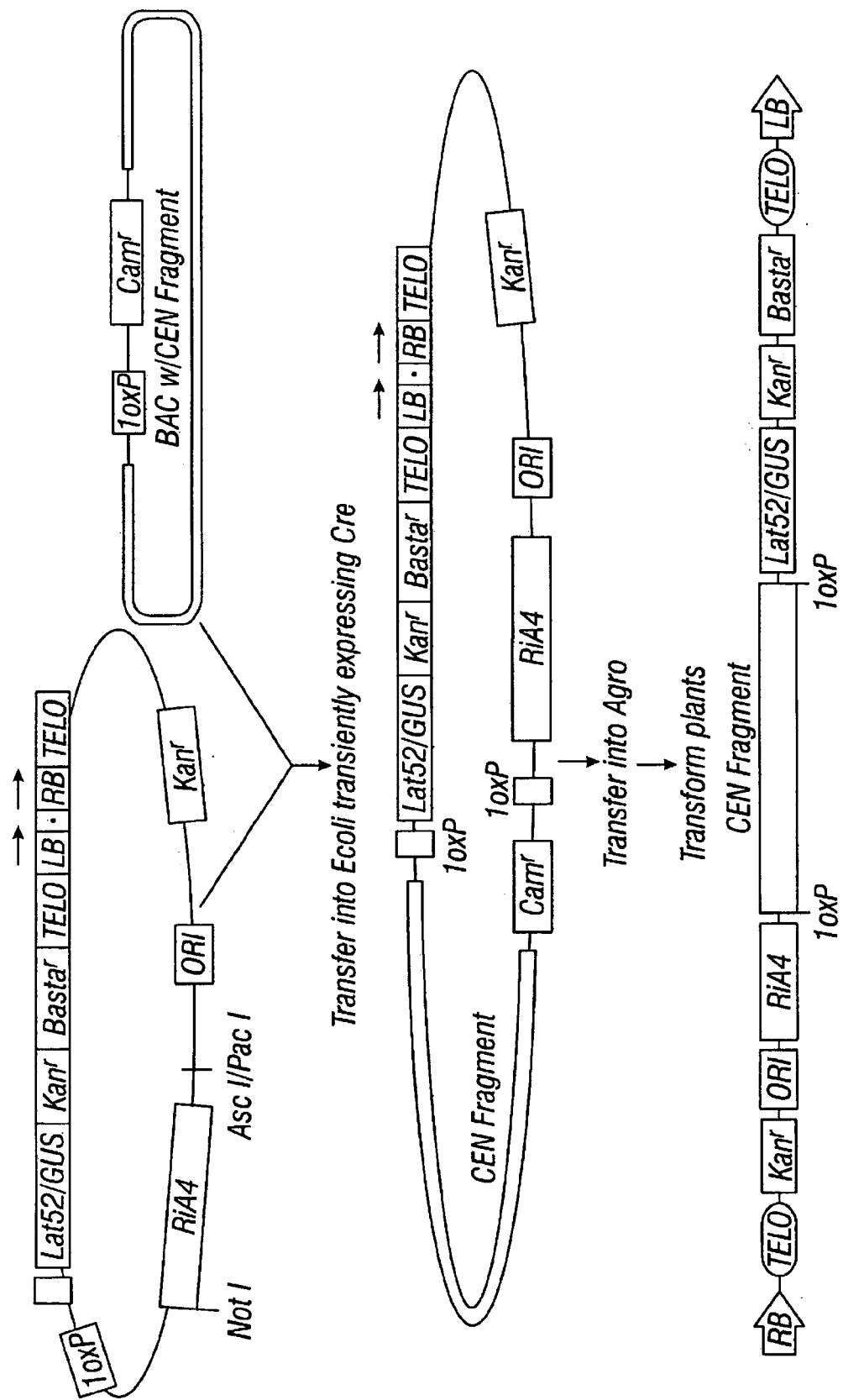

A two step method as developed for construction of minichromosomes, which allows adding essential elements to BAC clones containing centromeric DNA. These procedures can take place in vivo, eliminating problems of chromosome breakage that often happen in the test tube. The details and advantages of the techniques are as follows:

1.) One plasmid can be created that contains markers, origins and border sequences for Agrobacterium transfer, markers for selection and screening in plants, plant telomeres, and a lowP site or other site useful for site-specific recombination in vivo or in vitro. The second plasmid can be an existing BAC clone, isolated from the available genomic libraries (FIG. 11A).

Figure 11B:
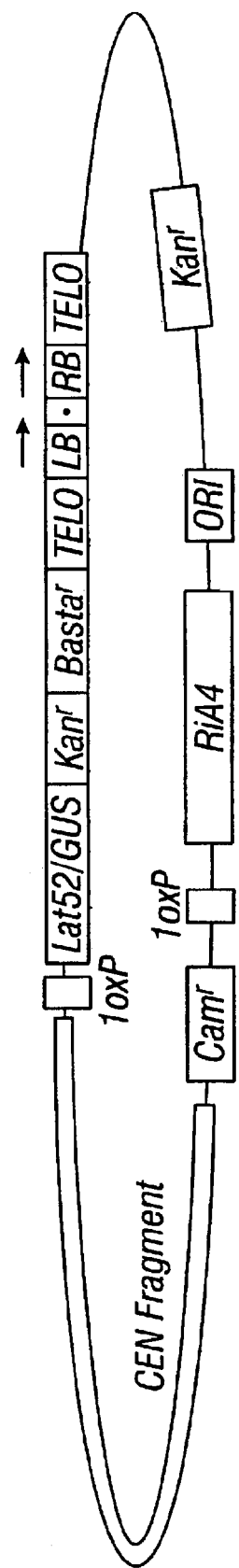

2.) The two plasmids are mixed, either within a single *E. coli* cell, or in a test tube, and the site-specific recombinase cre is introduced. This will cause the two plasmids to fuse at the loxP sites (FIG. 11B).

3.) If deemed necessary, useful restriction sites (AseI/PacI or Not I) are included to remove excess material. (for example other selectable markers or replication origins)

Figure 11C:
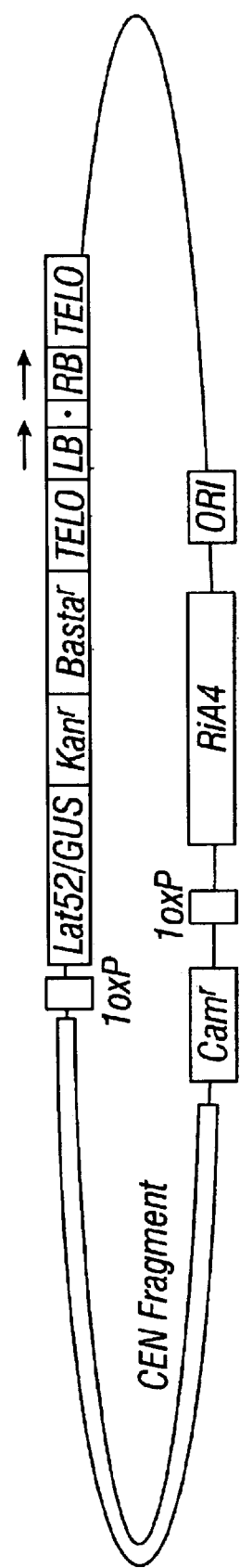
Figure 11D:
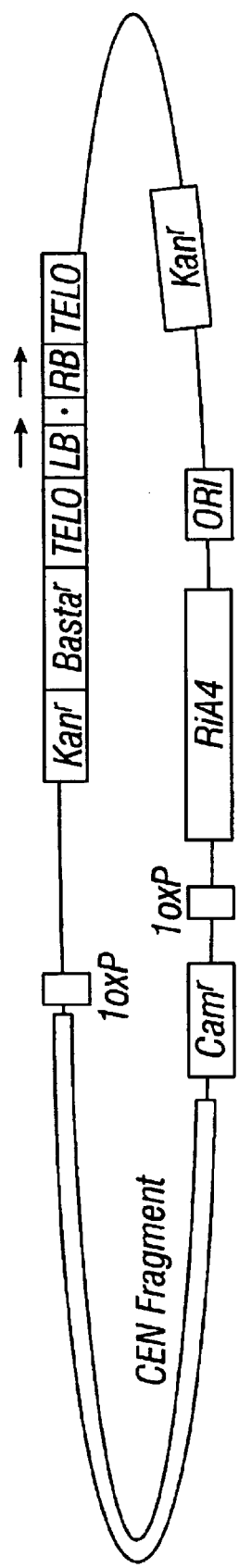
Figure 11E:
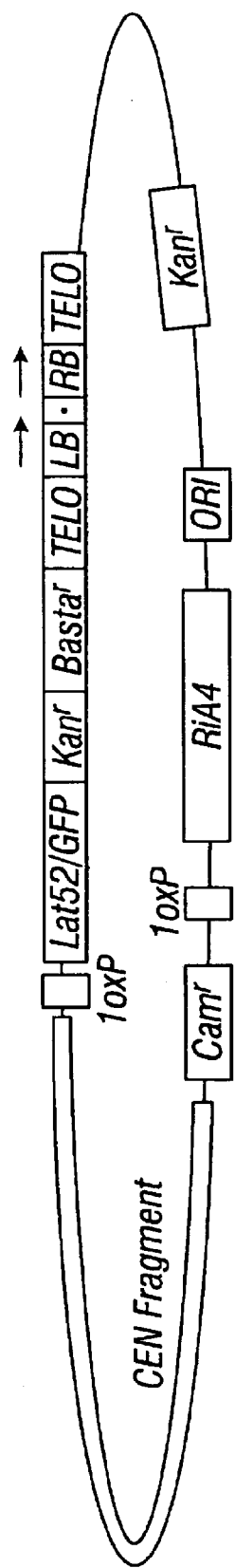

4.) Variations include vectors with or without a $Kan^R$ gene (FIGS. 11B, 11C), with or without a LAT52 GUS gene, with a LAT52 GFP gene, and with a GUS gene under the control of other plant promoters. (FIGS. 11C, 11D and 11E).

C. Method for Preparation of Stable Non-Integrated Minichromosomes

Figure 11F:
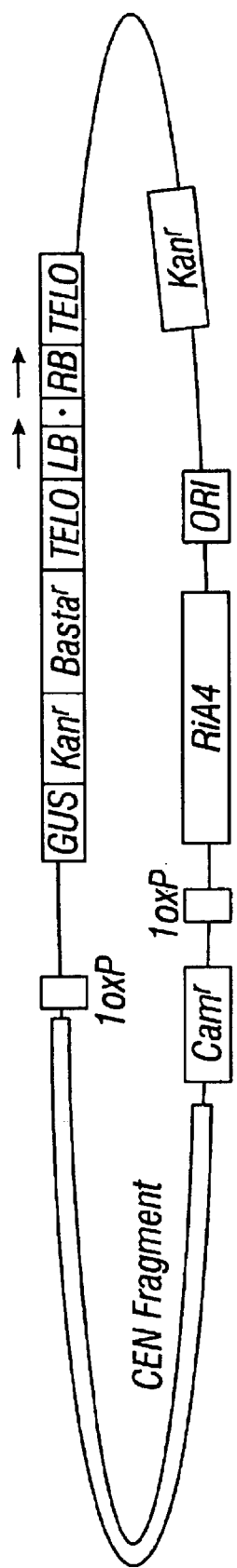
Figure 11G:
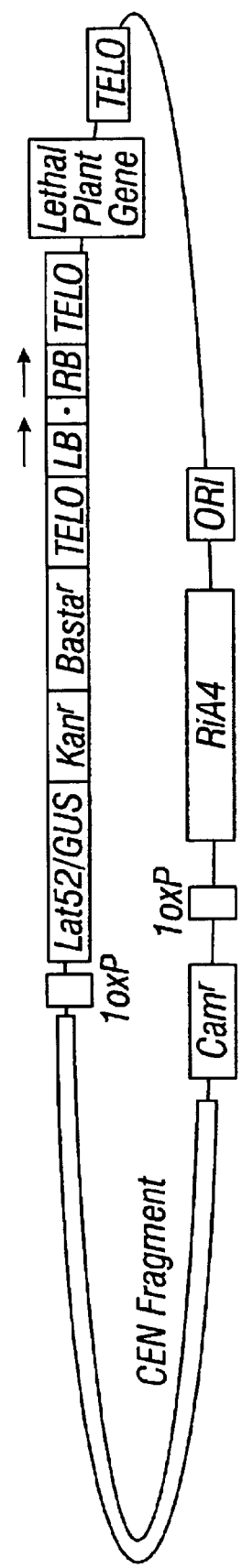

A technique has been developed to ensure that minichromosomes do no integrate into the host genome (FIG. 11F). In particular, minichromosomes must be maintained as distinct elements separate from the host chromosomes. To ensure that the introduced minichromosome does not integrate, the inventors envision a variety that would encode a lethal plant gene (such as diptheria toxin or any other gene product that, when expressed, causes lethality in plants). This gene could be located between the right Agrobacterium border and the telomere. Minichromosomes that enter a plant nucleus and integrate into a host chromosome would result in lethality. However, if the minichromosome remains separate, and further, if the ends of this construct are degraded up to the telomeres, then the lethal gene would be removed and the cells would survive.

EXAMPLE 9

In Vivo Screen of Centromere Activity by the Analysis of Dicentric Chromosomes

A method was designed for the screening of centromere activity (FIG. 10). In the method, plants are first transformed with binary BAC clones that contains DNA from the genetically-defined centromeric regions. By allowing the DNA to integrate into the host chromosomes, it is expected that this integration will result in a chromosome with two centromeres. This is an unstable situation which often leads to chromosome breakage, as single chromosomes harboring two or more functional centromeres will often times break at junctions between the two centromeres when pulled towards opposite poles during mitotic and meiotic events. This can lead to severe growth defects and inviable progeny when genes important or essentially for cellular and developmental processes are disrupted by the breakage event. Therefore, regions having centromere function could be identified by looking for clones that exhibit, upon introduction into a host plant, any of the following predicted properties: reduced efficiencies of the transformation; causation of genetic instability when integrated into natural chromosomes such that the transformed plants shown aberrant sectors and increased lethality; a difficulty to maintain, particularly when the transformed plants are grown under conditions that do not select for maintenance of the transgenes; a tendency to integrate into the genome at the distal tips of chromosomes or at the centromeric regions. In contrast, clones comprising non-centromeric DNA will be expected to integrate in a more random pattern. Confirmation of a resulting distribution and pattern of integration can be determined by sequencing the ends of the inserted DNA.

The screen is performed by identifying clones of greater than 100kb that encode centromere DNA in a BiBAC library (binary bacterial artificial chromosomes) (Hamilton, 1997). This is done by screening filters comprising a BiBAC genomic library for clones that encode DNA from the centromeres (FIG. 10, step 1). The BiBAC vector is used because it can contain large inserts of Arabidopsis genomic material and also encodes the binary sequences needed for Agrobacterium-mediated transformation. The centromere sequence containing BiBAC Vectors are then directly integrated into chromosomes by Agrobacterium-mediated transformation (FIG. 10, step 2). As a control, BiBAC constructs containing non-centrometric DNA also are used for transformation. BiBACs harboring sequences with centromere function will result in forming dicentric chromosomes. Progeny from transformed plants will be analyzed for non-viability and gross morphological differences that can be attributed to chromosomal breaks due to the formation of dicentric chromosomes (FIG. 10, step 3). Non-centromere sequences are expected to show little phenotypic differences from wildtype plants.

EXAMPLE 10

Refined Centromere Mapping with Treatment for Increased Recombination

In order to achieve a more refined map position for the centromeres in *Arabidopsis thaliana,* various chemical and environmental treatments were used to stimulate recombination. The treatments were used on pollen donors in crosses performed to create the tetrad sets of plants (see EXAMPLE 2). Pollen donor plants were planted individually in 1 inch square pots and grown under 24 hr light in a growth room until flowering. Flowering plants were then dipped in one of the following solutions and watered with 50 ml of the same solution.

TABLE 7

Chemical Treatment Agents.

| COMPOUND | SOURCE | CONCENTRATION RANGE |
| --- | --- | --- |
| Mitomycin C: | Sigma | from about 0.1 to about 30 mg/L, and preferably, about 10 mg/L |
| 5-aza-2'-deoxycytidine: | Sigma | from about 0.1 mg/L to about 50 mg/L, and preferably, about 25 mg/L |
| n-butyric acid (a.k.a. sodium butyrate): | Sigma | from about 0.1 mM to about 40 mM, and preferably, about 20 mM |
| Trichostatin A: | Sigma | from about 0.1 $\mu$M to about 30 $\mu$M, and preferably, about 10 $\mu$M |
| Methanesulfonic acid methyl ester: | Sigma | from about 0.1 ppm to about 200 ppm, and preferably, about 75 ppm |
| Methanesulfonic acid ethyl ester: | Sigma | from about 0.01% to about 0.2%, and preferably, about 0.05% |

TABLE 7-continued

Chemical Treatment Agents.

| COMPOUND | SOURCE | CONCENTRATION RANGE |
|---|---|---|
| 3-methoxybenzamide: | Aldrich Chemical Co. | from about 0.1 mM to about 10 mM, and preferably, about 2 mM |
| Zeocin: | Invitrogen | from about 0.1 μg/ml to about 5 μg/ml, and preferably, about 1 μg/ml |
| n-nitroso-n-ethylurea: | Sigma | from about 1 μM to about 200 μM, and preferably, about 100 μM |
| cis-diamminedichloro-platinum (II): | Aldrich Chemical Co. | from about 0.1 μg/ml to about 60 μg/ml, and preferably, about 20 μg/ml |
| sodium azide | Sigma | from about 0.01 mM to 10 mM |
| Dimethylnitrosamine | Sigma | from about 1 μM to about 1 mM |
| Bleomycin | Sigma | from about 0.1 mg/L to about 30 mg/L |
| Aflotoxin B1 | Sigma | from about 8 μg/ml to about 800 μg/ml |
| 8-methoxypsoralen | Sigma | From about 0.01 mM to about 50 mM |
| Cyclophosphamide | Sigma | from about .001 mg/L to about 500 mg/L |
| Hydroxyurea | Sigma | from about 1 mM to about 0.01 mM |
| Actinomycin D | Sigma | from about 0.0001% to about 0.1% solution |
| Diepoxybutane | Sigma | from about 0.001% to about 1.0% solution |
| Caffeine | Sigma | from about 0.01% to about 5.0% solution |

Following treatment, plants were then returned to the growth room and grown under standard conditions for 2–5 days. Pollen was then collected from newly opened flowers and used to pollinate receptive stigmas as described in Example 2. Then the pollen donor plants were again treated as described above and used in another round of pollination. Pollen donor plants were typically subjected to 5–10 rounds of treatment and pollen collection.

Treatments were also performed using non-chemical agents. As above, the treatments were used to achieve more refined map positions for the centromeres in Arabidopsis by stimulating recombination in addition pollen donor plants. The treatments were as follows:

TABLE 8

Non-Chemical Treatment Agents.

| TREATMENT | TREATMENT PARAMETERS |
|---|---|
| heat shock: | about 35° C. to about 48° C., and preferably, about 42° C. |
| UV exposure (350 nm): | about 1 second to about 50 seconds, and preferably, about 7 seconds |
| Gamma radiation: | about 0.1 kRads to about 20 kRads, and preferably, about 10 kRads |
| Magnetic field | about 1 to 20 Tesla for 1 h to continuous |
| cold stress | about −10 to 15 C for 1 min to continuous |

Heat shock treatments were performed by placing the pot containing the pollen donor plants in shallow dishes filled with water (to prevent desiccation), and placing the plant-containing dishes in incubators of the appropriate temperature. UV exposure was performed by placing the pollen donor plants in a BioRad UV chamber and illuminating the plants at the appropriate wave length for varying amounts of time. Both the UV and heat shock plants were subjected to several rounds of treatment and pollen collection. Plants exposed to a gamma radiation source (Cobalt-60) were treated only once and then discarded to prevent the accumulation of deleterious chromosomal rearrangements.

Following treatment, plants were then returned to the growth room and grown under standard conditions for 2–5 days. Pollen was then collected from newly opened flowers and used to pollinate receptive stigmas as described in Example 2. Then the pollen donor plants were again treated as described above and used in another round of pollination. Pollen donor plants were typically subjected to 5–10 rounds of treatment and pollen collection. The results are shown at Table 9 below.

TABLE 9

Results of Recombination After Treatments

| Treatment | Tetrads | Obs | Exp | $(O - E)^2/E = X^2$ |
|---|---|---|---|---|
| n-butyric acid | 43 | 11 | 2.5 | 28.9** |
| UV exposure 350 nm | 57 | 12 | 3.2 | 24.2** |
| Methanesulfonic acid ethyl ester | 10 | 5* | 0.6 | 32.2** |
| 5-aza-2'-deoxycytidine | 68 | 16 | 3.9 | 37.5** |
| heat shock | 23 | 7 | 1.3 | 25.0** |
| 3-methoxybenzamide | 44 | 8 | 2.5 | 12.1** |
| Zeocin | 106 | 14 | 6.0 | 10.6** |
| Untreated | 384 | 22 | N/A | N/A |

**indicates significant by $X^2$ (df = 1)

EXAMPLE 11

Facilitation of Genetic Introgression

It is also contemplated by the inventors that one could employ techniques or treatments which stimulate recombination to facilitate introgression. Introgression describes a breeding technique whereby one or more desired traits is transferred into one strain (A) from another (B), the trait is then isolated in the genetic background of the desired strain (A) by a series of backcrosses to the same strain (A). The number of backcrosses required to isolate the desired trait in the desired genetic background is dependent on the frequency of recombination in each backcross.

Backcrossing transfers a specific desirable trait from one source to an inbred or other plant that lacks that trait. This can be accomplished, for example, by first crossing a superior inbred (A) (recurrent parent) to a donor inbred (non-recurrent parent), which carriers the appropriate gene (s) for the trait in question, for example, a construct prepared in accordance with the current invention. The progeny of this cross first are selected in the resultant progeny for the desired trait to be transferred from the non-recurrent parent, then the selected progeny are mated back to the superior recurrent parent (A). After five or more backcross generations with selection for the desired trait, the progeny are hemizygous for loci controlling the characteristic being transferred, but are like the superior parent for most or almost all other genes. The last backcross generation would be selfed to give progeny which are pure breeding for the gene(s) being transferred, i.e. one or more transformation events.

Therefore, through a series a breeding manipulations, a selected transgene may be moved from one line into an entirely line without the need for further recombinant manipulation. Transgenes are valuable in that they typically behave genetically as any other gene and can be manipulated by breeding techniques in a manner identical to any other corn gene. Therefore, one may produce inbred plants which are true breeding for one or more transgenes. By crossing different inbred plants, one may produce a large number of different hybrids with different combinations of transgenes. In this way, plants may be produced which have the desirable agronomic properties frequently associated with hybrids ("hybrid vigor"), as well as the desirable characteristics imparted by one or more transgene(s).

Breeding also can be used to transfer an entire minichromosome from one plant to another plant. For example, by crossing a first plant having a minichromosome to a second plant lacking the minichromosome, progeny of any generation of this cross may be obtained having the minichromosome, or any additional number of desired minichromosomes. Through a series of backcrosses, a plant may be obtained that has the genetic background of the second plant but has the minichromosome from the first plant.

All of the compositions and methods disclosed and claimed herein can be made and executed without experimentation in light of the present disclosure. While the compositions and methods of this invention have been described in terms of preferred embodiments, it will be apparent to those of skill in the art that variations may be applied to the compositions and methods and in the steps or in the sequence of steps of the method described herein without departing from the concept, spirit and scope of the invention. More specifically, it will be apparent that certain agents which are both chemically and physiologically related may be substituted for the agents described herein while the same or similar results would be achieved. All such similar substitutes and modifications apparent to those skilled in the art are deemed to be within the spirit, scope and concept of the invention as defined by the appended claims.

REFERENCES

The following references, to the extent that they provide exemplary procedural or other details supplementary to those set forth herein, are specifically incorporated herein by reference.

Abdullah et al., *Biotechnology*, 4:1087, 1986.
Abel et al., *Science*, 232:738–743, 1986.
Alfenito et al., "Molecular characterization of a maize B chromosome centric sequence," *Genetics*, 135:589–597, 1993.
Araki et al., "Site-specific recombinase, R, encoded by yeast plasmid pSR1," *J. Mol. Biol.* 225:25–37, 1992.
Barkai-Golan et al., *Arch. Microbiol*, 116:119–124, 1978.
Baum et al., "The centromeric K-type repeat and the central core are together sufficient to establish a functional Schizosaccharomyces pombe centromere," *Mol. Biol. Cell.*, 5:747–761, 1994.
Bell et al., "Assignment of 30 microsatellite loci to the linkage map of Arabidopsis," *Genomics*, 19:137–144, 1994.
Bernal-Lugo and Leopold., *Plant Physiol.*, 98:1207–120, 1992.
Berzal-Herranz et al., *Genes and Devel.*, 6:129–134, 1992.
Bevan et al., *Nucleic Acids Research*, 11(2):369–385, 1983.
Bevan et al., *BioEassays* 21:110, 1999.
Blackman et al., *Plant Physiol.*, 100:225–230, 1992.
Bloom, "The centromere frontier: Kinetochore components, microtubule-based motility, and the CEN-value paradox," *Cell*, 73:621–624, 1993.
Bol et al., Annu. Rev. Phytopath., 28:113–138, 1990.
Bowler et al., *Ann Rev. Plant Physiol.*, 43:83–116, 1992.
Brandes et al., *Chrom. Res.*, 5:238, 1997.
Branson and Guss, *Proceedings North Central Branch Entomological Society of America*, 27:91–95, 1972.
Brisson et al., *Nature*, 310:511, 1984.
Broach et al., *Gene*, 8:121–133, 1979.
Broakaert et al., *Science*, 245:1100–1102, 1989.
Burke et al., *Science*, 236:806–812, 1987.
Bytebier et al., *Proc. Natl. Acad. Sci. USA*. 84:5345, 1987.
Callis et al., *Genes and Development*, 1:1183, 1987.
Cambareri et al., *Mol. Cell. Biol.*, 18:5465, 1998.
Campbell (ed.), In: *Avermectin and Abamectin*, 1989.
Campbell, "Monoclonal Antibody Technology, Laboratory Techniques in Biochemistry and Molecular Biology," Vol. 13, Burden and Von Knippenberg, Eds., pp. 75–83, Elsevier, Amsterdam, 1984.
Capecchi, "High efficiency transformation by direct microinjection of DNA into cultured mammalian cells," *Cell* 22(2): 479–488, 1980.
Carbon et al., In: *Recombination Molecules: Impact on Science and Society* (Raven Press), 335–378, 1977.
Carbon et al., "Centromere structure and function in budding and fission yeasts," *New Biologist*, 2:10–19, 1990.
Carpenter et al., "The control of the distribution of meiotic exchange in Drosophilla melanogaster," *Genetics*, 101:81–90, 1982.
Cech et al., "In vitro splicing of the ribosomal RNA precursor of Tetrahymena: involvement of a guanosine nucleotide in the excision of the intervening sequence," *Cell*, 27:487–496, 1981.
Chandler et al., *The Plant Cell*, 1:1175–1183, 1989.
Chang et al., "Restriction fragment length polymorphism linkage map for Arabidopsis thaliana," *Proc. Natl Acad. Sci., USA*, 85:6856–6860, 1988.
Charlesworth et al., *Nature*, 371:215, 1994.
Charlesworth, C. H. Langley, W. Stephan, 112:947, 1986.
Chepko, *Cell*, 37:1053, 1984.
Choi et al., *Plant Mol Biol Rep*, 13:124–29, 1995.
Choo, K. H. A. *Genome Res.* 8:81, 1998.
Chowrira et al., "In vitro and in vivo comparison of hammerhead, hairpin, and hepatitis delta virus self-processing ribozyme cassetyes," *J. Biol. Chem.*, 269:25856–25864, 1994.
Chu et al., "Separation of large DNA molecules by contour-clamped homogeneous electric fields" *Science*, 234, 1582–1585, 1986.
Chye et al., *Plant Mol. Biol.*, 35:893, 1997.
Clapp, "Somatic gene therapy into hematopoietic cells, Current status and future implications," *Clin. Perinatol.* 20(1):155–168, 1993.
Clark, L. *Curr. Op. Gen. & Dev.*, 8:212, 1998.
Clarke et al., "Isolation of a yeast centromere and construction of functional small circular chromosomes," *Nature*, 287:504–509, 1980.
Cohen et al., *Proc. Nat'l Acad. Sci. USA*, 70:3240, 1973.
Conkling et al., *Plant Physiol.*, 93:1203–1211, 1990.
Copenhaver and Pikaard, "RFLP and physical mapping with an rDNA-specific endonuclease reveals that nucleolus organizer regions of Arabidopsis thaliana adjoin the telomeres on chromosomes 2 and 4," *Plant J.*, 9:259–276, 1996.
Copenhaver et al., "Use of RFLPs larger than 100 kbp to map position and internal organization of the nucleolus organizer region on chromosome 2 in Arabidopsis thaliana," *Plant J.* 7, 273–286, 1995.
Copenhaver et al., *Proc. Natl. Acad. Sci.* 95:247, 1998.
Copenhaver et al., *Science*, 286:2468–2474, 1999.
Copenhaver and Preuss, *Plant Biology*, 2:104–108, 1999.
Coxson et al., *Biotropica*, 24:121–133, 1992.
Creusot et al., *Plant Journal*, 8:763–70, 1995.
Cristou et al., *Plant Physiol*, 87:671–674, 1988.

Cuozzo et al., *Bio/Technology*, 6:549–553, 1988.
Curiel et al., "Adenovirus enhancement of transferrin-polylysine-mediated gene delivery," *Proc. Natl Acad. Sci. USA* 88(19):8850–8854, 1991.
Curiel et al., high-efficiency gene transfer mediated by adenovirus coupled to DNA-polylysine complexes," *Hum. Gen. Ther.* 3(2):147–154, 1992.
Cutler et al., *J. Plant Physiol.*, 135:351–354, 1989.
Czapla and Lang, *J. Econ. Entomol.*, 83:2480–2485, 1990.
Davies et al., *Plant Physiol.*, 93:588–595, 1990.
Dellaporta et al., *In: Chromosome Structure and Function: Impact of New Concepts, 18th Stadler Genetics Symposium*, 11:263–282, 1988.
Depicker et al., *Plant Cell Reports*, 7:63–66, 1988.
DiLaurenzio et al., *Cell*, 86:423–33, 1996.
Dillion et al., *Recombinant DNA Methodology*, 1985.
Donahue et al., "The nucleotide sequence of the HIS4 region of yeast," *Gene* Apr: 18(1):47–59, 1982.
Dure et al., *Plant Molecular Biology*, 12:475–186, 1989.
Earnshaw et al., "Proteins of the inner and outer centromere of mitotic chromosomes," *Genome*, 31:541–552, 1989.
Earnshaw, "When is a centromere not a kinetochore?," *J. Cell Sci.*, 99:1–4, 1991.
Ebert et al., 84:5745–5749, *Proc. Nat'l Acad. Sci. USA*, 1987.
Ecker, J R, *Genomics*, 19:137–144.
Ecker, *Methods*, 1:186–94, 1990.
Eglitis et al., "Retroviral vectors for introduction of genes into mammalian cells," *Biotechniques* 6(7):608–614, 1988.
Eglitis et al., "Retroviral-mediated gene transfer into hemopoietic cells," *Avd. Exp. Med. Biol.* 241:19–27, 1988.
Enomoto et al., "Mapping of the pin locus coding for a site-specific recombinase that causes flagellar-phase variation in *Escherichia coli* K-12," *J. Bacteriol.*, 156:663–668, 1983.
Erdmann et al., *J. Gen. Microbiology*, 138:363–368, 1992.
Ferrin et al., "Selective cleavage of human DNA: RecA-Assited Restriction Endonuclease (RARE) cleavage," *Science*, 254:1494–1497, 1991.
Fitzpatrick, *Gen. Engineering News*, 22:7, 1993.
Fleig, U. et al., "Functional selection for the centromere DNA from yeast chromosome VIII," *Nuc. Acids. Res.* 23:992–924, 1995.
Forster and Symons, "Self-cleavage of plus and minus RNAs of a virusoid and a structural model for the active sites," *Cell*, 49:211–220, 1987.
Fraley et al., *Biotechnology*, 3:629, 1985.
Franz et al., *Plant J.*, 13:867, 1998.
Fromm et al., *Nature*, 312:791–793, 1986.
Fromm et al., "Expression of genes transferred into monocot and dicot plant cells by electroporation," *Proc. Natl. Acad. Sci. USA* 82(17):5824–5828, 1985.
Fujimura et al., *Plant Tissue Culture Letters*, 2:74, 1985.
Fynan et al., "DNA vaccines: protective immunizations by parenteral, mucosal, and gene gun incoulations," *Proc. Nat'l Acad. Sci. USA* 90(24):11478–11482, 1993.
Gatehouse et al., *J. Sci. Food. Agric.*, 35:373–380, 1984.
Gefter et al., *Somatic Cell Genet.* 3:231–236, 1977.
Gerlach et al., "Construction of a plant disease resistance gene from the satellite RNA of tobacco rinsport virus," *Nature (London)*, 328:802–805, 1987.
Goding, "Monoclonal Antibodies: Principles and Practice," pp. 60–74. 2nd Edition, Academic Press, Orlando, Fla. 1986.
Golic and Lindquist, "The FLP recombinase of yeast catalyses site-specific recombination in the *Drosophila* genome," *Cell*, 59:499–509, 1989.
Goring et al., *Proc. Natl. Acad. Sci. USA*, 88:1770–1774, 1991.
Graham et al., "Transformation of rat cells by DNA of human adenovirus 5," *Virology* 54(2):536–539, 1973.
Grill and Somerville, *Mol Gen. Genet*, 226:484–90, 1991.
Guerrero et al., *Plant Molecular Biology*, 15:11–26, 1990.
Gupta et al., *Proc. Natl. Acad. Sci. USA*, 90:1629–1633, 1993.
Gutierrez-Marcos et al., *Proc. Natl. Acad. Sci., USA*, 93:13377, 1996.
Haaf et al., "Integration of human α-satellite DNA into simian chromosomes: centromere protein binding and disruption of normal chromosome segregation," *Cell*, 70:681–696, 1992.
Hadlaczky et al., "Centromere formation in mouse cells cotransformed with human DNA and a dominant marker gene," *Proc. Natl. Acad. Sci. USA*, 88:8106–8110, 1991.
Hamilton et al., "Stable transfer of intact high molecular weight DNA into plant chromosomes," *Proc. Natl. Acad. Sci USA* 93(18):9975–9, 1996.
Hamilton, "A binary-BAC system for plant transformation with high-molecular-weight DNA," *Gene*, 4;200(1–2):107–16, 1997.
Hammock et al., *Nature*, 344;458–461, 1990.
Haseloff et al., *Proc. Nat'l Acad. Sec. USA* 94(6):2122–2127, 1997.
Hauge et al., *Symp Soc Exp Biol.*, 45:45–56, 1991.
Hegemann et al., "The centromere of budding yeast," *Bioassays*, 15(7):451–460, 1993.
Hemenway et al., *The EMBO J.*, 7:1273–1280, 1988.
Heslop-Harrison et al., *Plant Cell*, 11:31, 1999.
Hilder et al., *Nature*, 330:160–163, 1987.
Hinchee et al., *Bio/technol.*, 6:915–922, 1988.
Hoess et al., *Proc. Natl. Acad. Sci.*, 79:3398–402, 1982.
Hsiao et al., J. Proc., Nat'l Acad. Sci. USA, 76:3829–3833, 1979.
Hudspeth and Grula, *Plant Mol. Biol.*, 12:579–589, 1989.
Hwang et al., "Identification and map position of YAC clones comprising one-third of the Arabidopsis genome, *The Plant Journal*, 1:367–374, 1991.
Ikeda et al., *J. Bacteriol.*, 169:5615–5621, 1987.
Ikuta et al., *Bio/technol.*, 8:241–242, 1990.
Inohara et al., *J. Bio. Chem.*, 266, 7333, 1991.
Johnston et al., "Gene gun transfection of animal cells and genetic immunization," *Methods Cell. Biol.* 43(A):353–365, 1994.
Jones, *Embo J.*, 4:2411–2418, 1985.
Jones, *Mol Gen. Genet.*, 207:478, 1987.
Jorgensen et al., *Mol. Gen. Genet.*, 207:471, 1987.
Jouanin et al., *Mol Gene Genet*, 201:370–4, 1985.
Joyce, "RNA evolution and the origins of life," *Nature*, 338:217–244, 1989.
Kaasen et al., *J. Bacteriology*, 174:889–898, 1992.
Karpen, *Curr. Op. Gen. & Dev.* 4:281, 1994.
Karsten et al., *Botanica Marina*, 35:11–19, 1992.
Katz, et al., *J. Gen. Microbiol.*, 192:2703–2714, 1983.
Kim and Cech. "Three dimensional model of the active site of the self-splicing rRNA precursor of Tetrahymena," *Proc. Natl. Acad. Sci. USA*, 84:8788–8792, 1987.
Klee et al., *Bio/Technology* 3:637–642, 1985.
Klein et al., *Nature*, 327:70–73, 1987.
Klein et al., *Proc. Nat'l Acad. Sci. USA*, 85:8502–8505, 1988.
Kohler et al., *Eur. J. Immunol.* 6:511–519, 1976.
Kohler et al., *Nature* 256:495–497, 1975.
Konieczny et al., "A procedure for mapping Arabidopsis mutations using codominant ecotype-specific PCR-based markers," *The Plant Journal*, 4:403–410, 1993.
Konieczny et al., *Genetics*, 127:801, 1991.
Koorneef et al., *Genetica*, 61:41–46, 1983.
Koorneef, "Linkage map of *Arabidopsis thaliana* (2n=10)," *In S J O'Brien, et, Genetic Maps* 1987: *A complication of linkage and restriction maps of genetically studied organisms*, 724–745, 1987.

Korneef, "The use of telotrisomics for centromere mapping in *Arabidopsis thaliana* (L.) Heynh, *Genetica*, 62:33–40, 1983.
Koster and Leopold, *Plant Physiol.*, 88:829–832, 1988.
Kuby, J., *Immunology 2nd Edition*, W. H. Freeman & Company, N.Y. 1994.
Kuhn et al., *Proc. Natl. Acad. Sci.*, 88:1306, 1991.
Kyte et al., A simple method for displaying the hydropathic character of a protein," *J. Mol. Biol.* 157(1):105–132, 1982.
Lawton et al., *Plant Mol. Biol.* 9:315–324, 1987.
Lechner et al., "A 240 kd multisubunit protein complex, CBF3 is a major component of the budding yeast centromere," *Cell*, 64:717–725, 1991.
Lee and Saier, *J. of Bacteriol.*, 153–685, 1983.
Levings, *Science*, 250:942–947, 1990.
Lewin, *Genes II*, John Wiley & Sons, Publishers, N.Y., 1985.
Li et al., *Plant Cell.*, 7:1599, 1995.
Li et al., *Proc. Natl., Acad. Sci.*, 87:4580–4584, 1990.
Leiber and Strauss, "Selection of efficient cleavage sites in target RNAs by using a ribozyme expression library." *Mol. Cell. Biol.*, 15: 540–551, 1995.
Lin, S., Kaul, S. Rounsley, T. P. Shea, M-I. Benito, C. D. Town, C. Y. Fujii, T. Mason, C. L. Bowman, M. Barnstead, T. Feldblyum, C. R. Buell, K. A. Ketchum, C. M. Ronning, H. Koo, K. Moffat, L. Cronin, M. Shen, G. Pai, S. Van Aken, L., Umayam, L. Tallon, J. Gill, M. D. Adams, A. J. Carrera, T. H. Creasy, H. M. Goodman, C. R. Somerville, G. P. Copenhaver, D. Preuss, W. C. Nierman, O. White, J. A. Eisen, S. Salzberg, C. M. Fraser, and J. C. Venter, "Sequence and analysis of Chromosome 2 of *Arabidopsis thaliana*," *Nature* 402: 761–768, 1999.
Liu, Y. G., Shirano, Y., Fukaki, H., Yanai, Y., Taska, M., Tabata, S., Shibata, D. *Proc. Natl Acad Sci USA* 96: 6535–40, 1999.
Lohe and Hilliker, *Curr. Op. Gen. & Dev.*, 5:746, 1995.
Loomis et al., *J. Expt. Zoology*, 252:9–15, 1989.
Lorz et al., *Mol. Gen. Genet.*, 199:178, 1985.
Louis, E. J., "Corrected sequence for the right telomere of *Saccharomyces cerevisiae* chromosome III," *Yeast*, 10(2):271–4, 1994.
Lu et al., "High efficiency retroviral mediated gene transduction into single isolated immature and replatable CD34(3') hematopoietic stem/progenitor cells from human umbilical cord blood," *J. Exp. Med.* 178(6):2089–2096, 1993.
Maeser and Kahmann, "The GIN recombinase of phage Mu can catalyse site-specific recombination in plant protoplasts," *Mol. Gen. Genet.*, 230:170–176, 1991.
Mahtani, M. M. and Willard, H. F. *Genome Res.* 8:100, 1998.
Maloy, S. R., "Experimental Techniques in Bacterial Genetics" Jones and Bartlett Prokop, A., and Bajpai, R. K. "Recombinant DNA Technology I" *Ann. N. Y. Acad. Sci.*, vol. 646, 1991.
Maluszynaska et al., "Molecular cytogenetics of the genus Arabidopsis: In situ localization of rDNA sites, chromosome numbers and diversity in centromeric heterochromatin," *Annals Botany*, 71:479–484, 1993.
Maluszynska et al., "Localization of tandemly repeated DNA sequences in *Arabidopsis thaliana*," *Plant Jour.*, 1(2):159–166, 1991.
Maniatis et al., "Molecular Cloning: a Laboratory Manual," Cold Spring Harbor Laboratory, Cold Spring Harbor, N.Y., 1982.
Marcotte et al., *Nature*, 335:454, 1988.
Mariani et al., *Nature*, 347:737–741, 1990.
Marra et al., *Nature Genet.* 22:265, 1999.
Martinez-Zapater et al., *Mol. Gen. Genet.* 204:417–423, 1986.
Matsuura et al., *Journal of Bacteriology*, 178:3374–6, 1996.
McCabe et al., *Biotechnology*, 6:923, 1988.
Michel and Westhof, "Modeling of the three-dimensional architecture of group I catalytic introns based on comparative sequence analysis," *J. Mol. Biol.*, 216:585–610, 1990.
Mortimer et al., "Genetic mapping in *Saccharomyces cerevisiae*," Life Cycle and Inheritance, In: The Molecular Biology of the Yeast Saccharomyces, 11–26, 1981.
Mozo et al., *Mol Gen Genet*, 258:562–70, 1998.
Mozo et al., *Nature Genet*. 22:271, 1999.
Mundy and Chua, *The EMBO J.*, 7:2279–2286, 1988.
Murakami et al., *Mol. Gen. Genet.*, 205:42–50, 1986.
Murata et al., *Plant J.*, 12:31, 1997.
Murdock et al., *Petrochemistry*, 29:85–89, 1990.
Murray et al., *Nature*, 305:189–193, 1983.
Mysore et al., "An arabidopsis histone H2A mutant is deficient in agrobacterium T-DNA integration," *Proc Natl Acad Sci USA* 18;97(2):948–53, 2000a.
Mysore et al., "Arabidopsis ecotypes and mutants that are recalcitrant to Agrobacterium root transformation are susceptible to germ-line transformation. *Plant J* 21(1):9–16, 2000b.
Napoli, Lemieux, Jorgnesen, "Introduction of a chimeric chalcone synthase gene into petunia results in reversible co-suppression of homologous genes in trans." *Plant Cell*, 2:279–289, 1990.
Negrutiu, I., Hinnisdaels, S., Cammaerts, D., Cherdshewasart, W., Gharti-Chhetri, G., and Jacobs, M. "Plant protoplasts as genetic tool: selectable markers for developmental studies," *Int. J. Dev. Biol.* 36: 73–84, 1992.
Nester, *Ann. Rev. Plant Phys.*, 35:387–413, 1984.
Nicklas, "The forces that move chromosomes in mitosis," *Annu. Rev. Biophys. Biophys. Chem.* 17:431–39, 1988.
Nussbaum et al., *Proc. Nat'l Acad. Sci USA*, 73:1068, 1976.
Odell et al., *Nature*, 313–810–812, 1985.
Ohmori and Tomizawa, "Nucleotide sequence of the region required for maintenance of colicin E1 plasmid," *Mol Gen Genet.*, Oct 3;176(2):161–70, 1979.
Omirulleh et al., *Plant Molecular Biology*, 21:415–428, 1993.
Ow et al., *Science*, 234:856–859, 1986.
Palukaitis et al., "Characterization of a viroid associated with avacado sunblotch disease," *Virology*, 99:145–151, 1979.
Pelissier et al., *Genetica*, 97:141, 1996.
Pelissier et al., *Plant Mol. Biol.*, 26:441, 1995.
Perkins, "The detection of linkage in tetrad analysis," *Genetics*, 38, 187–197, 1953.
Perlak et al., *Proc. Natl. Acad. Sci. USA*, 88:3324–3328, 1991.
Perriman et al., "Extended target-site specificity for a hammerhead ribozyme." *Gene*, 113:157–163, 1992.
Peterson et al., "Production of transgenic mice with yeast artificial chromosomes," Trends Genet. 13: 61–66, 1997.
Phi-Van et al., *Mol. Cell. Biol.* 10:2302–2307, 1990.
Piatkowski et al., *Plant Physiol*, 94:1682–1688, 1990.
Potrykus et al., *Mol. Gen. Genet.*, 199:183–188, 1985.
Prasher et al., *Biochem. Biophys. Res. Commun.*, 126(3):1259–1268, 1985.
Preuss et al., "Tetrad analysis possible in Arabidopsis with mutation of the QUARTET (QRT) genes," *Science*, 264:1458, 1994.
Price et al., "Systematic relationships of Arabidopsis: a molecular and morphological perspective", in: Somerville, C. and Meyerowitz, E. (eds.) Arabidopsis, Cold Spring Harbor Press, N. Y., 1995.
Prody et al., "Autolytic processing of dimeric plant virus satellite RNA." *Science*, 231:1577–1580, 1986.
Prokop et al., *Ann. N.Y. Acad. Sci.* 646, 1991.
Puechberty, J. *Genomics* 56:247, 1999.
Rathore et al., *Plant Mol. Biol.*, 21:871–84, 1993.
Rattner, "The structure of the mammalian centromere," *Bioassays*, 13(2):51 . 56, 1991.
Ravatn et al., *Journal of Bacteriology*, 180:5505–14, 1998.
Reed et al., *J. Gen. Microbiology*, 130:1–4, 1984.

Reichel et al., *Proc. Nat'l Acad. Sci. USA,* 93 (12) p. 5888–5893, 1996.
Reinhold-Hurek and Shub, "Self-splicing introns in tRNA genes of widely divergent bacteria," *Nature,* 357:173–176, 1992.
Rensburg et al., J. Plant Physiol., 141:188–194, 1993.
Richards and Ausubel, "Isolation of a higher eukaryotic telomere from *Arabidopsis thaliana,*" *Cell,* 8:53(1):127–36, 1988.
Richards et al., "The centromere region of *Arabidopsis thaliana* chromosome 1 contains telomere-similar sequences," *Nucleic Acids Research,* 19(12):3351–3357, 1991.
Rieder, "The formation, structure and composition of the mammalian kinetochore and kinetochore fiber." *Int. Rev. Cytol,* 79:1–58, 1982.
Rogers et al., *Meth. in Enzymol.,* 153:253–277, 1987.
Rosenberg et al., "RFLP subtraction: A method for making libraries of polymorphic markers," *Proc. Natl. Acad. Sci. USA,* 91:6113–6117, 1994.
Round et al., *Genome Res,* 7, 1053, 1997.
Sauer, "Functional expression of the cre-lox site-specific recombination system in the yeast *Saccharomyces cerevisiae,*" *Mol. and Cell. Biol.,* 7: 2087–2096, 1987.
Schmidt et al., *Plant Journal,* 5:735–44, 1994.
Schwartz et al., Cold Spring Harbor Symp. *Quant. Biol.,* 47, 195–198, 1982.
Sears et al., "Cytogenetic studies in *Arabidopsis thaliana,*" *Can. J. Genet. Cytol.,* 12:217–233, 1970.
Segal, "Biochemical Calculations" 2nd Edition, John Wiley & Sons, New York, 1976.
Setlow et al., *Genetic Engineering: Principles and Methods,* 1979.
Shagan and Bar-Zvi, *Plant Physiol.,* 101:1397–1398, 1993.
Shapiro, In: *Mobile Genetic Elements,* 1983.
Sheen et al., *Plant Journal,* 8(5):777–784, 1995.
Shingo et al., *Mol. Cell. Biol.,* 6:1787, 1986.
Simoens et al., *Nuc. Acids. Res.* 16:6753, 1988.
Smith, Watson, Bird, Ray, Schuch, Grierson, "Expression of a truncated tomato polygalacturonase gene inhibits expression of the endogenous gene in transgenic plants," *Mol. Gen. Genet.,* 224:447–481, 1990.
Smithies et al., *Nature,* 317:230–234, 1985.
Smythe, "Pollen clusters," *Current Biology,* 4:851–853, 1994.
Somerville, C. and Somerville, S., *Science* 285:380, 1999.
Spielmann et al., *Mol. Gen. Genet.,* 205:34, 1986.
Stalker et al., *Science,* 242:419–422, 1988.
Stiefel et al., *Nature,* 341:343, 1989.
Stinchcomb et al., *Nature,* 282:39–43, 1979.
Stougaard, *The Plant Journal,* 3:755–761, 1993.
Sullivan, Christensen, Quail, *Mol. Gen. Genet.,* 215(3):431–440, 1989.
Sun et al., *Cell,* 91:1007, 1997.
Sutcliffe, *Proc. Nat'l Acad. Sci. USA,* 75:3737–3741, 1978.
Symington et al., *Cell,* 52:237–240, 1988.
Symons, "Avacado sunblotch viroid: primary sequence and proposed secondary structure." *Nucl. Acids Res.,* 9:6527–6537, 1981.
Symons, "Small catalytic RNAs." Annu. Rev. Biochem., 61:641–671, 1992.
Tarczynski et al., "Expression of a bacterial mtlD gene in transgenic tobacco leads to production and accumulation of mannitol," *Proc. Natl. Acad. Sci. USA,* 89:1–5, 1992.
Tarczynski et al., "Stress Protection of Transgenic Tobacco by Production of the Osmolyte Mannitol," *Science,* 259:508–510, 1993.
Thillet et al., *J. Biol. Chem.,* 263:12500–12508, 1988.
Thomas et al., *Cell,* 44:419–428, 1986.
Thomas et al., *Proc. Natl. Acad. Sci. USA,* 71:4579, 1974.
Thompson et al., "Decreased expression of BRCA1 accelerates growth and is often present during sporadic breast cancer progression," *Nature Genet.,* 9:444–450, 1995.
Thompson et al., *Nuc. Acids. Res.,* 24:3017, 1996.
Tian, Sequin, Charest, *Plant Cell Rep.,* 16:267–271, 1997.
Tominaga, *Microbiology,* 143;2057–63, 1997.
Toriyama et al., *Theor Appl. Genet.,* 73:16, 1986.
Tsay et al., *Science,* 269:342, 1993.
Tugal et al., *Plant Physiol.,* 120:307, 1999.
Twell et al., *Genes Dev* 5:496–507, 1991.
Twell et al., *Plant Physiol* 91:1270–1274, 1989.
Tyler-Smith et al., "Mammalian chromosome structure," *Current Biology,* 3:390–397, 1993.
Uchimiya et al., *Mol. Gen. Genet.,* 204:204, 1986.
Van der Krol, Mur, Beld, Mol., Stuitje, "Flavonoid genes in petunia: addition of a limiting number of copies may lead to a suppression of gene expression," *Plant Cell.,* 2:291–99, 1990.
Van't Hof, Kuniyuki, Bjerkens, "The size and number of replicon families of chromosomal DNA of *Arabidopsis thaliana,*" *Chromosoma,* 68: 269–285, 1978.
Vasil et al., "Herbicide-resistant fertile transgenic wheat plants obtained by microprojectile bombardment of regenerable embryogenic callus," *Biotechnology,* 10:667–674, 1992.
Vasil, *Biotechnology,* 6:397, 1988.
Vernon and Bohnert, *The EMBO J.,* 11:2077–2085, 1992.
Voytas and Ausubel, *Nature,* 336:242, 1988.
Wagner et al., "Coupling of adenovirus to transferrin-polylysine/DNA complexes greatly enhances receptor-mediated gene delivery and expression of transfected genes," *Proc. Nat'l Acad Sci. USA* 89 (13):6099–6103, 1992.
Walker et al., *Proc. Nat'l Acad. Sci. USA,* 84:6624–6628, 1987.
Wang et al., *Molecular and Cellular Biology,* 12(8):3399–3406, 1992.
Watrud et al., In: *Engineered Organisms and the Environment,* 1985.
Watson et al., *Recombinant DNA: A Short Course,,* 1983.
Weinsink et al., *Cell,* 3:315–325, 1974.
Wevrick et al., "Partial deletion of alpha satellite DNA association with reduced amounts of the centromere protein CENP-B in a mitotically stable human chromosome rearrangement," *Mol Cell Biol.,* 10:6374–6380, 1990.
Whitehouse, *Nature,* No. 4205: 893, 1950.
Wigler et al., *Cell,* 11:223, 1977.
Willard, H., *Nature Genetics* 15:345–354, 1997.
Willard, H., "Centromeres of mammalian chromosomes" *Trends Genet.,* 6:410–416, 1990.
Wolter et al., *The EMBO J.,* 4685–4692, 1992.
Wong et al., "Electric Field mediated gene transfer," *Biochim. Biophys, Res. Commun.* 107(2):584–587, 1982.
Wright et al., *Genetics,* 142:569, 1996.
Xiang and Guerra, *Plant Physiol.,* 102:287–293, 1993.
Xu et al., *Plant Physiol.,* 110:249–257, 1996.
Yamada et al., *Plant Cell Rep.,* 4:85, 1986.
Yamaguchi-Shinozaki et al., *Plant Cell Physiol.,* 33:217–224, 1992.
Yang and Russell, *Proc. Nat'l Acad. Sci. USA,* 87:4144–4148, 1990.
Yen, Embo. J. 10(5), 1245–1254, 1991.
Young et al., In: *Eukaryotic Genetic Systems ICN-UCLA Symposia on Molecular and Cellular Biology, VII,* 315–331, 1977.
Yuan and Altman, "Selection of guide sequences that direct efficient cleavage of mRNA by human ribonuclease P," *Science,* 263:1269–1273, 1994.
Yuan et al., "Targeted cleavage of mRNA by human RNase P," *Proc. Natl. Acad. Sci. USA,* 89:8006–8010, 1992.
Zatloukal et al., "Transferrinfection: a highly efficient way to express gene constructs in eukaryotic cells," *Ann. N.Y. Acad. Sci.,* 660:136–153, 1992.
Zhang et al., *Gene,* 202:139–46, 1997.
Zukowsky et al., *Proc. Nat'l Acad. Sci. USA,* 80:1101–1105, 1983.

SEQUENCE LISTING (212 sequences)

SEQ ID NO: 1 - DNA, 1038 bp, Arabidopsis thaliana
tgactatgtgatatggttcaaattacctataactactctctcaaataagagatcaattgcagttttttaggatcgaattcacggagttcttttgttcaaacagtgagttaaatgtcgagattaagctagcaggatatgattgaaaataaaagagaacaaagtaagaaaacagcagattgattttgttgtaaacgatttaataaagagctaggaacagggtattctcacgaaactattggttagtagatctaatgaaagctaggttgtgatcaaactattcttaaactcaaactctaattatggaacaacaggtaggcgtgccgcgaaactccctatatctatagctaataataaccggagaagccgagaaactatcaacctaaatatgcattcttaacgagttcaattgttcatcttactagataggccgattcttattacacacctataaaccagactcatcaaataatagatccaattacagatacctatgatgggcatatctagtgtctggattcaagatctagttaattactctagatctagcattaagcatagatgaagaactctacagataacctagcagagggggcaatctactaaaccatatgaatccctaatgaaaaaccctattcctaacaagcagattactcagacatattggatggagcaaacaacataattgaccttagcttttgctccaaaatgtctccttatctccattgttgtcccattgcataaaatacctgaaaagacaccaaaaagactcgagagataacataacgactcaaaatcctatacctaaaacatggatacaatcagtaaaaatcgggttatatcaactccccgagacttagcttttgcttcccctcaaacaaaacacaaaagcaaaacccgtggaagaggttttgaaaacaaaggaactcccaacattctctagcctattgccatgatcatccaaactaagtccatatgcctaacaagtctaatcaaatcctaaccaacatgtacttctctgattgatttttccagttcttt

SEQ ID NO: 2 - DNA, 601 bp, Arabidopsis thaliana
tgatatggttcaaattacctataactactctctcaaataagagatcaattgcagttttttaggatcgaattcacggagttcttttgttcaaacagtgagttaaatgtcgagattaagctagcaggatatgattgaaaataaaagagaacaaagtaagaaaacagcagattgattttgttgtaaacgatttaataaagagctaggaacagggtattctcacgaaactattggttagtagatctaatgaaagctaggttgtgatcaaactattcttaaactcaaactctaattatggaacaacaggtaggcgtgccgcgaaactccctatatctatagctaataataaccggagaagccgagaaactatcaacctaaatatgcattcttaacgagttcaattgttcatcttactagataggccgattcttattacacacctataaaccagactcatcaaataatagatccaattacagatacctatgatgggcatatctagtgtctggattcaagatctagttaattactctagatctagcattaagcatagatgaagaactctacagataacctagcagagggggcaatctactaaaccata

SEQ ID NO: 3 - DNA, 885 bp, Arabidopsis thaliana
tttttttgtccacacaatgagttgaatgtcaagattaagctagtagagattgattgtaataagaagtaaacaaagtaaaaagacaacggattgattggttgtaaacgataaaataaagaggtaggaacaaggtattctcaggagactattggttagtagatctaatgaaagctaggttgttatcgaaccattattaaacacaaattttaattatggaataaccggtggtgttctgcaaaacttttgtgcctatagctaagaataaccgcagaagccgagagatctttaacctaaacatgcattctaaacgagttcaattgttcaccttagtatataggccgattcttattacacacctataaaccagactcatcaaataatagatccaactacatatacctatggtgggtatatctagtgtctggattcaagatctagttaattactctagatctagcattaagattaattctacacataatttagcaagggggtgatctactaaaccatatgaatccctaatgaaaaactcaattcctaacaagaaactactcagacagattgattgaaacaaacaacataaatgaataagaaagcataaacacaacaaataaaattagggaatgaaaggatctcttcactgtaatgagaactgaatgaatctctgaagaacaacggatgattagcttatgtctctctgaaaatagggattaaaaacttgataaaaggaacttaggtctaaacaatgacctttaaaactatatataaaccctataaaacgtccagggactaataatgcaaatagggaagtcttttggggcaaatttccacttttgtaaacttgaaagcgtattggacttttctgggccgaaactggtgtcgatc

SEQ ID NO: 4 - DNA, 1072 bp, Arabidopsis thaliana
tatcttgatatggttcaaattaccctaagaactactctctcaaataagagatccattgcggtatttaaggatcgaattccacaaagttcttttcttcaaacaataagttcaatgtcaagattaagctagaagggtatgatcgaaataataagaaaacaaaggaagaaaacagtagattgtttcgttgtaaacgattaaataaaaagctaggaacagggtattctcatgaaactattggttagtagatctaatgaaagctaggttgttatcgaaccattcttaaactcaaactctaattatggaataactggtggtgttccgcaaaactccctataattatagctaagaataaccggagaattcgagagattattaacctaaatatgcattcttaacgagttcgattgttcaccttagtagataggccaatttttattacacacctataaaccaggctcatcaaataatagatccaactacagatacctatggtggacatatctattgtctggattcaagatctagttaattactctagatctagcattaagcataatcaaagatgaagaattctacagataacctagcaaaggggaaaaattactaaaccatatgaatccctagtgagaaaccctattcctaacaagcagattactcagacatattgattgaagcgaacaacataattgtgtatgaaaggtccaaaatcgtccttagcttccttttccttacctcttgctcgaaatgtctcctcatctccattgttgtcccgttgcatagaatacctgaaaagacactacaaagactcgagaaataacataaagactcaaaatccattaccaaacacatagataaaatcggtgaaaataggatatatcaactccccaagacttagcttttgcttgccctcaagcaaaacacaaaagtcgaacccgtggaagagattttgaaaacaaaggaactcccaacattctctagactattgccatgatcatccaaactaaatccacatgcctagcaagtctaatcaaatcctaaccaacatgtacttctctacccaagctttgtaatt

SEQ ID NO: 5 - DNA, 591 bp, Arabidopsis thaliana
tgatatggttcaaattaccctaagaactactctctcaaataagagatccattgcggtatttaaggatcgaattccacaaagttcttttcttcaaacaataagttcaatgtcaagattaagctagaagggtatgatcgaaataataagaaaacaaaggaagaaaacagtagattgtttcgttgtaaacgattaaataaaaagctaggaacagggtattctcatgaaactattggttagtagatctaatgaaagctaggttgttatcgaaccattcttaaactcaaactctaattatggaataactggtggtgttccgcaaaactccctataattatagctaagaataaccggagaattcgagagattattaacctaaatatgcattcttaacgagttcgattgttcaccttagtagataggccaatttttattacacacctataaaccaggctcatcaaataatagatccaactacagatacctatggtggacatatctattgtctggattcaagatctagttaattactctagatctagcattaagcataatcaaagatgaagaattctacagataacctagcaaagggga

SEQ ID NO: 6 - DNA, 650 bp, Arabidopsis thaliana
taagaactattatctcaaatatttaaggatcgaatttcacaaagtttttttgttcacacaatgaattaaatatcgagattaagctagtagggaatgattgaaaataaaggagaacaaagtaaaaagacagcagattaattggttgtaaacgattaaataaagagttaggaacatggtattctcaggaaactattggttagtagatctaatgaaagctaggttgttatcgaaccattcttaaactcaaactctaattatgcaataaccggtggtgttccgccaaactccctatgcttatagctaagaataaccggagaagccgagagatctttaacctaaacatgcattctaaacgagttcaattgttcaccttactagatagaccgattcttattacacacctataaaccaggttaatcaaataataaatccaattacagatacctatggtgggcatatctattgtctggcttcaagatctagttaatttctgtagatctaccattaagtataatcaaagatgaagaattctacagataacctagaaaaggaggcaatatactaaaccatatgaatccccaatgagaaaccctattcctaacaagcaaactactcagacatattgaatgaaacaaacaacataattgagt

SEQ ID NO: 7 - DNA, 856 bp, Arabidopsis thaliana
taaatatgcatttttaatgagttcgtttgttcaccttagtagataggccgattcttattacacacctaaaaaccagactcatcaaataatagatccaactacatatacttatggtgggcatatctattgtctggattcaagatctagttagttactctagatctagcattaagcataattaaagatgaagaattctacagataacctagcaaagggggcaatctactaaactatatgaatccctaatgagaaaccctattcctaacaagcagattactcagacatattgattgaaggaaacaacataattgagtatgaaaacataaacacggcaaatagatttaagggaaagaagggatctcttcactgtattaggaactgaatcaatctctgaaaacactcgatgaatagcttatgtctctcagtaacagggtttgcaaaaagcttgataaaaaacttgataatgaaaacttaggtctaaacaatgtatatacaccctctaaaaacgtctagggactaataatgtaaatagaaaagttttctagggcaaatttcctcttctgtaaacttgaaagcgtctaggactttgctgggccgaaactggtgtcgatcgacactaggagtgtgtcgatcgacactcctcttgattcgtgaaaccaaagtcgtccttaccttactttttcttagcttttgctccaaaatgtctccttatctccattgttgtcccactgcatagaatacctgaaaagacactaaaaagactcgagaaataacataaagactcaagatcctatacctaaaacatagataaaatcagttaaaataaggatatatcaatcaccacaatctacatatt

SEQ ID NO: 8 - DNA, 736 bp, Arabidopsis thaliana
aactatgattttagagtaaccgatggcgttccgcgaaactccctatgcttatagctaagaataaccggagaagccgagagatctttaacttaaacatgcattattatcaaatttgattagttcacctagtatctaaaccagagcccttatatgagcctacctgttctttcttaaatgcctaggctcatctatgatagatcaaatagcaaatacctatggtgggcatacctattatctaatatcaagttctagttagctactctagaactaccaataagaacaattaagatgaagaatcatatagataacctagcaaggggcaatctactaaatcatctaaatctctaatgagaaaccctaaacctaacaagtggattactaagacatgatcaaagaaacacaaatcatattctgaataagaaataaatgatgaaaataacaagagaaaagagtaagaaagatccaaaagggagttttcacaggtttttgctctccaaagtacaaaagagatccagggaatagcctcccaaagcttacgggtctaaaacaatgacctaaaaactatatatatgtcttaaaaacatgatgggccttaattaaacataggagaaagttctgggccgaatttggaaatcttcaaaacatcaataagttgcgtctcgaaattgcagtcaggtattagtgttgctcgacactaggggtggtgtcgttcgacacccacgtgcattttcgtctc

SEQ ID NO: 9 - DNA, 679 bp, Arabidopsis thaliana
tatcgcaccgttctcgaactcaaactatgattttagagtaacctgtggtgttccgcgaaactctctatacttagagctaagataaccgaagaagccgagaaatcttatactaaaccatgcatttttatcaagaatgattagttcacctagtatctaaactagagcccttctatgagcctatctgttctttcttaaatgcctaggcccatctatgatggatcaaatagcaagtacctatggtggacatacctattatctaatatcaagttctagttagctactctataactagcattaagaacaatcaagataaagaactctacagataacctagcaagggggcaatctactaaatcatctaaatccctaatgagaaaccctaaacctaacaagtgaattactcagacatgatcaaagaaacacaaatcatagtctgaataaggaatcaataatagcaagaaaaagagtaaagaagatcttctccaaagggagtctccacagggttttgctcccgaagtacaaaaaaatagagaatatcctttccaagcttagatctaaacaatgaccctaaaaacctaattatatgtctaaaacacgtgatgggccttcattaaacataggagaaagttctgggccgaatttggaaatcttcaaaacatcaataagttgtgtctcgaaa

SEQ ID NO: 10 - DNA, 1198 bp, Arabidopsis thaliana
aagacatatcaatgtgctatgtgatataggtcaaattaatcataagaccactctctcaaataaagaggtcaattgcagcgcttagggatcgaataacaaagttctcggatcacgcaatagactaacggcaaatcgaattatgctaagtaaaatagtaaataaaataaagagaaacaaaagtatgcaatagcaatcgattggatggttgtgaaacaagataagaaaagcgtcaggcttaggctattctcaggaaatagatgatagtagatctagaaatagctaggttattatcgcaccgttctcgaactcaaactatgattttagagtaacctgtggtgttccgcgaaactctctatacttagagctaagataaccgaagaagccgagaaatcttatactaaaccatgcatttttatcaagaatgattagttcacctagtatctaaactagagcccttctatgagcctatctgttctttcttaaatgcctaggcccatctatgatggatcaaatagcaagtacctatggtggacatacctattatctaatatcaagttctagttagctactctataactagcattaagaacaatcaagataaagaactctacagataacctagcaagggggcaatctactaaatcatctaaatccctaatgagaaaccctaaacctaacaagtgaattactcagacatgatcaaagaaacacaaatcatagtctgaataaggaatcaataatagcaagaaaaagagtaaagaagatcttctccaaagggagtctccacagggttttgctcccgaagtacaaaaaaatagagaatatcctttccaagcttagatctaaacaatgaccctaaaaacctaattatatgtctaaaacacgtgatgggccttcattaaacataggagaaagttctgggccgaatttggaaatcttcaaaacatcaataagttgtgtctcgaaattgccgtcaagtaatggtttcgctcgacacctaagttcattttcgtctccggattgtttctgcagcttaaattctctgttttcctccagaatgttccattatctccaaatgaatccaaacatgtaaagacctgaaaaggactagaaaagactctagaaataacaattagactctaaaacctatatctaaaacatacttaaattaggaaaaatagggatatatcacttatat

SEQ ID NO: 11 - DNA, 696 bp, Arabidopsis thaliana
tccaactatgattttagagtaaccgatggcgttccgcgaaactccctatgcttatagctaagaataaccggagaagccgagagatctttaacttaaacatgcattattatcaaatttgattagttcacctagtatctaaaccagagcccttatatgagcctacctgttctttcttaaatgcctaggctcatctatgatagatcaaatagcaaatacctatggtgggcatacctattatctaatatcaagttctagttagctactctagaactaccaataagaacaattaagatgaagaatcatatagataacctagcaaggggcaatctactaaatcatctaaatctctaatgagaaaccctaaacctaacaagtggattactaagacatgatcaaagaaacacaaatcatattctgaataagaaataaatgatgaaaataacaagagaaaagagtaagaaagatccaaaagggagttttcacaggtttttgctctccaaagtacaaaagagatccagggaatagcctcccaaagcttacgggtctaaaacaatgacctaaaaactatatatatgtcttaaaaacatgatgggccttaattaaacataggagaaagttctgggccgaatttggaaatcttcaaaacatcaataagttgcgtctcgaaattgcagtcaggtattagtgttgctcgac

SEQ ID NO: 12 - DNA, 670 bp, Arabidopsis thaliana
agttgatatagctcaaattgccttaagcttactccctcaattaagagatcgtcgttagcacttaagggtcgaattccattgagctctcgatgttcacacaatagacttatgatattgtttaataagctaaatgaagtaattgaatattaaaggcaaataagcaagtaaatgagttgtagattcaagtgattaaagcgtcaggtctaaggaattatctcgggagatagataaattgtagatctagataatatcaggattgttatcgcaccgttctcatactcaaactataattctagagtaatcagtggcgttccgcaaaactctctatacttacaactaagataaccggagaagccgagaaatcctatgctaaagcatgcattgttaataagcttgaatagttcacctagtatctaaaccagagcccttctatgaacctacctgttttttcttaaatgcctaggctcatctatgatggttcaaataacaaatacctatggcgggaatacctattatctaatatcaagttctaggtgatcaatctaaaactagcattaagaataatcaagatgaagaactataagaataatcctaaggggttttcgatctactaatccatctaaatccctattgagactccgtagacccaacaaggtgattactcaaacat

SEQ ID NO: 13 - DNA, 687 bp, Arabidopsis thaliana
tcgatccccggcaacggcgccaaatttgatatagctcaaatcgccttaagcttactccctcaaataagagttgtcgttagcacttaagtgtcgaattccactgagctctcgatgttcacacaatagaattatgatgttattaaataatctagacaaagtaattgaatgtaaaagacaaataaccaagtaaacgaagtgtagattcaagtgattaaagcgtcgggtctaaggaattgtctcgggagatagataaattgtagatctagctaatataaggattgttatggcaccgttctcaaactcaaactaagattctagagtaaccggtgatgttccacaaaactctctttacttagagctaagataaccggagaaaccgagaaatcttatactaaagcatgcattgttatcaagcttgattagttcacctagtatctaaaccagagcccttctatgagcctacatgttctttcttaaatgcctaaactcatctatgatagttcaaacaacaagtacctatggtgggcatacctattatctaatatcacgttctaggtgatcaatctaaaactagcaataagaataatcaagatgaagaactataagaataatcttaaggggttttcgatctactaatccatctaaatccctattgagactccctaaacccaacaaggtgattactca

SEQ ID NO: 14 - DNA, 802 bp, Arabidopsis thaliana
tctcaatctgaaggtacctgaaaaacaagagaccaatagacaaagaaatacgtgaataggtggtagaaaagttgaatttagacttaaaaggacacctagtctaatggtgaactaaaagagaacttcgccaacggggccaaatttgatatagctcaaattgccttaagcttactccgtcaattaagagatcatcgttagcacttaaggatcgaattccattgagctctcgatgttcacacaatagacttatgatgttgtttaataagctaaatgaagtaattgaatattaaaggcaaataagcaagtaaatgagttgtacattcaagtgattaaagagtcaggtctaaggaattgtctcgcgagatagataaattgtagatctagataatatcaggattgttatcgcaccgttctcaaactcaaactataattctagagtaacagtggcgttccgcgaaactctctatgcttacaactaagataaccggagaagccgagaaatccgatgctaaagcatgcattgttaataagcttgattagttcacctagtatctaaaccagagcccttctatgagcctacctgttctttcttaaatgtctaggctcatctatgatggttcaaataacaaatacctatggcgggaatacctattatctaatataaagttctaggtgatcaatctaaaactagctataagaataatcaagatgaagaactctaagaataatcctaaggggttttcgatctactaatccatctaaatccctattgagactccctagacccaacaaggtgattact

SEQ ID NO: 15 - DNA, 821 bp, Arabidopsis thaliana
acaaagtcttaatagtacctgttttaaatataatagagaagattttataaaaacgatggaaacaagtctggtattgatgttttccgttctcatcaacaacttcacctatttcagctcgttgcattcgttcaaggaattgagtcctgaaacagtagcaaaaaaagaaggaaataaatagccaagaataaaattatttataatacactaaacagttaagagataatgaaaatataaacgttcttacgtgatgcgatccatgttaatctctgggtaactttaattgaatgtaattcttgaagcaccattatgtgtgattagacattgacgacctaaaatatttatgtttttattatatgcattagctataaaaaaaacatatgatgagaagagagttaaatttaccttcatgatcagcaacgttccaaaatcgaagcacgcatgttataggattcataccgaaggtccactgataaccaaggtgtagaccaagttccctccacaaacgcacaaacaaatcacaagtatatccacttgcaacacatgtaagagtttttcccctaataagaatatcttaattatttctctctaacatctaagttctataaattaagccacctataaagataacaatgcttactatgtttctacattaaaatatataaccaaaaatatgtcgaactatatagtcggaaatactaaccaagtatttttaagctcaaactcgagaaattgagaaagtcgaggttttcggaatattgaggaacataatctggtcttgttatattcccaactcgcacgacaacaccataagcatctacaaa

SEQ ID NO: 16 - DNA, 672 bp, Arabidopsis thaliana
cctcccaagtgagcttgtttaaagtcattagcttgactcctttaatcatcaagaagctcctggagatgaaccgatggcacctctggaaggatttggtctgctaagtatttcttgagcctttgaccatttactgtaaaatctccactcttaccagctagagtgactgctccataaggacggacctcagtgatgtagaaggggccagaccatctggatttaagttttcctggaaagagtttcaagcgagagttgaatagcagcacctgatcaccaaccttgaaatccttaatgatgatcttcttgtcatggaaaagcttggttctctccttgtagattttagaactctcataagcttctagacggatctcatcgaggttacttagttggatcaatcgcttctcctcagcagtttttatgtcaaagttcaaaagttttaccgccaacattgctttgtactcgagctcaacgggtagatgacatgattttccatagagaagattgaaaggagttgtacctatgggggtcttgaaggctgtcctgtaagcccataatgcatcatctagctttacagaccagtctttccttgtaatcccaacagtcttttctagaattgtttttatctccctattggagatctcaacctgcccgcttgtctgtggatctatgaccagt

SEQ ID NO: 17 - DNA, 2954 bp, Arabidopsis thaliana
taacatgaaaatattatctcatgtatcttataatacaaactttctgcaatcttcttaagaacatggctaaatagcaaacatcgctattaattggtgaatttaaaaaacaaagagtcactgattacataagaacattcggggttggatggcagctttcgcacttgtaagactcaagtagtacgttcttctggagaaaaggcattgaacgtttcgatagcgtactctttagctgcccctcgcatcctctcttcgtctagtttagcacaatagtccatagcgttaactgaatgtagctcaagtaagatcacacaagcaattccaacaaggcttgaaaatcacacgtgaaatatatatgtcacacagtcaaatatgaaatacttatcgaaacaagataatgaaagacaaccatacctaacgacgaacaattaaactgtaagttgggtctactcattgtcataagatcgagcctctatgttagcattcttccgtttacaccatgcttttgaataaggtacaagagcatgattttatgtgttctatgtacttcgccaactgctcgtctttcaacacttcactcttgcagtctaatacaatgattttctatttcatcaaatcgatgacaagcccaacccaatgctgcctctcaacctgcattgggcagtagatgacatcaacctcatcaaaccattttggtcgcaccatggatgggactcttgtaagcgtggtgaagtaaaaaactctcttacctgaagctgcacaaaatttgttgtattggcgtcgtagctctgacaagaaacttgatggtagaaaatcaaaatgcagcggcttctttttatcccgccgcatctgaatgaacctcactaaaagatctggtccttgtggaagtcactttttttattagcacacacctttaatacttagttttctactaaaaaagcagtgagcacacagttttatttgaaacaacacagattgcatgtataacttactacttcatctagaagtgtttgcgcctcgtaaatagttagaaattcagtattctccattacaacgccatcagcctgaaaataagatctacatggtaccatataccagcaagttagttgcgaaagcaaataagttcttctgaaaatataggggctataaatacttacactctccgttctatttgtttaagaaaacatttcactctctctgcacttggaacagcgaatcggtcatatggaccaatggtggtggatttggaggtatcttctccccttttcctggcctaacaacatgaactttagtcgaccctctaacaggtgtttgtcgctgctgtaccggaatggtaggccgactctctcttctgttgtacatgacaggactgtccctaatccggtcgctcgaccgcaacactatgacttttgtggggaatgtcttcttcttaccttttggaggtaacctgctgatgtcagcaacaatttcttgcgttaggccaacaaaacgtttggggcaataacatcacaatcatcttccaagttcttttctgcatcaatatcctgcatacatatacccatgtacatagtttagcatatatacatcatttacctatagtttaacatctttgtcatggcttaccgggttggttgcatgcaattcttctttgtttctaatctgtaatattcaattagagaaagtaagtgggtttcattcaaaaaatataagtgctagtggattaaatatacagacggatatagtaataccttactgcttgacacctgctccttctctttagctcttttaggtggccgggtagattgggcgtccatatcagaaatggatttttttctccgtcctttttgagaagcagcgtcacctcagacctagtagtacatcacatttctatgtcatatttactcattaaaacaaatgagtaacagtctttaccgtatgctaacctccttaagagatactcttgctgccatctgacacacttaatccatcagttatgccacaaacacccgctacactgtcacttcctccaggtagccaaatatcaagttcatccggctgggaaccaacatgcgtatgccttggctggtcagagcttctatgttcctatttcatgaattgcaattgtaacataagtatattatgtcacttaaaatggaatggaacataaatgttcagttttctaagacatatacaacaaatcaaggtaacttaacctttgtagagcatgactctgctacacatttgttgcattcccctttttgagcatgttgtatattttgcccacttaccagttccctaacagattcagcaatcattgccaccaattctttcttatgcttatctagttgagcatcaaagtatgccttcaagtcaactgtgttcgcctgttgaatcttgagaaaacgtttttcaaattcatcagctgcctctttgatcaatgcactactactatgttgcctttccccagcaatcgggacatcatgctgcaaatcttctctagcctaaaaactgtcatcatttttttgtggttgtccatcatcaacaggaacatcaacacccatgccgtcttcacatacaccggttgcaccctcttgtctctcttctgcagcaccaccatggacatcagcctccatctcatcttcaccatcaatcttagacgaattcacaccatcatctgcaagaactcatcatcagatggttgtacaatatcacaagcgtccatgccaccactccaactgttatgctcgtatgggtgctcctctattattaaagatagcaggtgtgatacttcttcatcctcctcctcatcagataaagataagtcgatatcttttgcaagtagtttttcattcagcagtgatgtgacccagtcctacaatataaagttgaattggatagttaaggcatgcacatacaattttaataccaaaatcaagtagctgacatacaatataaag

SEQ ID NO: 18 - DNA, 1129 bp, Arabidopsis thaliana
catgcgggaacccttgtatggctcttgtatcttggggaagttccttggttgttctttgttttgcgcttctaattgtagaaagaaacgaggttctgcccatggatatttaagaaatgcaacaacatctttaaccatctctacatgttcaggattaagattgttcccgcacatgtcaggcaaagaattccatcaactattagaagcaaggctaggcgaaaccgggttagcgggtctttgtatttcttccccatagaaagctttcctacaatccattttgaagttgactttctctctttaccaaatagtgacttgtagaagcttgtaggattctgaaccgctttcacattccctctagttcttgcatccttcttgttgaagtcagctttgctgaagttaagaccagttaccagctcaaaatcatcaatgcaaaagtgaattggtgtcccaacaaacaaccaccgcatctcatacttcttatttgtcaccaactgtctagatagaatgtaatgcaagaacattacagaaaatcgatgggttcccatttgcaagatacttcgaaatttggaaccatccaaattctgcaaaatgctcttcatctagtgcagcctttataatctcaatccacctaagtgtaaagtaattgtttatcctctttcgaccttcgggttcagaacaaagccgaaagaaacgctttgtcaactcatcatcccccatttaacagataccctgaaattcaaaggtaccattatcacttcttttcgcttacgagatacccaaaacagatgtatacaaatcatgtaatctaaactggcactaaatgttcaataactcaccatataggtggttaaaccacacatgcaatatgtagccatctttccattagtttcctagtcgcaactcaaattcgacgattatatagtccccgccacaaattgcacacccggaagttgcttactcgacttcaccgtcaccagccctgtcgccgttatgcgaaacccccaaatcgaaaaaccggatacccttgcatcgccactctaacggtgtcgatctatatcactcttcgaaactttcccaagttgctcgttttatgtatccacgctttattttgggtattgtaaattctctgcaa

SEQ ID NO: 19 - DNA, 713 bp, Arabidopsis thaliana
ctaggttatgaacccacgctacgcatgggtttatttgtataacttttaataattttttgtgtgattagattttttattgaaagttttgaaagatatgtttttatatgtctacttgttgttaatattataaactctttgaattttaaaattaccatgacaaatagttacaatttaaatacataactaaaaataactttaatacaacttttacgtttacaacatttatcaaatgaacatttttttggttcatgactctctctttatctttagatgtttaggataacgacgttttttacgtatgaaataaattgttgtatggaaaataattttgacgactttctcatcttggtacccgcaaatttactattgtttttcgtttatcttcgctccattagttagtatagctcttctaaaaataagatattatctagaagtacattcataacctcatctacactttcttttaacaactcatacttttctgactgtcttttcaatatggatatgaatttctgtcttcacaattttttacagagagttatcactcttcctatctttttgcaagcactcgttttatttgtttcattttttcttacagtgtctctttccatcctcttatgatttgtctaagcaatatgtgtcaaactttctaaaattttcacatgcttcatattttttcttcgaatatctcttccttttcttgttagtataag

SEQ ID NO: 20 - DNA, 1023 bp, Arabidopsis thaliana
ttatctttcaaaacaaaaaaaaacttccttttgaaagatatggagcctatccacaagctcactgatttgaatgtaaacttgaccgaatggaaggtttatgtgaagatcctatctatctggaatcatcctccaaagaatcatggtgaagttacaaccatgattttggttgattaaaaggtttggatccttttattttttggttcatttatcaaattttctttgttacgattgaaatagaggcttttttcttctttaaaagagagttttttcttttctttttacctgggtactcgaatagatgcaaccataccttaaaaaaactataaatatcctttctgacccattctcaagtcggacatctgctttcatctttctgattttcgagtcatttatccaacaaacagagttaattattctttgtttcatgtccaaatcaagtttatttggggaacaagtgtttagcctgttctagtaattaagaaaagtaatttctttgatttcatttttcccatagacattaagtatccttcgtcttaggaagttgagtatgtcactggtaagtgtatagagaatttaagttgttatcatttaaatctgcttatatttgttagtatgtgatgcatttaatttttatataatctattaacatcttctgttccacttagacgctatgggtgtggtgtcaaatatctctgctattaagaattttccatttgttggtcatcagggtgagactgactataagtacatgtatgtctctttcgacattgtggacactatgtaagttgttgtatttataggtgtataaagaattctgctgttttatgaatatgaaacttagaagaaataagtattgcagattgaatcatattgtttagggacagaaaatcaagtgctttcttgtggaaaaatgttgtgaactgtttgttataaagtggactaaacgtattgttcagtttcatatagcaataaaccaattcttgcaattgtccgcttctagagaaacacagaggttgagggtta

SEQ ID NO: 21 - DNA, 1955 bp, Arabidopsis thaliana
taacagaaataagtataactataactatacttttatgtaatcgttgcaaactttgataggagtttgtttggagtttctttatgtcatatttgtaaactttgttaggagtttaacaaaaagtaagatagagaaaaatccaacgggaatacaataattaaataggttcaaaacataagcaaagtttaacaaaaaaaacaatttgcaatgacaaagtttggagaaacttaaaagaagttcaaaacataatttaaagaagaataagagctgccaggtcaaactcctaaatattttcaatcacttccatcctttggttctctggaacttcataataatcttcgaaaccgcggctgtaaaagagaaaaataaaaatttttattgattaattgatgttatggttaactaatacaattaaaaaatgttaaaagtcttacatgtaacttcgaatatctatctcagggaaagtggttggattgatgtaaattcttgaacatccaaattcactcatcaaaacattctcacctgttacaaaatttttatttaaagttatataatacaaataaaaatcataagtaaataggattacaatagtattgaaaataactaaccctcaatctcagcaattctccaaaacctcacatgcctctgaactgatacatttcgagaattgtgtaacaaagatttcacagcatcttccaacagcatagcatttcattttctctcccctaaccaatatgataaaacattacactaagcaatacatttttaagctcaattttcagacggaagacacattactaaatatacttataaacactaaaacttacatattacccaaaagatcgaaagagacatatctcgattcatagtcggtttcaccctggcgacaaacaaatgagaatttcttaatagccgagatatttgacactacacccaacattgcatctaagtatagaataatatattaatagagtagttcaaaaaaataataacataaactactaacaaaaattcattctttaaatgagaagaacatagattgactaaaaacttacccgtgatataatcccaatcctcaagacatggatacttaaggtttatgggaaaaatgaaatcaaagaaatctcttcaccagttccggaagaggcaaaacacttgtttcccaaatgaacttgatgtggaaacaaaacgaagaatacctaaccctttcttgaggaacaacgacccgaaagtcagagatgtgaatccatgtgtcaggaattgcatctacacgattattctgaaaaaattcccagataactcaaagattaaataatttaaaatgatctgtttcaataataacaaagtaaacttggattaaaagaacgaaacaatcaaaaatacaaaccttgtcatcatgaagaatcatggttgtaatttcaccatgactgtttggaggatgattccagattgacaggatcttcacgttaatcttccaattagtcgagttatccctcaaatcagtgagtttgtgaacagacatcatgtttatccaaggaagtttttttttttgtttgaaagataagagttaaacctaattgttttaggcttgaggtttttgattttatataattacgaaaagatacaatgatggacagttgatgtgtaaaaaggaaacgaattgtccacaaccaataggatttcttataggttagaacaataatgttgatatttatttcttagcctgttactaaaaaattgtaattatttaaaggagaatgtatgaaaaaataggaataggtttgtttttcaagattctcatgattaatcatatttaataggattgattatttagtgtacaaaatctttcctaattctgattttgttggttttttttgtttaaaatgaccaaaagtgtttatagttctccgtctgattaacattgtaatataaaagaatatgtttcttaatcataaata

SEQ ID NO: 22 - DNA, 22 bp, Arabidopsis thaliana
cgccaaagactacgaaatgatc

SEQ ID NO: 23 - DNA, 23 bp, Arabidopsis thaliana
ataatagataaagagccccacac

SEQ ID NO: 24 - DNA, 20 bp, Arabidopsis thaliana
gggtctggttagccgtgaag

SEQ ID NO: 25 - DNA, 22 bp, Arabidopsis thaliana
gttttacttagtccaatggtag

SEQ ID NO: 26 - DNA, 25 bp, Arabidopsis thaliana
aaatggccaacgatcagaagaatag

SEQ ID NO: 27 - DNA, 25 bp, Arabidopsis thaliana
gaagtccggcatgttatcacccaag

SEQ ID NO: 28 - DNA, 20 bp, Arabidopsis thaliana
caagtcgcaaacggaaaatg

SEQ ID NO: 29 - DNA, 24 bp, Arabidopsis thaliana
aaactacgcctaaccactattctc

SEQ ID NO: 30 - DNA, 24 bp, Arabidopsis thaliana
gaagtacagcggctcaaaaagaag

SEQ ID NO: 31 - DNA, 24 bp, Arabidopsis thaliana
ttgctgccatgtaatacctaagtg

SEQ ID NO: 32 - DNA, 26 bp, Arabidopsis thaliana
gttgacttgtatttgatttctttttc

SEQ ID NO: 33 - DNA, 22 bp, Arabidopsis thaliana
cgagtgatttccttttgctacc

SEQ ID NO: 34 - DNA, 22 bp, Arabidopsis thaliana
aagataaagcagcgaatgtgtc

SEQ ID NO: 35 - DNA, 24 bp, Arabidopsis thaliana
cgaaagccgtaactagataataag

SEQ ID NO: 36 - DNA, 20 bp, Arabidopsis thaliana
taccagcatacaggagaacg

SEQ ID NO: 37 - DNA, 22 bp, Arabidopsis thaliana
cctgattgcagttttatttacc

SEQ ID NO: 38 - DNA, 21 bp, Arabidopsis thaliana
tccatacctaagttccacaac

SEQ ID NO: 39 - DNA, 19 bp, Arabidopsis thaliana
aggggcgagtaaatcaatc

SEQ ID NO: 40 - DNA, 21 bp, Arabidopsis thaliana
gaagtgcggatctgtttgaag

SEQ ID NO: 41 - DNA, 21 bp, Arabidopsis thaliana
ataaaaagccggagatggttg

SEQ ID NO: 42 - DNA, 23 bp, Arabidopsis thaliana
attcatgagtgcaaagggtagag

SEQ ID NO: 43 - DNA, 23 bp, Arabidopsis thaliana
ctcagccaaagaatcaagtagag

SEQ ID NO: 44 - DNA, 21 bp, Arabidopsis thaliana
aagcttcattctgtggttttg

SEQ ID NO: 45 - DNA, 19 bp, Arabidopsis thaliana
agaatccttagccgtcctg

SEQ ID NO: 46 - DNA, 20 bp, Arabidopsis thaliana
gccttggatgatcagtggtg

SEQ ID NO: 47 - DNA, 24 bp, Arabidopsis thaliana
agcccttggatcatattctttagc

SEQ ID NO: 48 - DNA, 20 bp, Arabidopsis thaliana
ggctactggtcaaatcattc

SEQ ID NO: 49 - DNA, 20 bp, Arabidopsis thaliana
gaatctttgcaaacgagtgg

SEQ ID NO: 50 - DNA, 21 bp, Arabidopsis thaliana
gcggctgatgatctccacctc

SEQ ID NO: 51 - DNA, 22 bp, Arabidopsis thaliana
ttaccccgcaggaaaaagtatg

SEQ ID NO: 52 - DNA, 21 bp, Arabidopsis thaliana
acttcatcacttgcgggactg

SEQ ID NO: 53 - DNA, 21 bp, Arabidopsis thaliana
ggcccaagaagcccacaacac

SEQ ID NO: 54 - DNA, 19 bp, Arabidopsis thaliana
accgcaagtgtggctgttc

SEQ ID NO: 55 - DNA, 27 bp, Arabidopsis thaliana
ctattctagaagattgttaggagttac

SEQ ID NO: 56 - DNA, 23 bp, Arabidopsis thaliana
atgcctatttagcctttttatag

SEQ ID NO: 57 - DNA, 20 bp, Arabidopsis thaliana
cgtctgtatggattcgtagc

SEQ ID NO: 58 - DNA, 23 bp, Arabidopsis thaliana
tgagaggtgcaaaatcataacag

SEQ ID NO: 59 - DNA, 16 bp, Arabidopsis thaliana
accgcgtcgttggagc

SEQ ID NO: 60 - DNA, 18 bp, Arabidopsis thaliana
ggccgcgtaagaggagac

SEQ ID NO: 61 - DNA, 26 bp, Arabidopsis thaliana
aaactgatattgtagatgtgtattcg

SEQ ID NO: 62 - DNA, 18 bp, Arabidopsis thaliana
cgttcgaagcgtttgttc

SEQ ID NO: 63 - DNA, 24 bp, Arabidopsis thaliana
attacagttttgcctagaagatgg

SEQ ID NO: 64 - DNA, 26 bp, Arabidopsis thaliana
aagttgattttctactgtttatttag

SEQ ID NO: 65 - DNA, 20 bp, Arabidopsis thaliana
catcgtcatatggcttgttc

SEQ ID NO: 66 - DNA, 18 bp, Arabidopsis thaliana
taacgttcccacatgagc

SEQ ID NO: 67 - DNA, 18 bp, Arabidopsis thaliana
aactctgtacctgctgga

SEQ ID NO: 68 - DNA, 21 bp, Arabidopsis thaliana
catctccatgaaggtgaatag

SEQ ID NO: 69 - DNA, 23 bp, Arabidopsis thaliana
aagttatgcaaaatgttatgacg

SEQ ID NO: 70 - DNA, 26 bp, Arabidopsis thaliana
gagcccttctatgagcctacctgttc

SEQ ID NO: 71 - DNA, 30 bp, Arabidopsis thaliana
agagatcccctgttactaaagcctattctg

SEQ ID NO: 72 - DNA, 21 bp, Arabidopsis thaliana
atatttcgtcgatcgtgtttg

SEQ ID NO: 73 - DNA, 18 bp, Arabidopsis thaliana
gtgcctcagggacttcac

SEQ ID NO: 74 - DNA, 20 bp, Arabidopsis thaliana
ggtaacagccttcactcgtc

SEQ ID NO: 75 - DNA, 22 bp, Arabidopsis thaliana
aaagacttgtatttgggatttg

SEQ ID NO: 76 - DNA, 25 bp, Arabidopsis thaliana
tctttcccttaatctatttgttgtg

SEQ ID NO: 77 - DNA, 22 bp, Arabidopsis thaliana
aaacgattgttttcctgtagtg

SEQ ID NO: 78 - DNA, 24 bp, Arabidopsis thaliana
tctctgtgctttctctttcctgac

SEQ ID NO: 79 - DNA, 21 bp, Arabidopsis thaliana
gcaatgctaccgctctgatag

SEQ ID NO: 80 - DNA, 25 bp, Arabidopsis thaliana
ttgtttttctaggttttgttgtaag

SEQ ID NO: 81 - DNA, 20 bp, Arabidopsis thaliana
atgctgcgatgtttgtaagg

SEQ ID NO: 82 - DNA, 20 bp, Arabidopsis thaliana
agtcgatgtctaggctcttc

SEQ ID NO: 83 - DNA, 22 bp, Arabidopsis thaliana
cttccatttcttgatttagttc

SEQ ID NO: 84 - DNA, 25 bp, Arabidopsis thaliana
actaaggcctgtgttgatgtttctc

SEQ ID NO: 85 - DNA, 21 bp, Arabidopsis thaliana
aaccgcttcccattcgtcttc

SEQ ID NO: 86 - DNA, 22 bp, Arabidopsis thaliana
ggcgaccttggacctgtatacg

SEQ ID NO: 87 - DNA, 22 bp, Arabidopsis thaliana
aaccgccattttcatttctatc

SEQ ID NO: 88 - DNA, 21 bp, Arabidopsis thaliana
taggggacatatcaaaccaac

SEQ ID NO: 89 - DNA, 24 bp, Arabidopsis thaliana
gtctaaaaccatcttcaccataat

SEQ ID NO: 90 - DNA, 20 bp, Arabidopsis thaliana
atgcctaactattcgctgac

SEQ ID NO: 91 - DNA, 22 bp, Arabidopsis thaliana
ttctgtagttctttgtgagtgc

SEQ ID NO: 92 - DNA, 19 bp, Arabidopsis thaliana
ggcattaattgggaaggtc

SEQ ID NO: 93 - DNA, 24 bp, Arabidopsis thaliana
tataacatcaaaagcggtcatcag

SEQ ID NO: 94 - DNA, 20 bp, Arabidopsis thaliana
gcattaaagacaaaaagccc

SEQ ID NO: 95 - DNA, 21 bp, Arabidopsis thaliana
cgttgaccccgagaagattac

SEQ ID NO: 96 - DNA, 22 bp, Arabidopsis thaliana
ttcgggaatcatggtctacaag

SEQ ID NO: 97 - DNA, 24 bp, Arabidopsis thaliana
tgtcacatacacggtttctcttag

SEQ ID NO: 98 - DNA, 19 bp, Arabidopsis thaliana
caagcttcatggggactag

SEQ ID NO: 99 - DNA, 23 bp, Arabidopsis thaliana
taatacgggacaatctacaacac

SEQ ID NO: 100 - DNA, 22 bp, Arabidopsis thaliana
ctaattgtaacggagaagagag

SEQ ID NO: 101 - DNA, 20 bp, Arabidopsis thaliana
aagcatgttacgtgggattg

SEQ ID NO: 102 - DNA, 23 bp, Arabidopsis thaliana
caaatgatgtctggtctatcttc

SEQ ID NO: 103 - DNA, 25 bp, Arabidopsis thaliana
aatttaaaaggaatcagagaactac

SEQ ID NO: 104 - DNA, 20 bp, Arabidopsis thaliana
atgatcaaagggggacgagg

SEQ ID NO: 105 - DNA, 24 bp, Arabidopsis thaliana
aaggaaacaccaccaaacgaaaac

SEQ ID NO: 106 - DNA, 19 bp, Arabidopsis thaliana
gagacagaggatttggaac

SEQ ID NO: 107 - DNA, 18 bp, Arabidopsis thaliana
gaaaccctctcctcaaac

SEQ ID NO: 108 - DNA, 21 bp, Arabidopsis thaliana
cccctcccgccctaaacctac

SEQ ID NO: 109 - DNA, 25 bp, Arabidopsis thaliana
ttccgctacatggccttctaccttg

SEQ ID NO: 110 - DNA, 24 bp, Arabidopsis thaliana
cgtattcccctgaaaagtgacctg

SEQ ID NO: 111 - DNA, 19 bp, Arabidopsis thaliana
acatccggccttcccattg

SEQ ID NO: 112 - DNA, 23 bp, Arabidopsis thaliana
attcttttgctttatgggacttc

SEQ ID NO: 113 - DNA, 22 bp, Arabidopsis thaliana
aaacatgctgcagcttgattag

SEQ ID NO: 114 - DNA, 23 bp, Arabidopsis thaliana
aggacgatgatacgcttgtggag

SEQ ID NO: 115 - DNA, 21 bp, Arabidopsis thaliana
atcatggggacgctgcttttc

SEQ ID NO: 116 - DNA, 24 bp, Arabidopsis thaliana
ttggttttaaggctttggtgtagg

SEQ ID NO: 117 - DNA, 23 bp, Arabidopsis thaliana
atgcgcagaagagacgatgatag

SEQ ID NO: 118 - DNA, 28 bp, Arabidopsis thaliana
gtttaaatttttatgtcatgtctgtttc

SEQ ID NO: 119 - DNA, 21 bp, Arabidopsis thaliana
ctttgggcgatgtaggagtag

SEQ ID NO: 120 - DNA, 21 bp, Arabidopsis thaliana
cgcgaccttagccttgttgtg

SEQ ID NO: 121 - DNA, 20 bp, Arabidopsis thaliana
tgtgggcagggtaatggatg

SEQ ID NO: 122 - DNA, 22 bp, Arabidopsis thaliana
atatccggctccgaacttgtgg

SEQ ID NO: 123 - DNA, 21 bp, Arabidopsis thaliana
ccgcgagatggatgtgatgac

SEQ ID NO: 124 - DNA, 21 bp, Arabidopsis thaliana
tgagggggctgacatttcttc

SEQ ID NO: 125 - DNA, 19 bp, Arabidopsis thaliana
ttcccccgaggcgactgac

SEQ ID NO: 126 - DNA, 21 bp, Arabidopsis thaliana
tcggttggggatagaaaatgg

SEQ ID NO: 127 - DNA, 23 bp, Arabidopsis thaliana
gtggcacgatcgtatgagttagc

SEQ ID NO: 128 - DNA, 24 bp, Arabidopsis thaliana
ctctcatcgaccctcactctcaag

SEQ ID NO: 129 - DNA, 27 bp, Arabidopsis thaliana
agtcccaacaaaaccaaaaacataaac

SEQ ID NO: 130 - DNA, 21 bp, Arabidopsis thaliana
ggcctccatgctaccaacaac

SEQ ID NO: 131 - DNA, 23 bp, Arabidopsis thaliana
cacaaaatgccacccctactacc

SEQ ID NO: 132 - DNA, 23 bp, Arabidopsis thaliana
tggcagcagagttatttgacgag

SEQ ID NO: 133 - DNA, 20 bp, Arabidopsis thaliana
atgcgcgactgaaggacacc

SEQ ID NO: 134 - DNA, 18 bp, Arabidopsis thaliana
ggcctgcccataaacctg

SEQ ID NO: 135 - DNA, 19 bp, Arabidopsis thaliana
ccgctgtggaacctgaaag

SEQ ID NO: 136 - DNA, 21 bp, Arabidopsis thaliana
aaacgccgccaaaatcagaac

SEQ ID NO: 137 - DNA, 22 bp, Arabidopsis thaliana
acaaccttagccccatccattc

SEQ ID NO: 138 - DNA, 18 bp, Arabidopsis thaliana
ctgcgagcgaggtcaatg

SEQ ID NO: 139 - DNA, 18 bp, Arabidopsis thaliana
gcagccgtgtggatggag

SEQ ID NO: 140 - DNA, 24 bp, Arabidopsis thaliana
aatcaattggtttctactttttag

SEQ ID NO: 141 - DNA, 21 bp, Arabidopsis thaliana
aactccgactgaaggtatagc

SEQ ID NO: 142 - DNA, 20 bp, Arabidopsis thaliana
tttgcaccgcctatgttacc

SEQ ID NO: 143 - DNA, 19 bp, Arabidopsis thaliana
gaggacgttttgcagagtg

SEQ ID NO: 144 - DNA, 26 bp, Arabidopsis thaliana
tcgactagatttattatttctctcag

SEQ ID NO: 145 - DNA, 20 bp, Arabidopsis thaliana
tttggcttgactctgtgaac

SEQ ID NO: 146 - DNA, 20 bp, Arabidopsis thaliana
gcgaattccttgccactaag

SEQ ID NO: 147 - DNA, 26 bp, Arabidopsis thaliana
aagaagaagaggaggaagaagatgtc

SEQ ID NO: 148 - DNA, 22 bp, Arabidopsis thaliana
agtggacgccttcttcaatgtg

SEQ ID NO: 149 - DNA, 19 bp, Arabidopsis thaliana
tggtccgtcgtagggcaac

SEQ ID NO: 150 - DNA, 21 bp, Arabidopsis thaliana
cttcacgctgccttcactctc

SEQ ID NO: 151 - DNA, 20 bp, Arabidopsis thaliana
gatacgctcgttcccactcg

SEQ ID NO: 152 - DNA, 22 bp, Arabidopsis thaliana
caaaaccaaatccgcgaagaac

SEQ ID NO: 153 - DNA, 24 bp, Arabidopsis thaliana
agtggccagccttcttaacatacc

SEQ ID NO: 154 - DNA, 22 bp, Arabidopsis thaliana
tttgtgcaatttattagggtag

SEQ ID NO: 155 - DNA, 23 bp, Arabidopsis thaliana
atttgcagaagttgaagttggtc

SEQ ID NO: 156 - DNA, 24 bp, Arabidopsis thaliana
ccgtggtcgagagttgagttagtc

SEQ ID NO: 157 - DNA, 24 bp, Arabidopsis thaliana
acccggagtagtttttcagtgttc

SEQ ID NO: 158 - DNA, 21 bp, Arabidopsis thaliana
agcttcgataacaaactcacc

SEQ ID NO: 159 - DNA, 26 bp, Arabidopsis thaliana
agaagataaatcaactaaacaaaatg

SEQ ID NO: 160 - DNA, 25 bp, Arabidopsis thaliana
aacgcttatcctctttctcttttac

SEQ ID NO: 161 - DNA, 22 bp, Arabidopsis thaliana
acggttgcccatcttatcagtg

SEQ ID NO: 162 - DNA, 22 bp, Arabidopsis thaliana
tctcgttctgatggctcctgtg

SEQ ID NO: 163 - DNA, 23 bp, Arabidopsis thaliana
gtgtaaccggtgatactctcgcc

SEQ ID NO: 164 - DNA, 20 bp, Arabidopsis thaliana
cgacgaagcagtggaggaac

SEQ ID NO: 165 - DNA, 22 bp, Arabidopsis thaliana
gcgagaaaacgtgaagagatag

SEQ ID NO: 166 - DNA, 22 bp, Arabidopsis thaliana
agctactacccgaatgtgaatc

SEQ ID NO: 167 - DNA, 21 bp, Arabidopsis thaliana
ttggtgtgttaagaagagtgg

SEQ ID NO: 168 - DNA, 20 bp, Arabidopsis thaliana
taggacgcaaatcagagaag

SEQ ID NO: 169 - DNA, 24 bp, Arabidopsis thaliana
ctaatcatgtgtctttaggctatc

SEQ ID NO: 170 - DNA, 18 bp, Arabidopsis thaliana
ttgggctggcgtggaatc

SEQ ID NO: 171 - DNA, 18 bp, Arabidopsis thaliana
agggcagaaagcgtcagg

SEQ ID NO: 172 - DNA, 20 bp, Arabidopsis thaliana
gctgcgaaggctgaatgaag

SEQ ID NO: 173 - DNA, 20 bp, Arabidopsis thaliana
tcgccgggaaaaacagtaac

SEQ ID NO: 174 - DNA, 21 bp, Arabidopsis thaliana
caccgacgttatctgggaaag

SEQ ID NO: 175 - DNA, 28 bp, Arabidopsis thaliana
aaaagttaggtagtaggaaagaaagaag

SEQ ID NO: 176 - DNA, 21 bp, Arabidopsis thaliana
gagcgtgcttttggagttttg

SEQ ID NO: 177 - DNA, 22 bp, Arabidopsis thaliana
aaccctagatcgcccttttttc

SEQ ID NO: 178 - DNA, 20 bp, Arabidopsis thaliana
gactcatatgtggcgttttc

SEQ ID NO: 179 - DNA, 18 bp, Arabidopsis thaliana
aggattcactggcggttg

SEQ ID NO: 180 - DNA, 2001 bp, Arabidopsis thaliana
cataacacaatgctttgtccaaagaaagacagagaagggcttttttttgtttgtttgttaaagtgtgaggcatggcttggtgggtcaagtttagatcattcagaggagataaccatgaagagttctacacttcgtccattaacaaaatcatcagattattccttcctaattactagtcataccctaaatattcacttacattaatttctggtattctcttttggtagtggtcgctagatttttttgggtcaaaattaaacttcatctactttatttcagtaagatcatgtttcattgtgagaatgccagttcaataaccattaacacaatctcttgaccattttttttttggtttaattgatacttaaacaaaactcgaattggttcaaagctcaaattggtacatgattataagccaaactcaaaactgaaatacttgcctaaaacacacagattagcaaaaatcatcatcggtaatctccccaataaccaaatcaaaactagttttttcaacaaaaaagaaaattgtaatcgctatggctccgtagatcgtaaaacaagatccacaggttcctatcagtaagcgaaacacgtacatttgtttatgtctaatatagcgtcgagttaggatcattgccccaaaaaaaagagctaccttcgacgtggcatcagacaatttctacaatttagaagaaaacaaaaagaaaaaaccctcagcggacccttgtcaaatcaaccacacagcagacacagaacgaattcagtcacgctagctgttgtgtaaagtgtcatacggcacttcctatcttttgggattgcttcttcatcgggtttataacaatcaaaactcgtaaccaaacattaaacgatttcaagtaaacagagaaccaaaagaagaaaaaactaagatagaagaaaacgttgttgaagatatgagaaagagggagaagagaatctgtatttatatagagggtatttgtggcggcataacttaaagccctagcgtgtacgaggcggcatataacttgaaaccctaacgtgtacgaggcggcataacttcaaacccaagcgtttgatcgagttaccatatagcccattaagagcctatatgtattttgggctgaataaaatattattgggccagtagattgtggtagtagaaagagaagagctctaactacaaagactactagtctttgttccttctacgatgattgggacagaaaccaaaccattggttcaacaaatgtggtcccacgtgtggatctcatggctctagggaaaccacttggatgacgctgcaaggagttgatctttatgctgcggttccgttttgtgttgtgcatataatcttagagaaaggtactgtcttctcatgtactcttgttttataggtttttcctctcttttttaagaaaagtgtgtataattgtgttacaaatgttgcagatggagaggaaattgagtttgaatcaaacaaatcagagtttagtgaaggagaaggctctgttcatatcagaacttggggatcttgctgatagactcagcatcttgcagtctcctctacatctcattgtattgtcccctgtttttgcttgcacatgtttttgaaagtgcttaaaacattgtttcaaattcgcactgcactttactggcacacttataaggtgatattgtttatcacacactgtcaagaagttaaaaccattagatgttgacaggactgaacattagatagagactctgtacttctcacactcatcaaactaagcacatcatataaagagacaacgatgacaaaagtgaatcgaaagagataattgcaatagagaataagttcgatttgttgtttgaaagaaaagagagatgaaagaaacggaaacatagtcgatcaattatttatcagaggctgtacatggccccaaaacataaaccaccaaagtactagatgaaacgatacatgaacttggttcagtaaccataagagagagagacaaggtt

SEQ ID NO: 181 - DNA, 2001 bp, Arabidopsis thaliana; identical to SEQ ID NO: 180

SEQ ID NO: 182 - DNA, 2001 bp, Arabidopsis thaliana
cgttttttttttgggaaatacgaaatcgaaaggctaaaaacaactcaattcaatggccaggattaaaggcgagtacccaaatttttaataccaggtaaaatgatccgcgtgttttctaagtgaaactgcgaaagcgaacgactaaaaacaattcaattgaatggccaagattagaagttatgacccattattttaaaatctgggtcaaaaggatccgcgtgttttgtaagtgaaaccccgaaatcgaacagctaaaaacaattcaattaaatgaccaagattagaagttatgacccattattttaaaatttgggtcaaaaggatccgcgcgtttctaaaaaggtttttttcatgacataaaatttttaaccttatggcaaatttattattttagcgaaattcatgcatactttattaaacgtaattatcaaataatagagtagattataattgaatagtataaacatattttcattttatttttgtttttgtttaactaagctcacagcgacacaattccgaatattagcaattggagaaagaataaaagacacagagcaccatattattcttttagcccaaaaatttccacaagtacaaatccggcaaaaacacatacatagaccaatttttggtttactgacgaaattttcagatcagaaaaccggatttgattcaagtgggtccctaaaccgtcggttttaaacaatattttcaacgatgagctttttcaagtcaaactagcgaaacagctatcagacctagacaaaacattagaaacacaatcatgatgattatcttgatcgtctttagatggactattaggcatagatctaagcattcttggtgaatctaagctttttctcaagatctgtctcatcgcagagatcaaatgtcttgtcagattcgatggtgggcttgaggatttgaacttattacacttgttcatgtgtctcgccatagcttcttcttctgttgttaaaaatctttttgttctcatgactttgtacttcacagcttcagaacaaaatccagagatccatttccctatgtaacgctctcttatcatctctgtgtacgattctgtacactcgtcggttaatccgcaacagtcacacgtcaccgaatctagctcatcgctggatatttgtgtcaccggaaccgttgagataattattacatccggtgttgaaattaacattgttggatcactaagtacactatcagacatggtttcttgatttaaaaccctgttgagaaaatttcgatcaacaatctgattcttacttcaacataagaaactataaagaaaccaagaggagaagttttatcagtagcagaagatgagaagataacgcaataagcttgtgatatatcttctttgttttgtctctgtttctgaaacagagaaatggtttttaaaaagggattcttaaaagaaattggaatacatttttttttttttaacgttcgttttgccactctctgtcttctaaattactttcatctccgagaaaaatttcacaaaacaaaaccattgcaaaaacagagtattaaaaatgctttttatctttggcttttcttgaaaacaaatagaaaaagttaccgtttctatttacttcacggaaaaaacattagaagttcataaaaattcactcgaatctctcgttacttcagaagagagaaaaaaaaaagtattgttttggaaatatatgaggaagagaaaatgagagaagaagtagtgcaggcgaaggagaagcaatgtttggtgttttataagagagacgatagtagtaactagtgacgtggaatattgattttaattttttagttttattttatttattgaacattttatcaaaacgccgcgtattagagaggatgccctagtttaatgtcttggtataaaagcctatattttgcatttttcatccgactctctgcgttaggtttcattttagcggcagacgagagagcaaaagcaaggagaaaccctaacca

SEQ ID NO: 183 - DNA, 2001 bp, Arabidopsis thaliana
aacaaagctgggttttttttttttcaatttcgattcatctcaaggtttttggagtttttgattatggacttgtgagactcttagaatttctgttttatgatttattggataactgtgattctccaagaacttatgtcttatatgattttgtcttcatttcgttgcttcttatttcttgcctgtgatgtattgcatctgcatagttggattgaaagttaggttcttgggtttataagaaggctgtgacttgatgttacttagccatagctgatcaaatatcgtctaacaaagtggtctgttactctgttatattggttcgcgtaaattttggttacagtttgtttccgagttggtatctcgtaagtcgtaacgtttgtgtacttattcactggaagcaagttgtattgttgttagtcttttgttacctctcctggtacgattttttttgtttgtgaacaagatcagaaactgggactgtgaatttgaccgataatcaaagaaccaaataacttttgatccaaaaatcgagtaattaataaccgaaaagatctttctactaagttttttcctacttcgacgtgatttttgacttgttgcaaaatgttatgctctttgtgcgttccaccacttccgtagtgaaagctcttgtatccgtaaagcaaaaagtcaacccttttgagtttttgtcatggcaatttctgcacatttttcattgcagccttgccatggagacaccatgtgttcccaagcttcagcgggcaagacgtccgtagaacctttctcagtcaccttctgaaggaattccggaacaagggaatacgcacgttcatggataatgatatcgagagaggccaaatgatcagtcccgagctcatacaagcaatccgagaatctaggtttgcggttgtagtgttgtcgaagacatatgcatcttcaaagtagtgtttggatgagttggtatattctttatacccagtatcatgattcatataggtaaagaaacagagttacacataaatgcgtatacacaaagatatggtgtttgtgctgattttgctctttacttgttgttttcaaacttatgaaaagagatatatcacagagtgtatgaaccataaccgtacatgtcccaaatccaaacaagtcctctatcgagtgtgtttgacgcccaaccatttgattaatgagttgattacgcgatggtgtcttgttagcaatagcaaatatgatcggccagccccaaaaccatctgatattgaaatagtaacggagctgttcacggatggcatcgaattgttgcttcagcggatttcctctccttcctcctcggttgcagatcagacagaagctgcaaaagagcttgccctccaatcctcgaaatttgtccaagtccgtgacttctttatcaaggaactttctgattcgatcaccaggttactcactccgctctctgttttgggcgatgaggtagactcgaatcccgagcttcaagagaatatcgtcacaacattgttcaacatgtcgactttcgaggagaataaaacactacttgctgaaaaccatcaagtgatccctgtgcttgcaaagtttatgaagcagaagtcagttgtgacaagaagaaacgctacattgacttgagtgtcacttttagacattgattctaacaagatcatcatagggaactcagtagcactcaaggctctgatagatcttatcggggagttggatgacttatcagctactcatgaagctctttgcgctgttatatacctctgttgtgatgaaatggagaactggaaaaaggcaatctcgttggggttgactccttttgcagtcagaaatatcaaagcaagaagaaattcgtttgactcgttagttatcttggcattgatttctttacacgaacgcgttatccaggaactggctaatgggttatctatgatctgttaagtatcttgattcttgaggaacaaaagttgcatggtgacttgtgagaacgtt

SEQ ID NO: 184 - DNA, 40349 bp, Arabidopsis thaliana
tacgctcactatacggcgaattcttcatctttaattatgcctaatgctagatctagagtaattaactagatcatgaatccagacaatagatatgcccgccataggtatctgtagtcggatctattatttgatgagtctggtttataggtgtgtaataagaatcggcctatgtactaagatgaacaattgaacttgttaagaatgcgtatttaggttgatagtttatcggcttctccagttattattagctatagatatagggagtttcgcggcacgcccaccggttattccataattagagtttgagtttaagaatggttcgataacaacctagctttcattagatctactaaccaatagtttcctgaaaataccatgttcctagctttttattaaatcgtttacaacccaatcaatctgctgttttcttattttgttttctaactattttactcataccttaatagcttaatctcgacatttaactcactgtttgaacaaaagaactccgcgaattcgatcctaaaatattgcaattgatctcttatttgagagagtagttctaggtaatttgaaccatatcaaatttggcgccgttgccgaagttcttgggaatcatcattgagtttagtttagagattttgtctagtttttacttctattttgttactcacgcgtttcttgttttcttcttttccgtgtttcaggtgtatgcctaggcaaacaaggagcacaaaacagaaggagcttatcaacttgtctgttctggactagggagaacttgaacgcatcaaccaaaaaactaaaaaattagcaatcgctgacagagtcatcagagctgatgcagaaggagttttgagagatgaggatgggcaagcctacaatgaggctggttagagattggatgatcatggactcatcctacccgaggacgccaatgaggatcaggcgtgcctcaatgcgcaattagctactagagacgcagcagggctcggtgtcgagcgataccaactgggtgtcgatcgacaccatcgggagcagcacgcagatgcaatcggtgtcgaacgacacaatagaggtgtcgatcgacagcaacaccacattcctgcagctattcctccagctgcggaaccacgtcgtactcttgggaatttcaacaagccagacctgttctatgctaatcgatcagcgattgtaccctcaccattttagaggaacgactatgagctgaagcatggctactttgctttagttggccagcatcctttccatggcttatctcatgagcagccaatggatcatatcgagcgatttgaggatcttgttttgagcatcaaggctaatggagtttcagagtttgaaagctctagggaagcatcaagatagccttcttgaacaatttctacgatgatgctaagtttgaggagttgagaaacaagctgtctaccttcacacaaggtccagttgaagctttcaaggctgcttgggttcgtttcaaggagtaccaacgagattgtccacatcatgatttcagtgaggtacaacttctaggtaccttcttcagaggagttgattggagataccagatggctctagatgcagcgagcaatggtaacttcaatacacgttacccagctgatgctacagccttgatagagaaccttgcttgcagcaacagtaccaagaatgctgattttgagaggaagaagattgctggagctgtttcaggaactctgatagcagaggtgaatgctaagctggattcagttcataacttgctcacagggaagaagcatgtccattttgcagctgaagaagagactattgagcctgagcctgagtcagtggaaggagtcttttacatagatggtcagggatacaggaaatttgggcagccacaaggcaacttcagtggcaacagatttgcagggaaccagggttcctcatactacactccaaagcctgctttccagaagacttttcttcaaagcagctttcagaggacctatggaaattcaacttaccaagcccccccccccctcagcagagacaagaatggaatcaatgcttgagtagattcttgagagccaaacaaagcttcttgtggagtttaatggcaagtttgatgctgtctacacagatcttaatgggaagatcgacaatctgagctctcacttgaagaagctagatgtacaggtagctcaaactgcacaatctatcaagagacaagaaggttttcttcctggtaatcctgatgctaaccaaagaaagagctgtaatgccatcttgatcagagaaggagatgatgtgtgggaggaattggacactgaagacgagttggagcttgtagttgcagagatggtatcgaccaacaccctcctatgtcgatcgacaccatatgggacgcttttctcagagacgacccactacgacggtgtcgattgatacccctctagtatcgatcgacactggatctggactgcaccttgtgaggtgcaagtatctatagaattcttcatctttaactatgcctaatgctagatctagagtaattaactagatcatgaatccagacaatagatatgctcgccataggtatctgtagttggatctattatttgatgagtctggtttataggtgtgtaataagaatcggcctatttactaagatgaacaattgaactctttaagaatgcgtatttaggttgatagtttctcggcttctccggttattattagctatagatatagggagttttgcggcacgcccaccagttattctataattagagtttgagtttaagaatggttcgataacaacctagctttcattagatctattaaccaatagtttcctgagaataccttgttcctagcgttttattaaatcgtttacaacccaatcaatctgctgttctcttattttgttttcttactatttcactcataccttgctagcttaatcttgacatttaactcattgtttgaataaaagaactccgtgaattcgatcctaaaatactgtaattgatctcttatttgagagagtagttctaggtaatttgaaccatatcactcctaattcatctctaactcttataattagttaatgcattggattgtgacacattttgaccatgaaaacacaaacaaaactgtttactgattctaagcaattttttgttggtttaggttcttttgggagaaaatgggtataagtgttttctaaacactcctaatccaactctaactcttatcattagtcaaatgcattggattgtgacacattttgaccatagaaacagtagcaaagctatttactgctcctaagcaaatttttgttggttttagcctcttttgggacaaaatgggtataattattggctaaacactcttaatccatctctaactcttataattagtcaaatgcattagattttgacctattttaaccataaaatcactaacaaaacagtttcctgcttctaagcaatgttttgttggttttatcctcttttgtgagaaaatgggtataagcgttggctaaatcactcttaatccatctctaactcttataattagtcaaatgcattagattgtgacacattttgaccatagaaacactaaaaaatattaactgcttctaagctaatttttgttggttttaacctcttttgggagaaaatgggtataagtgttatctaaacactcctaatccatctctaactcttataattagtcaaaagctttggattgtgacacattttgaccatagaaacactaacaaagctatttagtgcttctaagcaattttttgttggttttagcctcttttgggacaaaataggtataagtattgtctaaacactcctaatccatctttaactcttacaattattcaaatgcattggattgtgacacattttgaccataaaaacactaacaaaactgtatactgcttctaagttattttttgttggttttagcctcttttgggagaaaataggtataagtgatgtctaaacactcctaatccatctctaactcttataattagtcaaaggctttggattgtgacacattttgagcataaaaacactaacaaagctatttactacttctaagttattttttgttggttttagccttttttgggagaaattgggtataagtgttgtccaaacattcctaatctatctttatctcttataattagtcaaatgcattggattgtgacacattttgaccatagaaacactaacaaaactggttagtgcttttaagcaattttttgttggttttactctgttttaggagaaaatgggtataagtgtttctaaacactcctaatccatctctaactcttataattagttaaaggctttggattgtgacacattttgaccatagaaacactaacaaagctatttactgcttctaagttattttttgttggttttagcctcttttgagagaaaatgggtataagtgttgtccaaacactcctaatcaatctctaactcttataattaatcaaatgcattggattgtgacacattttgaccataaaaacactaacaaagctgtctactgtttcaaaacaatttttgttggttttagcctcttttcagagaaaaaaggtataagtgttgtctaaacactcctaatccatctctaactcttataattagtcaaatgcattggattttgacacattttgaccataaaaacactaacaaaactgtttactgcttctaagcaatttttttttgattttagcctcttttgggagaaaatgggtataagtgttgtctaagcactcctaatccatctctaactcttataattagtcgaatgcattgggttctgacacattttgaccataaaacactaaaaaaactgtttactgctcctaagcaatttttgtggtttagcttttttgagtcaccaaacagctggcctacagccaccaagaaggattactaccacgcccccggaattgacccctcctggcaaaccccaaataaccaattctaggttttttctcaacccgggaagatattcttgaaaaatttcccctctgcggcacagaaagaaaaatcacttctccccccctcattggtgcccgcacgccatcgcattgttgcagccttcgtgtgggtgcaaacaattctttttacccggttctccctaggaggagaccacaaacgggctatatggtgctttggttattcgacggtcatctttaggcttccatctttgtgcgccacaaaatcgacaatgatcttctttttcgtcttctttccagaaaagcatacaattgttcgagcaaacatcaatcgtatgatatgaaagtcctaaattgcccatcaacttttcggtttggtaatgtgaactggtagcctggtttccttctggtaaaaaatctgtaaacatttcgcaaacagaatccaccaacttttcactcatattataatccgtcttgttctgcatgagtcgagatgctaaggataattgcgactggccttcacgacaaccatcgtacaatggattatttgcaccttctaacatgtcgtagaatttttttgaatggttacggaccggttcttccatactctgataactactatcctgatgataattatcctgatgataattatcatcaaccccacgttaaaataaaatgcgtcgttcaccatatccacatatggattttctacaacattacccacttcttcaggattagaactaaaatacgtcatatccgtgtaactagttcctatatccatattcaattcttctccatgcttataccaaacataataatcaggcataaatccttgactaaacaaatgactactaactcttctacccgagatgatgtgtttctcattcttgcatacactacaaggacaatgaaatttacctcgactactctgtactataggctgactattagcgaatgtcatgaactcctccactcctgcgacatattcggctgacaaatttcccgttacttcatcaaatctcttgtacatccaatatcgatagaaaccgccaccaccgccataattgaagtttcccgccattatagcataaactaaacttatattttttctttcaaaatcggttttttttccttttgattgtggttttgatttggtggtgaatgagaatgaagactgccgtggattatatagaggatttcttatgactattatacgactaaacattgtagacgctcagaaattaggtgtacctactcagcaacgcgaaaaacgttttccaaccatattatacgacaattatgcgactatgttacgacaaaggcaaaatagtcgtattatcgtcgccgaatgtacgactattgtctgtagtcggatatgtagtcgtcaaactacgactactttacgactacatattgttctcagtaatgttgtcgtccgatagtcgtaattggacgactatgcaccgactaaatattgtagtcgctaaaatacgactatgtaacgactaattgtactgttgtcgtaaagtcgtcgtccagcaatcgtaagttagtcgcaaaaaaggacgactacattgttagtcgcctttcgtagtcgtcgtttgtctgttttcttgtagtgctcaaagctgcatggtctgtatagacagtgaccttggatccaaccaaatagcttctgaacttctcaaatgcgaatacaacagctagaagctccttttcagttgttgcatatcttccttgagttttatccaacgtcggctggcgtaatatttgacgtgaaccttcttgactattttctggcctagaacagctcctacggcataatctgacgtatcacacataatcttgaacggatagtctcaattaggagctcgaacaacaggagcagataccaaagctttcttgacggtgtgaaaggatttgaggcatgtcctcatcgaatttgaactaggtctccttgacaatagtctagttaacggcctggctatcttggagaagtccttaataaatcttctgtagaatccagcatgaccaaggaaacttttgatgtctttgacaatttttggtggctggaatacatcatcacttcgatttttcccttgtcaacctctttacccttctctgatatcttgttacccaacactatgccatccttcacatgaaatgacacttttcccaattaagaacaagattagtctcttcgcacctggtcaataccctgccaagattcaactaacatgaggagaaagaggggccatagaccaaaaaatcgtccatgaagacttccaccatctcctcgattaaatctaaaaatatagaggtcatacacctctgaaatgttgcagggacattgcataaaccaaataaaattctctaataagcaaaagttccataaggacatgtgaaagtggttttctcttgatcattagggtgaattggtatttgaaagaaaccactatatccatcaaaaaagcaatagtatgagtgattagctaagcgttctagcatttgatcaatgaatggtaaagaaaaatgatctttcctagatgcagcatttagctttctataatcaatatacattctatgcccaattatagttctagtagagatcaattcatctttttcatttttaacaacagtcattccgccctttttagggacgctatgcactggagaagcctaagtactattagagatagggtaaatgacaccagcatcaagcagtttcaatttattttttcactacttatttcaagttagggtttaaccaggtgatagggtaaatgacacaagcatcaagtggttcaatactagaataggattcgttttcaaggtggatcctatgattgcataaactaggtgaaattcccttaatgtcaaataatgaataaccaattgctctcctatactttctaagttcagataatagcaggttcacttcatcatcatttaactcaacattaatgatcacgggataagtagagtttggaccaaggaatgtgttggagctggatttccctcaaggaatccacctgcgaaaataccaggccagcccactaagcccaccaagtagaggacctgcgcaactgatgtgcccacgtacgcaaatgggtacttgagcctgataagcccggtcacctgatgaagggagataagcgagtaacaacctaggaactaacggggagatattcgcggagcggacctgatatctcggaactgacctgccaaatatccaggagaatctccgcagatcctggacggagctaccacgtgtgtagacctatataaggaagcaaggacgacttggaagacacattcaatgcagctttacattcacacttacacttttacacttgtaatctcattccacattgtaaaagctttactatcatcaatacaaaagtctcttcgttcttagcaatataactctcaaagttcatgtgaagatctagccctcctttctcataatctcagttacaaatctctactgtggatttcagaacccacatttggcactgtctgtggggacggaaatagatcattacaacaccaaaactaacacatcaattgtgaccaacgatcatggatcccaatttatccgattcaacaagatctggcgtaccagttcaagtcttaaacgataacgtctcggacgggcacctcccaacggatctctctttcggaatccaggttgatgctatccatgacattgatgcggagaacatctcccaaaactcgaattcttctggatctgaccaaatcctcccccccttgcaaacaagggacggggaacaaaacgtcacgatacagcctcctaacggagataaccgggctaacccgtctaatcagctccctccgagacctgccaacgaactggcggagctccgcgcaatgatcctgaacctaatcaacataagcaaaaaccaagaaattgcgcatcgcaacctcgcagaaatggtaaggaaattcctccccgcgaaactgggattcctgcccagatccccatagatctgacagataccgtctccccgacagatcccactccaaggactcgtctagacttcgtctcgatagaggtctcacctcctctcaaccggcaggtcgcctttttacaggcacccgtgcacactctcgtcgaaaacccaacaacagggaatgagacacgtacatcgcctaccttcccaaggctaccgctcccacagagaacctcgtacgtgacgccctcgaatggtttgctagtctcgaagggaactctattgatacagtactcggtactcatcgtaaacaggacgtctgaagccgacctctggggtctcacccaaattcagaacgaatccctgcgatcttacatcgaaaaattcaaagcaatcaaatcaaagattgcgaacctaaacgaggaggtagccataaccgcccttcgcaacggcttgtggttttcctctaggttctgtgaggaactcaccgttaggcacccggtttctttaggatgcctttcacaaaggtcttcactttgccaaagccgaaggggagcacaccgttttggcccaaagattcaaagaatctaaagcacaaaacgcttcccttgcaactaaaatacccttcaaaaaggaaaaccaaacacaagggcagcataccctattcgcaatagaagaggcagtcgaggacgtgagtccagaacttgacctcgaaaaatattgcaagtaccacaaaaagagaggatatttcacctaggaatatcgcgccgttacaaaattaatcgcagccggggtcaaaactaaaaaaggttcaaaccccaaagctaaaacccctcctcccgatgagcaggaggaggagcaaactcccaaactaaagaaacgggaccgaacactggaaggaggtgactctcctccacctgctaggaaagaacgcatagacctagcctttgcagaactcgaactggaaggcaggacaaaaaggtcagtcactacacctcctcccgccacgcaaaagaaaaacacgaggttcccattacgcctcccgaaattctgcagaaacgcaaccgagcacctctccccgaaacgcatcgatttcatcatgggaggatctcagctctgcatagactcaatcaattcgatcaaaactcatcagaggaaggccaattcatacacaaaaggcaaaagcccgatgatggcacctgatcaccagatcacattttgggaaagtgaaaccactgacctcgataaacctcacgatgatgctctcgttatccgaatcgacgtagccaactacgaactctcccgtataatgatcgacacgggaagctcagttgacgtactcttctatgactcacctccccacgtcaacggctcctcccccaccagggaagtcccgttaccggacctggatggaaccaactctaataaaaaatagctcctccacgtcaacggctcctccaatccacaaggatccggattcggaatacaactcacctcccccaccggggaagtcatcgaacaatcgttccgacttggattcaacgcatcaaacaataagtctgagtacgaagccctcaattctggcattaagctagctcaagaaatggggatccgcgaaatacacgcccatagcgactcccaactcgtcaccagccagttcgaatcgtttgaactaaccaggatccccagaggagaaaacacctcggcagacgccttggcagctcttgcttctaaaacctcttttaggagaaaatgggtataagtgttgtctaaatactcctaattcatctctaactcttataattagtcaaaggctttggattgtgacacattttaaccatagaaacaataacaaagctatttactgtttctaagcaattttttgttcgttttagcctcttttgggagaaaatgggtataagtgttgtctaaacactcctaatccatctttaactcttacaattagtcaaatgcattggattgggacatattttgatcatagaaacactaacatatatattgactgcttctatgcaattttttgttggttttagccccttttgggagaaaattggtataagtgttgtctaataactcctaatccatctttaactcttataattagtcaaatgcattggattgtgacacattttgaccataaaacttacaaaacttacatctcatgaatctcattagactcaggaatatcaggatccggaaagacggttgatatcgggccttcggtgctaacacgtacgttctttggaccatcaaaataacggtcaatcttccaccacccaagaacaccgacaataactccaccatcatatcgacgataattatgatcaaagtcaagagcttccttcttagtagctagacattccaaaacacgatttctaaacagataatcaaaaatagtattagaacagtttaatttaggtaattcaaattaaactctcaaagaaggaaacttactcattgtcacttattttgaaagttagcgtcaaatcaacgacgtggttttgcttaggtattgtgtttatcaattctccaacatcatagatcgctcccaccaagtctccaaaaattacaaaaattaattaaaataaatcagagtcaaatatatacaattgatattgaaaatgacaaaactaatgaacactaagatgcatgatataaaataatgaacacaacaaattcataaaaatctcaccgactaaaacagatttatcgatttcatcatcgataatcgaaaagaaggatggtagaagatagtgaggaatagtgggtaccagacttgttaatctgacgacagtgtcaacagaaaattcaattttgaaggtatgagttgttggcctgacaggacccgagttctcatcaactccaaaccttgttatcgttgcccattctcttttattaataaaatctttttagtgatctgacatcttgtatccaacagtagcttcaatagtcataccctacggatcaaacatactaatcaaaactctaaaacatgcaaacctaaaattatcattacaaaacagtcaatacttacatgttcgtcgacgagaagcaaacccataacctttgaagatggaaccagcggaactaagaatgtcctcacaactctcacacgaatacaccatcctgtaatagacggtttcaacagtgtaagaggatgaaacgattccatcttttcgctgaaatttcttagttattttttgtattcgttttatgagatgctaatgataccgatatatatatataagagagagaaatacatcgtagaggcatgttagatgcaacttttaaaaaagtaataatagtcatgatgtttcaagtcatttcgtaatcttgaatattctgtaatatattttgaataactcaattattaataaaattaaaaatttggcgagtcttacattttagagaaataatagaaatattttttcgttattattaattagagttgttatataaataccaattgtcttaactgcgtggataaattagtaacaatcacatgatcctataatgtttgagacatttaataacaaaatttccataaaatttaataattatggagagaaataagtaataaatatttttcatattttttataatggaagtgattacaaattaggaaacaatatatatgcaaatatattgctaacaaaagaatctataatttaattctattatggcacaacatacagaatggatattctaatttagttttctactctattattggggaaattggaacacaaattaagggatgcttgattaagagataagagttgaaataatttattttttcaacttagaaggttcctctatgaaggtgattttacgacatatttctttggacaaatcttttaataaactcctaggggttgggttttggtgttcttttgtttaataaggttagatatctaactctttatttgcgtgtccgatgggatacaatatttgccgccccatacctctttgtttaaccccgcgcgattttcaccctaattgttagactcacaaaaggcagcagttgactcagaggtttacaagggcttgatggggtctgacacaaatgttatgaaagctaatgacgtaagttcaacacatgctcgaccaactacttccaccaacaactcgaagaagcctccaacttgtcccgaaagctcatgctcgaccaaacaactcaaggcaagcactcagatgtcagatgattggttagaactcaaggagagatctaaatggcaagacaaagccatacaagagttaacacatattgtgaaagagctaaaggatcaaatcaaggagctcaatggaaaagccaaccaagtaccactcaacatcaaggacgcccctgacgatggagacctgtcaagaaatcctaatgagtatgatgatcactctactaaagaaggagaggagacctcatttcctctctacaacccaccgtaagcctaatgagtatgagaagtcaagcttaaagacatacaacaagctcacttgggagcaaatcccatgtctatctttgtacatatctttattttccttgttgtttttgatgcatttggttagtgttttcaggagataagtataaagagctgagtgaagtggattctggctctgagagtacaacactatactcgaccacaaagcaatgaaggatactcgaccatgttctagcttatccacgccaggagatcactcgactgcggtgctggccgcagcagaagaatggaggtcgagtatactcatggcggtgctggccgccatagaggcactgaggtcgagtacccacatgcaggagctgagacagaacagggcggctcgtctatggcctgggagcaatcacatgcagccattgacgaccaacttcgttcgttcttcgagtgaggtaagcgtctcacttcaccattgtattatatcatctcttgtgatttgttcttcattttgtttctgtgattggatttgtcctgagtactctcttccaagtttattcacacagtggactgtgtgatttaagtttgggggagggctcaggaagtgtgtgttgcactgtgtatattttttagtctgcattcatttaaggcatagaaaaaccaaaacaatttgaaaaatttcagaaaatgatttcataaaaaagagtgttaatgtagttgcattacatttaggatcgagtcgagagtgttgcatttaggattgttgcataagcataggggatgatgatgagatagccttgtaagcattttggttcaccggataaactcagtgccctcgttgctagttgtctgttgcctagtcaatgaatttgaaataaaactgaaccatgcctagattgctctactctaccacactgtcatgatttgataccactccctatcaatttgaacctgaatctgatctttaattatcatgtctgcatcaaatttgaactcatggataccctaaaatacttggattttcttactcattttgatcactcttgttaatccaagtagctcactctccctattagagcagttaacccgaacctaaacctagactttcttttaaaccctatatcacttgtgagtgtttgtgaggtcttattccgattaagcttggtagaaagtgttaggttcgtaaccacagagatagtgtctcatgtagttctagttcgcatttttcggactagataggactaggtgggtgcttatactttgggttgggatgtgtttaaaaaaaaaaaaaaggtggattcattgataagaaaaggtaaaagactctaggtaaagtaagctgaaagcagaaaaagtctagtaaaggttttgggatttgtaaagaaaagaaagagttcttgttagctaatgaagaagggcaaaagccctcggttttaaaattttaaaacagaaaccttagttgttacagaaatccaaacccttgagaaagcttctcctggagttaagagaaaagaaaagaatgattagaaaaagggcttaaatgattcatgactgcaaagggtagagttaagttcttaatttgggactagagataggattaccattagagcttcattggttatactctgggtagatggaatcttatctctgtatgcatagcttgggacttacctttagcattctactaatgcttaattattttttgagagattccgtgttactgaagcctattctataagggaccatctttgtctcttgacctttatcttaggcaaatgagttcattgatgatgcattgcttgattcactttccagaactaatgaatgttaaagggattggtagatttgaaaacatgtgtaggtcgagcatacgactcggattgattgataacaaggcctgactaacgtttttgagtagaatttgatcatatcgcagcttagaactaccaacttggacattgatttcatctgatttatctagtgctttggctctaagtccccgctttcaaacctcacctccagcttgttctttattgtttgcttgagggcaagcaaagactaagtttgggggagttgataagtgtgcattttacacattttgagcatccatttgtcatcactttagcatcatatcatcactgttttataccacttctcatcatttgtcatcattttgcatgtttaggatagttttgcatgcatgttgcgtatttgtgttgttttcaggtgatttggagctgttggcgagctaattggaagaaactggccagatcatatcaatacatttgaccacacggtcgagtagatggcttcacgacatcaacaaaccacttgaccccctggtcgagtagaaggcttcatcacttcacaccaccacttgaccccaaggtcgggtatcatcatctccaccacctgatcataactcgatcacaccactcgacccccagatcgagtacctccatcaccttcactccatcactcactcgattacacgaccgagtcccaccatcatcacacactcgacagatcactctaccaccaagccgagtactaccatctccatcactcgacttcatactcgactggcagcttcagagtcttctctattccgcactcaaccagacactcgagcgcaaggaagaaaagaagactccagcttatcactcgaccattcactcggcaacctgggtcgagtatcgttcttaatccgtcacaatactgcgtcgttttgagtattagggtttcggtatatttccctataagtagcatgtatttcacactttcgaagaaaagttttaatcccgctgacactgtgttcttgacatttttgtaatccagatttcttttaatctattcagtattcagtattcgcttttcattttcgtttactaagttgttcatcctattatcatcttgcttttattctgttgctatcatgttttcattctatcgtttatgctttatgcaatgatgtctaagtagtgactaggtttctgaggatgggttagagtagtttagaattctcagtatgctaggtggttgagttttatttatagatctcttctacattagttgttcttaatgcctattgctttctgatcaactggaatttgagcccagacatttccgcacccaaaaagtgttcgatgaaatgtctgaaccactaattcacgagattcgtggctctgtaccactaatcatacacatgacatcaagtcatattttactccaaaagactaaacaagctttttcttgcttctcaaagctttgatggtgtagccaaagtccgtatgagtctttggctttgtatcttcatacaaggaaacactacttaggctttgaagatcagaatgttgttctagttctaatactcaatcatacacatgacatctagtcatatttgactccataacattaaacaagattcattttaattctcaatactttgatggtgtagccgaattccatatgattctttggctttgtatctacaaacaaagaaacactacttaggctttttagatccggtagcggtgctagttcttatactcaatcatacacatgcaatctagtcatatttgattccaaaacactaaccaagcttcttcttgcttctcgaagctttgatggtgtagctgaacttcgtatgagtctttgaatttgtatcttctaacaaagaaacactaattaggcttttaagatcatgttgcggttctagttcttatactcaatcatacacacgatatctagtcatatttaactccaaaacactaaagaggcttcttcttggttctcaaagctttgctcgtgttgccatagttcttatttgtcttttgctttgtatcttctaacatggaaacactacagaggcttttaagatccggtttcagttctggttcttatacttaatcatacacatgacatctagtcatatttgactccaaaacactatcaaccttcttcttgcttctcccagctttgatggtgtagccgtaatctgtatgaatctttggctttgtatcttctaacaaggaaacactaggcttttaaatcaggttacagttctaagtcttatactcaatcatacacatgacatctagtcatatttgactcgaaaacactaaccaaggttctccctgcttctcaaagctttgatggtgtagccaaagtccgtataagtcttttactttgcatcttctaacaaggaaacactacttaggcttttacgattcagttgcggttctagttcttatactcaatcatacacatgacatttcgtcatatatttgactccaaaatactaaccatgcttcttcttggttctcaaaactttgatggtgtagccgaagtcgtatgagtctttggctttctatcttctaagaaggaaacacttcttaggcttttaagatccggttgcggttctaagtcttatacttaatcatacacatgacatcaagtcatctttgactccaaaacaaaaataaagcttcttcttgcttctaaaagctttgatggtgtagtaaaagtttgtacgagtctttgtcttcatatcttctaacaaggaaacactacttatgcttttaaggtccagttgccggtctagttcttatacttaatcatacgcatgcaatctagtcatatttgactccaaaagactaatcaagcttcttcttgcttctagaagttttgatggtgtagctgaagtccgtatgagtctttaaatttgtatcttttaacaaggaaacactacttaggcttttaagatccatttgcagttctagttcttatactcaatcatagacatgatatatagtcatatttgattccaaaacactaaaaaggcttattcttggttctcgaagctttgctcgtgttgccatagttcttatttgtctttcgctttgtatcttctaacatggaaacactacataggcttttaagatccgatttcagttccagttcttatactcaatcatacacatgccatctagtcatatttgaatccaaaatactatcaagtttcttcttgcttctccaagctttgatggtgtagccgaattgcgtatgaatctttggctttctatcttctaacaaggaaacactaggctaatatggtctagttgcggttctagttcttatactcaatcatacacataacatctagtcatgtttgactcgaaaacactaaccaagcttctttctacttctcaaagctttgctggtgtagccgaagtccgtatgagtctttggctttgcatcttctaacaaggaaacactacttaggcttttacgattcagttacggttctagttcttatactcaatcatacacatgacatttagtcatatttgactccaaaacacaaaccaagcttctttttgcttctaaaagctttgatagtgtagtcgaagtccatacgagtcattggctttctatcttctaaaaagaaaacattacatgtgcttttaagatccggttgcgattctagttcttatactcaatcatacacatgacatctagtcatatttgacttcaacaatctaacaaagcttcttcttgcttctcatagctttgatggtgtaccgaagtccgtatgagtctttggctttctatcttctaacaaggaaacactacttaggcttttaagattcggttacggttctaagtcttatacttaatcatacacatgacatcaagtcatttttgactccaaaccacaaaccaagcttcttcttgcttctaaaatctttgatgggtactcaaagtccgtacaagtctttggctttgtatcttctaacaaggaaacactacgaaggcttttaacgtccagttgcaatctagtcatatttgactccaaaacactaacatagcttcttcttgcttctcgaagctttgattgtgtagctgaagtcagtatgagtctttgaatttgtatcttctaacaagtaaaaactacttaggcttttaagatccagttgtggttctagttcttatactaaattataaacatgatatctagtcatatttgacctcaaaacactaaaaaggcttgttcttggttctcgaagctttgctcgtgttgccatagttcttatgcgtccttcaatttgtatcttctaacatggaaacactacataggcttttaagatccggtttctgttctagttcttatactcaatcatacacatgtatctagtcatatttgactccaaaacaatatcaagtttcttcttgcttctccaagctttgatggcgtagccgaaatccgtatgaatatttggctttgtatcttctaacaaggaaacactaggcttttaagatcatgttagagttctaagtcttaactcaatcatacacatgacatctagtcatttgtgactagaaaaaactaaccaagcttcttcctacttctcaaagctttggtggtgtagacgaagtccgtatgagtatttggctttgcatcttctaacaaggaaacactacttatgcttttacgattcggttgcggttctagttcttatacttaatcatacacatgacatttagtcatatttgaatccaaagtactaaccaagcttcttcttggttttcaaagctttgatggtgtagtcaaagtccatatgagtctttggctttctatcttctaacaaggaaacattacttgggcttttaagatcctgttgcgattctagttcttatactgatagagaggaggaagcaaggtaacaagcaggggtttgagatctccaggaaacaacaaactcgagcttggatcttacttatctcgatgataacgtatcgagaaagcaacaaagggatgaggatcctctcctcagggctaagaaactctttaatgtaaactgaattttattatctaaagcgtgattacaacgatgatgaatgaaggctacttatagagaataaagagataacaacgaatactctaaagctaatcatatcgaagattcagtattatctaaaaacacaagaaaaaggagaaaatgtaatagaacattctaaacgattctcatatacgtgaagcccatgatacgtagacgagaagcccatgaactcttaagatgcgctgcatcaggtcccctcgggtgggagaggattcgaccctgaatcaaccacctcattgtcaccacgaaacggagagaggtacttcacgttgaacacattggacgtccgtaaatggggaggaaagttgactctgtacgcattctcattgatgcgttccaagacttcaagtggaccaatcttgcgggacttgagttaattgtactcatgaggtgggaaacgttcacgggagagcactacccacaccaaatctccaggattaaaaagcaattcccgacgcttatgatcagctgcattcttgtacttggtcgtcgcggcttccaaattactgtgtgcatccttgtgaactttctgcaactcttcaacaaagtccacagcattaccatgcatgcgagttttatcagggagagttgtcaaatccaaaggtgcacgtgggacaaaaccgtacaccacacaaaacggagagcatccaacacttcggtaaaaagcatgattgtgtgcaaactcggcttgacatagcttaacgtctcagctcttaatgttatctccaactaaacatcgaagaagatctccaagagctcgattgctaacttcggtttgaccatccgactgaggatgataagcagtactcatatccaagctagtgcaaagtaacttccacaaagatcgccaaaaatgactcacgaatcgagtatctcggtcacacacaatagaagtaggcaaaccatgtaaacgataaatttctcgaaagaagagtaaggctaccgtaacagcatctgtcgttttcttacaaggaataaaatgagccattttggagaagcgatccaccaccacaaagatagagtcgttcccgcgttgagtacgagggagtcccaaaacgaagtccatactaacatcggtccatggctgcgtgggaatagggagaggaagatagaggcccgcattggagggtttttcctttggcaagttggcagatccgggaacgttccacaaaacgttcgacgtcacggcgcagtgaaggccaaaaataagatgttgtgacgagctgcaatgtcctgtcacgccctacgtggccttcattatgtaattcacaaataatctgaagtcggaggctgcaatctggaacacaaagccgcaaacctttgaagaggaatccgttttatagtgtatattcatcgtttaactcattctcgacgtcgcttaatatccgagagaagaaggtgtctgtagagtataagtccgagaagaaccaagattggcgctgtcgttaacttgtgcttgataagtgtaaacgcttcatccgcttctttcgtccatgtgaccttgccatccttaatgcaactcgtgattggtgctacaatgctgctgaagtgatgaacaaaccggcaatagaaagaggctaattcgtggaagctgcgtacctcggttactgtttgtgaaccggccaagagcgaactgcttcaatatttgtttcatcgactgataatcccttatccgatatgacatagcccaaaaaaagaacctgtgagacaccaaactcgtatttatggcgagctgcaaacaacttctccttccgtaaattgctagaacagcttggatgtggttctcgtgttcctcatgtgacgagctgaagatgagaatatcatcaaaatacacaaccacgaatttcccgatgaaagtacttgattcatgacgcgcatgaacgtacttggggcgttggtgaggccaaagggcatgacaagccattcaaaaagtccttctcgtgttttgaaggcggttttccactcatctcccggtcgaatccgaatttgatggttcccgctttttagatcaatctttgaaaagagagatgccttgccgatttggtccaataggtcatcaagtcgtggtatggggaagcgatagcgcaccgtaattttgttgatagctcgactatctacacacatacgccacgttccgtctttctttggaatgagaagggcaggtacaacgcaaggactgaggctttctttaatatgaccttttgctagaagttcttcaacttgtcggcgcaactcgtcatgttcttgcggactcatgcaatagtgtggtcggtttggtagcgttgcaccgggcacaagatctatgtgatgttgaatatcttgagtggtggtagctcctggtaactcttgcggaaacacgtctgcaaattcttgaattacgttatcgaatatggtgtgagctacggtggatgtagtcgctgtaattgatggtaacactgctaatgcaaatccttcactttgcagctctttctcaaacacaaaaatgaacacaacatgggagtgtgtacatggcctgtcgaagttacatggggcatgagagttggcttgcgtgccggtggaggtgacggattgggagaaagcggtgtgtctggagatggaagcagcacaatcttatgagtttcccagataaattcatatgtattcgcagccccatcatgcataatctttcgatcatactcccaaggtcgtcccaagatgaggtgagtgacattcataggtgtaacatcgaaataagtgcggtccttgtagaattgccctatggagaaagaaactaggactcgacgtgaaacgcggaacgaaacgccatcctgcaaccaagtcattgcatatggtgttggatgttcttcaaatggtaagcccagctttcgcacagcttcctcggcaattacattacggcaacttcccgaatcaataacaaaagtgcagactcggcctttgattgtgcaagtagaacgaaaaatgttagtgcgaagccaatgtttttcacgatgctgtggagtgagaccgaaaaatcgtgctaccaacatatgaccttcatcacccttggtgttatgcgtttcaataaacgcttcctctgtttggtttggacacgctgtttggtttggacacgctgtttgtctgtgaccaagttccccacaagcatagcaacgtaaggcattcgggcgggtcgatcgtcgtatttggggctgtggatcttcttcttttgcagtgacacgagtggtgttaaggctactttgttctgtatctttacgatgaccaaaaccagctgaatttgatttagtctcagatggtcgtgaacgtggaaagatagagtttgtttgagagcaaaactgttgctcaaaagaagatgcgcgtctgtgagcctccgccacagtggaaggatcgaatagtgataacgcgttttggagttgagttcgcagtactcctatgaagtgtgagaccaattgtacctcactgtcatagatgtcattacttgtaacaagaagataaaattcttctgcgtaatcgtctacagttctagacccttgtctcagattttgcaggcgattatacatcgtgcgatcgtaattgtgaggaagaaaagtgtctctgagtttcttcttcaatttttcccaagagcgaataggtgctttactcgtacgtgccctaaacgtcttgaattgctgccaccaagaagctgcatgtccacggaatcgtgtagccaccaacgatactcgtctctcagcaggtacacacttgaaatccaatgtttcctctacagccacaagccaatcaagtagtgcatctccccggatacagccttgaaattctggaatgtcgactttgaaccttgtttcccaacgtgtgtcttgaaacatctgttcctggtgtctagccggcagaaaatcgtgttggtttggattggctaacactaattgattaggcagctggtcacgaggttggttgtgctctgcgacgatctgaacagcgtcttgttgtcgtggagccacggcgactgctgctggaggcgggttagctgcatcaagatgtctgattaacgcttgactaagctcacgaattgaagcctgcaacgcagtctgagaggcgagaagagtatcgcgaaactcgatccaattgatggttgggtccggaaacttgtcgccaacgttttcgttctttggaggcattgttgattcaaatttcaagccaagaaaaactagaatctgataccaactgatagagaggcggaagcaaagtaacaagcaggggtttgagatctccaggaaacaacaaactcgagcttggatcttacttatctcgatgataatgatcgagaaagcaacaaagggatgaggatcctctcctcagggttaagaagctctttaatgtaaactgaattttattatctaaagcgtgattacaacgatgatgaatgaaggctacttttagggaataaagagataacaacgaatactctaaagctaatcatatcgaagatttagtattatcctaataacctaagaaaaaggagaaaacgtaattgaacattctaaaggattctcatatacgtgaagcccatgatacgtagacgagaagcccatgaactcttaagatgcgctgcatcatatactcattcatacacatgacatctagtcatatttgactccaacaatctaacaaagcttctttttgcttctcatagctttgaaggtgtagccgaagtccgtatgagtcttgggctttctatcttctaacaaggaaacactactttggctttcggttgcggttctaagtcttatacttaatcatacacatgacatcaagtcatttttgactccaaaccacaaaccaagcttcttcttgcttctaaaagctttaatggtgtagtcaaagaccgtacgagtctttgactttgtatcttgtaacaagcaaacactactaaggcttttaaggtccagttgcaatctagtcatatttgattataaaacactaaccaagcttcttcttgcttctcgaagctttgatggtgtagctgaagtcagtatgagtctttgaattggtatcttctaacaagtcaacactacttaggcttttaagatccagttgcggttctagttcttattctaaatcataaacatgatatctagtcatattttactccaaaacactaaaaaggcttcttcttggttcttgaagctttgctcgtgttgccatagttcttatttgtcgttcgatttgtatcttctaacatggaaacattacataggtatttaagatccggtttcggttctagttcttatacgcaattatacacatactatctagtcatatttgactccaatacactaacaagtttcttcttgcttctccaagctttgatggcgtagccgaaatctgtatgaatatttggctttgtatcttctaacaaggaaacactaggcttttaagatcatgttgcgattctaagtcttatactcaatcatacacaagacatcttgtcatatttgactagaaaactaaccaagcttcttcctgcttctcaaaactttgatggtgtagccgaagtccgtatgaggctttggctttgcatcttctaacaaggaaacactacttatgcttttacgattcagttgcggttctagttcttatactcaatcatacacatgacatctagtcatatttgactcgaaaacactaaccaagcttcttcgtgcttctcaaagctttgatggtgtagcagaagtccgtatgagtcattggctttgcatcttctaacaagaaaaaactattaggcttttacgattcggttgcgcttctagttcttatactcaatcatacacatgacatttagtcatatttgactccaaaacactaaccaagcttcttcttggttctcaacgctttgatggtgtagttgaagtccatatgagtctttggctttctatcttctaagaaggaaacattagttcggcttttaagatccggttgcgattctagttcttatactcaatcatacacatgacatctagtcatattcgattccaacaatataacaaagcatcttcttgcttctcaaagctttgatggtgtagcaaaaatctgtatgagtctttgaatttgtatctgctaacaaggatacactacttaggcttataagatccggtttcggttatagttcttatactcaattatacacatgccatcatgtcatatttgactccaaaacacaatcaagtttcttcttgcttctccaagctttgatggtgtatccaaaattcgtatgaatctttggctttgtatcttctaacaaggaaacactaggcttttaagatccggttgcggttctaagtcttatattcaatcatccacatgacattttgtcatatttgactcgaaaacatttaccaagtttcttcctgcttctcaaagctttgatggtgtagcaggactccgtatgagtctttggctttgcatcttctaacaaggaaacactacttaggcttttacaattcgacctgactttgatcctaggattagaggatccttaggttctgcttccatatcaagcacaacgaaatacgtaggcacttccactccattaatcattactggtagatcttttagcaggccgaaaggttttcttgaaaacctatcagcaaagatcaaagtaaggtcgcaaggcctgtactgagtgaattccagcttccttgccacaaaaagtggcattaagcttactgaagctcctaagtcacacaaacaactgctgaaagccaattgcccaatggaacatggtagagtgaaagatcacgatcttccagcttttcttgaataatcctcttgacagtagctctagaaggattagcatcacattcgtcatatgaatcctttccagaattgaatttctcacatctttgtgcgggtccgggattaggttgagaacttctatcagaggcatcaccgcttccatcttatcaagctgcttctctacaagagacttgtatctttctatccacgctttcctgaatttccatgggagagcacgtgaaggtaacggtgctggcttgaatcgtttaaccatcctctcaatgatggctgctttctcgtccaaggtggacttagtttgaaagcgagatccagccgaatggtcgagtccaacaactgaaatttcaatctgagtagaaacctccccgtcctgaacatcactgtcctgagtgattgagttggagacatgttgagtaggcagctctcgatcatggcagatattgatagcgtgagcggtggcgtattctttcgggttctgtatgaacttccctggaaatcctttaactttgggagaagaggtcgacgcagtttgtccttccaggtatctgaccttagaggtaagtgcctcaagtttgatgttaagatcgttgaaagtgcaatccaccttgttgtggatttctgccatctttttggcgagatccattactcctgctccttgtccctggagaatctgctgtagcatgttcttcaaatctgaatctggagttgttgaaatcggttcttgttgctgctgtccaaacccatgttgtggaagttgctgctgatagttgccctgatactactgctttggaacatacccctgaccttggttgtatggaacaaaggggttgggttgattatgctgctgtgaagggtagacttggtcatgtgggtttgcaacattgttacttctgtaagacagattgggatggttctgcttgaagttgttgaaaccttttttgtaacctccttggttttgcacataactgagttcttctgactatagagtctccccatcctgaacttggaacgtctcatcatcccccagaaaatgaacgtgtttctgttgcactaggagtaacttgtccagcttgtcattcatagctttcatatccctgtagtgtttctcatcagaatcagagttggtgcagatgcttctatcgtaatcttcattgtagttaccatccgactgtgccaaattctctaccagctcccatccttcttcaacgtccttgttgagaaagttcccattggaagcagtatcaagaagcatcctgatcttgggaaggacacctctgtagagagtgctgagaagtgaagcttttttgaacccgtgatgagggcatttggtctgatagcctttgaagcgctcccatgcttcaaagaaggtttcagcattctgctgtgtgaatccggatatctaattctggagtgtggcagttctgaagttggagaaaaatttagccaggaaggctttcttgcagtcgtcccaggttgtgactgatccctggggtagcgtcttctcccacagatgggctttgtcttcaagtgaaaacgggaacaggcgaagcttgaaaccatcttcactaactccattaatttttgttaggctgtagagcctttcaaactcgtccaggtgatcgagtgggtcttccattggcaggtcgtgaaatttgttcccctgaaccatagcaataagactgctcttgatctcaaaattgttgttttgaaccggcggagggacaatgccattacgcaggttatggttgtgtgggaagtcgccaacgccaatgttgttgggcagttcttgctcatctacaacgtgagccatcgtattagtatgtgtctgttctcttagagagcgagcgatgcggtcgatgttgtcgttgaagaggaggttctaatgtccttgggaccgtgtttgcatacaactgatatcagcacagcttaaacagaccaatcagagactggtccagggaagttggtgaatatgagtacctaaaacacacaaacacatgaaaaagacacagagtcagtaaccttgtaacaaacgaacttgatcttaacgtttccaaaaatctcaaatttagcaaagaaacacctaattggcaacggcgccaaattgataataggtttttcagatcaattaattttaaagcactatcatgtcgttgtagtactgaaggtgtcaatccaaatgggtgtgatgcagacaaatgagatatgatcagaagttgctaagtcaagccaggcagaatttggttggttttctaacagtcctaatgttaatgcagaaaacagtaaaaagtcatagaaatgactgatatactcgatcgcagggtcgactgccagaagggaccctgtgatcgagtacaacaggatgacagagagtaaaaatgtagaaatggaccagtttactctatcacacagtctcactgttagtagactggtgtgatcgactagaatggttgaaaacagaaaaatactaaaattcaatagcaagtgaatgaagcaggtaagtaaacagagaaatcaaatggatgagaaattcctaaggatggggaaatcgaatagtgtggtctccctgatcaattcagttggttatcaaatctcaattaagctatccctagacaacaagttcaacaacagattaattcattcccgtgatagaaatcctcaagcatagctagacactgacctaattcccattagcgatctctaacttagcaggcaataagactgactgttaaagccaataaccgctctaaacggccaagcccttgggatagagacgattatcactggaattagtagatccaacgttccattaaatgccttttgagcgttgggggatcggattccagttgatcagaaaggaataagcagtaaatctacacttaaccaacggattcgaacaggggttctacaactactctatcccatcctcaaaaatcctaatcactactctgacaacatgcgttaagacaataacatagaaacgattgaagattccatacttaagatattaaagggaatgaaacaaagatgaacaagcaaatgaaagcaaaatctaaataacttagaagaaaaatcgaaatacaaagttgcacgaatgaaaagcggcttttgaataatagtgcaaaattcgtgtctcaaaagtgcatgtctcacggcgaaacccttaaacacttatttatactaagataagaaagcgggcttccagcccatttaacgacccttggacgacgtgatcaagagtgtcggctcaaagtgggcttcctgatgggcttcgaacgggctttgaatgtgccttctcttctctttccgttgctcaggttgtctggttgagtgcagattgatcagagggtcgaggtggtggtcgagtaggtttgttgacagaatggtctggctgcttcttggcctctgtgaccgagtatgtgtgtcagctgtcaggatggactagttcttctcctctacgatcgagtagaactggtggactggcaaagtaggactgcttggtcgcctctgcgatcgagtagaactgtaaaatggactgcctcctctcctctgcgatcgagtataagtgtctggatggactactgagctgactgcttccatctctgctactggtgatcgagtatgttggtggaaatgtgactttctgttctgtttttcctctttctgagcacaaatagctccaaagcacctgaaacaactccagaatgcagaatgtatgcaagactagtcctatactcgactaaagacgcacaatgtacaaaaatgatgatgaatgctatgaaagatgggtgaaactatactcaaaatggtgataaaaggatgtgtaaaacatgcaaattatagacatatcacagagataatatcccatctaccctgagtataaccaatgaagctctaatggtaatcccatctccaatcccaatataagaacttaactctaccctttgcattcatgaatcttttaatccctttttctaatcattcttttcttttctattaactctaggagaagctttctcaacactttgatacatctagcggatttggatttctttaacaactaaggttcctgtttaaaaattttaaaaccgagggcttttgtctttcttcattagctaacaagaactctttcttttctttacaaatcccaaaacctttactagaatttttctgcttctttagcttacttcacctagagtcttttaccttttcttatcaatgaatccaccttttttttcttttagacacattccaacccaaagtataagcgcccacctagtcctatctagtccggataacgcgaactagaactacatgagacactatctctgtcattacgaacctaacactttctaccaagcttaatcggaataagacctcacaaacactcacaagtgatatagggcttgaaagaaagtttaggtttgagttcgggtttaactgctctaataaggagagtcagctacttggattaacaagagtggttaaaatgagtaaaaaaatccaagtattttagggtatccataagttcaaattgatagggaatggtatcagatcatgacagtgtggtagaatagagcaatctaggcatggtgcagttttacttaaatttcattgactatgcaacagacaactagcaacgagggcactgagtttatccggtgaacaaaaatgcttacaaggctatctcatcattatcccctatgcatatgcagcaatcctaaatgaaacactctagactcgatcctaaattaaatgcaactatatgaacactctgtttttgtgaaatcattttctcacatttttcaaaaacaatttatttttttatgccttagatgaatgcagactcaagagtatatacaatgcaacacacacttcttcctgagccctcccccaaacttaaatcacatgtgctgcacatcctctagtaatccaagttgggccagagtaatcaagcaaggatatcatgtactgcaaaactcgttcgcctgatatactcctcaaatgtcaataggttagtctcaaagaaaacaatgaaaccaaaattgttatcaacagacaatgaaatggactatattggtcgagtacaatctagtactcgagtatactgaacttttcccgagttcttctttaacgatttgaatcgagtggaacagaaatcggaggtcgagtatatctgttgaggtcgagttcagccagtgaagtcaagtggtcgagtaaactatcagtcgacggtcaggaatttgcagggacggaaccatgaatcgacggtcgagtagatggtgcacttggttacggttgtgaggtggtcgagtcatgtggttgtaatcgagtagttcttaaggctttaacggtgaacgagatggggaactcgactgcggtggcgcagaggtggtcgagtacggcgagttgtgctcaagtgtctttgctcttcgcggtcgagtgttgtggcgagaacaaagtgacggtgacagcttcttcttggccttcgagtgtagggtcgtgtgaaaggtagagtgaagtggtcgagtatggcgacgaaatcgagtgaaatggtgtcaaaacgagtaattctttggacgagtgagagatggcgatttgtggtgaaggagagaaattggagtgtcggtggagagatgaagagagatgggtcgagtagactttacttttggatagagtgagggcgaattcagaaggtgtgttggagatctattctatgattctctctacatcttatcttcaggaagaaaacgcgtgtggtccatgccctgttgttttgtctttaagcttagttccctgttgactgggaaaacctgaaatcctctgtaagtctctgttagtcgagtatatggttgaatataaaggatctgaatcatcaaattcactcgactaaagatcctcatcagcacgtgaccaatgagatcgagtgacaaatgaaaccttgtttatactcgatttcacagagaaactcgatctccacagcatgtggtcgagtgaaacactgagattggatccattgcacttaaatattggcagctatctctgaaaacactagtaaaacactagtaaaggcatgggacttcctcccaagtaagcttgttttaagtcattagcttgactcccttattcttttgatcatcaagaagttcctggagatgaaccgacgtcacctctggaaggatttgatctgctaagtatttcttgagtctttgaccatttactgtgaaatctctactcgtaccagctagagtgaccgctccataaggacgaacttcagtgatacagaagggaccggactatctagacttaagctttcctggaaagagtttcaagcgagagataaaaaaaacaccttatcaccaacctggaaatccgaagtgatgatcttcttgtcatggaaaagcttagttctctccttgtagattttagagctctcataagcttctaaagagatctcatcaaggtcactgagttggatcaaccgcttctcctcagcggtttttatgtcaatgttgaggagttttaccgcccacatagctttgtactcgagttcaacaggtaggtgacatgattttccatagagaagattgaaaggagttgtactaatgggggtcttgaaagctgtccaataagccgacagtgcgttatcgagctttgcagactagtctttccttgtaatcacaacagtcttttccaaaattgcttttatctccctattggaaatctcaacttgcccgcgtgtctgtggatgataaggagtggcgaccttgtgctttactccatgcttcttcagaaggttttcaaaaaccttgttgatgaaatgctttccaccatcacttatcactaccctgggaactccaaatctcgggaagattatggtcttgaacagctttagcgcaacttttgcattgttggtaggactggcaatagcttcgacccactttgatatataatctacaacgaccagtatatacttgttaccgtatgaagatgggaatgaacccataaaattgattccccatacatgaaagatctcaactttcaagattgggttctgaggcatctcatttcttctactgatgttgccctttctctgacatgaatcacattttaaaacaaactcctgagcgtccttaaacattgttagccaccaaaaacctgcttgcagaatctttaacactgtcttgaatgtcgcgaagtgaccaccatatgcggagccatggtaatgcagcaggataccttctacttcatcttccgagacacatctcctatagatcttatctttacagagagtgtaaagataaggctcatcccagtattaatggtgtatgtccctgaaaaacttcttcctttcataactggtgaagttgggaggctctactctgcatgccaaataattgacgtcatcagcataccatggagatcttccctcaacagcgttcagttggtggaactctttcccgctgtagctcccaccgaaaaattctacaaccattagttgctcttctggcattgagtcgtctatctgaataggttcttcaattctcatccttgacagatggtcagctgcaccattttcaatgctttcttgtcttctgtttccatgtcaaacttctacaacagaagtatccatctcaatagtcttggtttagtatccttcttagaatacatatgcctccactacaagaaaacaggcgtttaccgactacaacactagtcgtttcatagtcgtaaacagaaataatacgactaatagacgactaatcagagtagtcgtatatatatagtcgctaagcaacatagtcgtatgttagtcgtaaagttacgactaacttacgactacgtaacaatcggcatgaaatagtcgtcgattggtcgtaacatttggcgactacgatacgattaattaacctgtttatgggggattattcgtgtagtcgtaaactagtcgtacttccattgacgactactttgcgactagtttacgatcaattgtattaaactctgggcactattctggttgtcgtatcttagtcgctaaataatatacgactaatgtacgacgcctttacgactacctaacgactctcttatattgtcagacgatagtcgttaatattggtgactattttacgactatgatacgactatacgacgactattggacgacaatttgacgacgacattttgtgtccaaataagaatttggtcatatcttgatttctttgttggttggtcatcgattctgagaattcggtttgtttgttgttctaaatgctataaagtataacaaaaacacatttttattgaaaatcctatcaaatacataaaacacaacttacacttaaggttcaaagtactaaacacacacacaaacattattgttcaaagttcaagtgaaaagggactgaaatctaaacctattgatcattatgtggagtagctggtagaggctctgtggttgtcgaagattgagaggccatgaagtcaaggaattgcggatctgtttgtcggagatacttctccactaacgacaagtcaaggaattccaaagattcgggcagtctaagcttcacgcgcaacaatctcagaatcacgcttctcattgtaggctgcctgctcctcaatcttgcgttgcgatttcttcagccattcttctaaatctaggaaggaagatgatgattgtccagggagattgcagttggcacagcctaatgtgtctttgagactgccaagtccataaggattgcctctggaatccctttcggtggactgaaaagaaataaagaagagattagtgaatgaataaccaaaaactcaaagtcaagaggtttagattgcaacattttacctggagaaagatggttgtcaactcctcatttgtcagcagaagcttccgcctctagctgtgacaatctatctctcacattctgctcataagtttgagcaatcatctccgccttccgatcaacatacgtaccatccgacttagtatgagtctctacaaacacctcaccaagagtgactgttcttcccaatttctcctcctgcactgaaaccaacacagctcaaatactcaaaaacttacatgtgaggtaactgaaagaggtaacagaaaaacttactaattcgtcttggatttcctgaaaagactttggcccagagaagtggatgtgaggaccgagaccgttacggtcagagagacaagctttggaataggtccgactccgtttttgtgctggttcggtgtcccagtaagcgcacataacagctgcaccctagttctccttgcggtgctaaccatgtctttcaagcgccgtttacaaacctcattgaagtaatactgcacagtctctgttattaagggatcccaactgtgagttttctacaaaaaattgtagcttgagttagtgaaatttaaaagattaagctggaaagttaagaaagtaagagaaatgcatgacagcttaccgcaaactcaagaaataacctctctcttttattcactggtacacatgaccagttatagtagggagcatttgtgtaaaaatccgagtgatctttctaaccaactttgatcccctgtcgcgagtaaacctccaaacacatgaaacaatgaaagataaaaacatgttacattagtgaaactactcaacataaagaatagcaagtcaccacaacagaacacaagagagcaagccaccacaacagaacacaagtatgctagacatgaccactatgttcacagaagatatagcaagcgaccacaacagaacacaagtaagcaagccaccacaacagaacaaaccgccacaacagaacacaagagagtaagccaccacaacagaacacaagatagcaagccaccacaacagaacacaagatagcaagccaccacaacagaacaaaccgccacaacagaacacaagagagtaagccaccacaacagaacacaagctcatcaagacatgaccacaatgttcacacaagatagcaagcgaccacaatctaacacaagctcatcaagacagtagtattacagaagctaatcaagacacaatccaatgaaacaatctaatacaagcagatcaagacacaatatatgttcacaacaaattaacaaagcggacacaagagcaatccaccacaatctaacacaggatagcaagccaccacaacagaacacaagagagtaagccaccacaacagaacacaagctcatcaagacatgagctttatgttcacacaatagcaatcgatcaaaatctaacacaagctcatcaagacaacaagctaatcaagacacaatccaccacaatctaacacaagcagatcaagacaacaagctaatcaagacacaacctaacacaagctaattattgctgcaacctaagacaagcaactcaagacaacaagctagaggatctcaacctaacacaagctaatcattgttgcaacctaacacaagcttatacagaatctaaaacaagctaataagttgaggaagagcacataccattcagtcttcggcttgggaataggagacagtacggtggtccacatttccctcccgggaaccataagtatgtcggagagagccctcgccgagtcttcttgtagctccgacaatgattgaggagctccctcttgaaagttgttgccctgagaagatggatggctgtgtccctgagagttgggatttggagactccggaggctcttggtttagaggatcttctggcggtggattaaactgcgcctcttcagatcgcagcggcggcggatcaacacgctgagtggtggagctctggaatagttgatgcggcggcggatagttgcggtagtggggagctaacgttgaggctccagcggcttgaggcgtatgcgtcagaggagcttgaggcggatgcgtcagaggagcttgaggcaccgccgccggagtgaagtcgtgttgcttaggcagcgacgctggtcttccaaccggtgtggaccctccggctctctgtgtaacgttgggggtcgtcttcctctttcgtgaacctccacgaccggcgataggcatggttgaaagaagaagaagaggatttgaagaagaaagagaagatgattcgacgaagaaagagaagatgattcaaagaagaagaagatctaatgaagagaagaggcgaagaagaagttgcagaagaagatcgaagaagaagaacttgaagaagaagatcgaattagatcgaagaagttcaaagaagaagaagttgaagaagatagatcgaagaggttaacctttggatgaaatgagaagggaatcgatcgaattagggttttctttatacacgtagtcgcaatgtagtcgtattttagtcactaattttcttgggtttgggccgcgaaataagaaagcccaacaataaagacaattgtcgccgaatagtcgttgaatagtcgttactttttattgggtttgggcttcgaaattactaagcccaacaaatttatggtgtctcgcatgttagtcgtaatatcgtcgttagctttattgggtttgggcttcggaattactaagcccaacaagtaaaaagcctgtcgcaagttagtcgtattatagtcgcacattattttggttttaggctcgaaattaaatagcccaatatcattagacgtctgtcgtcggttagtcgtacttcagtcgttaattttattgggcttgggcttgggatgtcgacagcccaacaaattaattatatttagaagtattcatgataattataaaatttctataatatttattcaaataattaaacatgatatgattcttaaacaaaaaatttcaagtaaataaaaaagttaatatacatataagcacacatttagaactcttcatcatcttcgatttcatcatcgtctgaagacgataaattacatcaaaattcatcctctggttcagcatctccgacatcgtaatcgagtatgattgggtttaagctttctaccggattgtgtagtaccagatcttcaattgtagtcagcaacacagcttcatcattttctgtttgcaaaagagtcggatcattgttttcatattctccagaaatgtttccccgaggattaacttttaaaacatttagccaaatgctttttggtttctttgtatatggatacggaatataacaaacttgatctgcgtgcgatgctgaatacacaaattatacattaataaatatacaaaattatttaataatttatagagaaccttatgtattcttaattacatacctagaataaatggctcgtatttattgtatttcctagatgatagaacgtctacaacaccaccatggcttcgccgagtgcctctaccaacctttgggtcataccacttacacttaaaaagtgtgattttcaaattgacgatcccctcatactcgagttctatgatatcagttaaggtaccgtagaaatccgcttcatcagatgaatccgcgtaattttctcctttaacacataccccatagttacatgtttttcgtccagctccatgatttttcgtatgaaacaaatatcctcgtgtgaaatacattggccaagttttaaccttgttcaaaggcccatgcacaatctcttgaacccaaataggaaatagagaagtagggttccaaaatgttacctacataataaataaacaatatcaatatcaacataatttaaatgatcacttttaaaaattactaaaatgatgtagacttacatattctttaactcattgataatattcttcagctcttttcgcgtaatgttctttttcggacaaagttggatatttcaaagaaagaaaatcctcgaacatactatatttacaaccgaagataaataaatcaaagttatcataatgaaaattttaaattaagaagtgatttaaaatacctctcaagtggttgaaaatagtcacaatttcttaaaacatatgcatgtgcgctctggtagtctttctctgtaagccattctacgtgcatttcaccacttggacggtcgacgtgcataaatatgttaggtactccagggacatgatatacaggaacttctccttcatcgaatcttgttaatctgattcatgtaattgatttcaattctgaagtatagattgcgaatcgtaaaataaatagttatatttaccttgattttgtttgtatatgatcggcaaagtagtgagtcaccaaacagctgct

SEQ ID NO: 185 - DNA, 64415 bp, Arabidopsis thaliana
  modified_base (9960)..(21146): N = A, C G, or T/U
gaattcactcagtataggccttgcgacctgactttgatccttgctgataggtcttcaaaaaaaccctttggcctgctacaagatctaccagtaatgattaatggagtggaagtacctacagatttcgttgtgcttgagatggaagcagaacctaaggatcctctaatcctagggagaccttttcttagcctccgtgggagcgatgatagatgtcaaagactggagaataagtcttaaccttgggaagcacatgaagctgcagtttgacatcaatgaaacttcgcaaaggacagctgtagaagaaaagatcagggctcaacctcaaccttcggattcaatcaacagaccaagcacagcctctacacctgacttgcgagatctcaaaaagaaatctgatgagcaagaagaaaccatagagaagctagctcagacagttgaggaacttaagagtaaactggatcatgtgcaagagaaagctcaatcaaaatgcaggattgacactatcccgagaaaaaagattacttcaagatggtctgaggagatagattatcaaccagaagagaaagaggcctatttcgaggaaagaagaattcagtattcggctactcatctctcaagagaggatgctgaatatgatgatgagatcagagaggactatgcagatcttctctatcacccattttcttcttaatgagtgtgaggagtcaagctagagactttaaacaagctcacttgggaggaattcccaagactgtttctgtaaataaaacttttattttcttgttatttttgacttgtttttggttgtgtttgtgattctcaggaacagagaaacagcgtggaggtagagtaaaaatttaaaaatttttactctacagagcaacaggggatcgagtatgtcagaaattcaagagtttgaaaaacttctgttgcactaagaggccatgaggtcgagtaagttggtcgagtattagtgatgattttaaaaaacaaaattttgaaattatacttatactcgaccaacagaagctacagagacttgcatggagtttaacaagtttacagaggatgacagaagattctagtcaacagagaacagtgcttcaggacaaacagacagagcgtggcccaccacctctcacctttgttcccccacgcgtttttagagataacaaaatctcttccctccttccccaccactcgatctcaccctatcctttcccaccgacatcatctctcttcctctccaaacgctcaacctcgaagactcactctcactcacgtctctcactcgaccaaacttcactcaccatctctcttcctcaccaaacactcgaccactccattacactcgaccacaccgctcactcgatcccacacctccggcttctccatctctcacggcttcgtctcccttcccactcgaccacgacacagccgctgccgcttgcgccaccgccttcattctttctttcactcgaccggtttcgccatctctcatcactcttgaccttgtcgttcactcgacaactccgcctttcacttcgctggaagcttcaccgtctcaacgtcttctccatcttcactcgattgcaacgacgctcctctccaatcaacgcatactcgatcgccggactttcgccatctccctgtcacctgtgttcactcgacctcaccgttccagcttcaccatttctcaccgctcgtgtctcctcttcactcaaccgctacacgaccaattctcccttctcgccattcgtcgttcatccgccagagcttctctctcattctcacgaacactcgaccgctcatctctccaccggagttcgaagactctcaatcatctatgcttactcgacctcaagccgattcactcgggtgaagcttagctcgaccgctcttcaacccgccactatttctcggagaagtttacctgacctcgccgcacgcaccgcaaacactcgaccacagtccttctaggaacaaaagaccgaagccacaatttcactgtactcgaccgtattactcgactgcgtacttgaccggtttagtgtttgcgttttatttagactaacatattgatatttggctttgagttacattctttttcaggaaattaatatgagtaactacagtggcgaatcctccatggatgcggattacaacgtcgatgaagctgaatcttggtcaactggaccagagagagagcgacaggcttatgagagcttcagagctgagacccaacgcttagtagctcgacgcaatgagaagagagctgagagtgctagaggaaagagagcaatgaccagcagatatgagatgatcgacgaagatattgacgtcgagtatgagcctgagtcatggcacagagagacgaagctgttgaacaggcctgatgaagttacagtggaggagtacatcagactttttgagctcaatgacttctggggaacgaggtacccctgttatcagactttggcccagctggggctactggaggacgtacaacacttattcgagaagtgtcatctggagacgctgatgtcttacccatacgttgcttacaagaaggaaacaatagagtttctctctactctgcaagtggagatgtatcaaggacttacagcagatgagctggagagtgaagggttggggttcttgactttttcagtgaacgagcagcgttaccagctatctatcaagagcttgaaaggattgtttggtttccccaatggaaagggaactaaacccaagttcgagagggaagagttgaaaaatttgtggttaaccattgggaacgatatagcgctcaactctgcgaggtctaagagcaaccagattcgaagccctgtagcgaatgttctgtactctagggaatctacaggcatcgtgtctaacacagacatggagatgattgattctgcactcaagggcattctccgcagaacaaaggggaagaaggtcctgaagggcgacctcaatgatgcaccagcggttatgcttctgttgatccacctgtgtggatacaggaagtgggcgcacaccaacgagaagaagagggtgcgaggagccctttgtgtaggtggtgttgtgacaccgattctgattgcatgtggtgtaccgctcatgtctccagggtttgatccgaggatgatggatttagatcatttgcgtcgttgtgagtttctggagcacgacatggttggcgatttctatcgctacaaattcgagcactccttgacccgaacagccaacattctgcttccctgcaccgaggccataaccatacttcagggcgaaaacattgacttcaatcctgcgcgtgattacctctactttgagagcgctccaccgactgatgacaacggccctacaaaagaagctacagaggatgagattgctgagacagatgaggatagaaaggaggagtacgatacgagcatgtatcatttcagtgagaatgtacctccagcgcgggagagcaagagcttgagcgaagctcacagaaacaacagtaagttgcagaggtggtgcaagaaacaagataggctactcatcaagtgcttcaaggccatcaagtttctgacagacaagctaagctgctcctcttctaccacagctattccgcagggagagcctcctcaggacatgccctcgaagagatatgacgcgccagagccaactcgccactggcctgagctaagtcaccacaggcctgagcctagtgaccgagtagtcccaccagtccctgtgtggcattcatcattcaagcctcgggagctcgggagaaagaagaaggctgcactcgctcggtctggcagtaggagtacacgacttctccagtcccgtagcttacgcaaccacggtgatggccgcagcataagaacagaggtcgagtatcatcagagcgctgctggccgcgacgaaggagcagaggtcgagtacccccagggggaagctaagacacaacagggagattcttcgatggcctgggagcaatcacaagcagctattgacgaccaactccgctccttcttccactgaggtaagcacctatctccaccattgtaatataccatctcctgtttttattttgtttttgtgatgtgttttgtcctgagtactctcttccaaatttggtcacacagtggactgtgtgatttaagtttgggggagggctcaggaagtgtgtgttgcattgtatataatcttgagtctgcattcatctgaagcatagaaaaacccaaaaaaattgaaaaatttcagaacatgatttcacaaaaatagagtgttcatgtagttgcattgcatttaggatcgagtctagagtgtttcgtttaggattgttgcatatgcataggggataatgatgagatagtcttgtaagcattttggttcaccagataagctcagtgccctcgttgttagttgtttgatacgtagtcaataaaattgaagtaaaactgcaccatgcctacattgctctactcgaccacacggttaggatctgataccattccctatcaatttgaacttgaatctgatttagaattatcatgtcctggcattgaatttgaactcatggataccctaaaatacttggattttcttactcattttaaccactcttgttaatccaagtagctaactctccttattagagcagttaacccgaacccaaacctaaactttctttcaagccctatatcacttgtgagtgtttgtgaggtcttatttccattgagcttggtagaaagtgttaggttcgtaacgacagagatagtgtctcatgtagttctagtttgcgtttttcggactggataggactagctgggcgcttatatcatgggttgggatgtgtttaaaagaaaaaggtgaattcattgttgataaggaaagggaaagaattctaggggaattaagctaaagaagttagaaaaaacaaatctagtaaagggttttggaatgttaaagaaaagaatgaggttcttgttaaagactaactcttagaaaacaaaatatatacaataagatattactataaatacatatatattaatttttatataatttattatcaaacatatatacaaggacatttatttctacaaaaagatagtattcataagtacaaatagatttaattgatcacactaatgttcaaatatttttatgtaagaaagtcatcctaatatagtttcttttgattataatctgaggagataaactaaaagattttcttgctttttcgtttttgacttcaaaatatatatataatacaaccatttgtaacaaagcataaacatcaaaaacaaaattaagtcaaaatcatagaaatgactattagcaagaaaatgttaatcgttgtatcagagtgttgagaaagcttctcctagagttaagagaaaagaaaagaatgatatgaaaaagagtttgaaagattcatgagtgcaaagggtagagttaagttcttgtattgggactggagttgggattaccattagagcttcattgttatactctgggtagatgggatcttatctctgtatgcataacttgggacttacctttaactactaaagctcaatcattcttgtgagatcccctgttacttaagcttattctgtgagggaccatctttgtctcttgaccttcaccttagccaaatgagttcattgatgatgcattgcttgattcacgttccagaactaatgaatgttaaagggattggtagatttgaaagcatgtgtaggtcgagtataagagacggattgattgataacaaggcatggctaacgtttttgagtaaaattcaatcatatcgcatcttagaactaccaacttggacattgattttatttgctctacttgattctttggctgagtccccaccttcaaacctctccttcaactatgtattcttatttgcttgagggcaagcaaagactaagtttgggagaattgatatgtctatagtgtgcatgttttcagtgtccattcatcatcgttttgaatctagtttcgtatcattcatcactattttatatcatttctcattgttattgcatactttgcatgattaggatagttttgcatacatattgcatttctgagttgttttcaggtaatttgtagctgtttgcgagcaatttcgaagaaacgagcctgaaccagaagacatactcgaccaccaggtcgcgtgcatccagcaccatacttgaccccctggtctagtgactttggagccattcttcccatctactcgacccccaggtcgagtaacctcatctcaggccactcgatgacgccactcggcccccctggtcgagtatcacttcgccacaccacctgaccacactcggtcgttcactctaccaccttactcgaccccctggtcgagtatcgtcactcaccaccaacaccatcactcgacaagacactcgatcacatcttcatagtctactcaaatctctattcgattaccccatccttaggaatctctcgtcaatcggatttctttgttttatcgttaccgctaaatcgttctcattgcttgtttcttcgtttttccaattactcgatcaacttactcgaccacacccagtgtcttgcaacagactgtgtagtcgagtacggttgtctcatagactgtttgttacatgaccagtatactcgaccacacccagtgtctggcaacagactgtgcagtcgagtatatctgtttcatatcatgtatgttactcgacctgttactcgaccacatcctacttctggcatcagcctgttgtggtcgagtgactttagtaattctgttattatttctgttttctgcatgtttgcttaggattgttagaaaccccaaaactgttattgcttggcttgacttattgacttctgatcacatctcatctgtttgcatcacacctatttggattgacacctaaaatactacaacgacatgattggtgttttaggataattgactaaaaacctattatcatttaacatggaagcactactttacttttcgggatcttgttgaggttttagttttatattcaatcatacgaataacatgttgtcatatttcactctgaaacgctaaccaaaatttttcttgcttctttaagtattatagtatatttgctcctaaacactaaacctaaaccctacaccttaaatcccaaaccctaaatctaattccttaaccctaaaacctaaaccctaaaccctaaaccctaaaccctaacgctaaaccttaaaccctaactctaaaccataaaccgtacacccaaaaccttaaaacataaacactaaacgcaaaatcttaaccttaaaccttaaaccctaaatcctactttaacttcctggttctttttgcgtttctagttcttagactgaatgataaacaaaacatcaagtcatatttgactacaaaaacacaaaccaagcttcttcttgattctcaaagctttgatggtgaagccgaagttcttatgagttttttggttttgaatcatataacaaggaagcactactttacttttcagtatctcgttgaggttctagttttatattcaattatacacatgacatctagtcatatttcactccgaaacgctaaccaagattcttcttgctttttaaagtatcatactatatttgatcctaaacactaaacctaaactctacaccctatatcccagaacctaaaatcgaacccctaaaccgtaactcatgaaccctaaatcttaaacccgaaaccgtaaaccctaaactcttaaccctaaaccctcaaacctaaaccctaaaccttagatcccaaactttaaaatctaaatcctactttaggcttccggaatcgagttgcggttctagttcttatgctcaatgatacacaaagcatctagtcatatttgacaacaaatccgctaacgaagtttcttctttattctcaaaggtttgatggtgaagccaaaattcttatgagttttcagtgttttgaatcgtttaacaaggaagcactactttcactctaaaacgataaccaacattcttcttgcttcttaaagttttatagtatatttgctcctaaactctaaaacttaaactctacaccataaatcccaaaacctaaaatctaacccctaaaccctcaaccctaaaccctaaaccttaaataccaaatcctaaaccctaaaccctaaaccataaaccctaaaccctaaactcttaaccctaaacccttaaacctaaatgataagtgtgtattttgcatgttttgagcatccatttgtcatcactttagcatcatatcatcactgttttataccatttctcatcatttgtcatcactttacatgtttaggatagatctgcatgcatgttgcatatttgtgttgatttcaagtgatttggagctgttgacgagctatctggaagagcaacctgatcatgtcaaaccactcgaccccgaggtcgagtagaagacatcaccacttcacctcaccactcgtccacgaggtcgagtgtcctcatctccatcacctgaccatcactcgatcacatcactcgaccccgaggtcgagtgtcttcacctccattatcaaaccaccactcgatctcaccactctgccttgaagtcgagtatcaccatcaccaccactcgactgcgtactcgatgaaaagcttcagagccttcttcattccgcactcaaccagacactcgagcacgaggaagaaaagaagactccagctactcactcgaccacttgggtcgactacagttcttaatccgtcccaatacttcgtcgttttataagtagcatgtacttcacattttcgaaaacaagtttttatctagttttattccgcagaccttgtgttctagaccttttgtaatctggatttctctttatctattcagtattcagtattcagcttttgttcttgatttcgtttactattgttcattctgttatcatcctgctgttacactgttgttatcatgttttcaacttgttcaacgtttatgctttctgttatgatgtctgagtagtgaataggtttctgaggatgggttagagtagtgtagaattctcagtatgctaggtgattgagtattgattgatagatcccttctagattagttgttcttaatgcctattgctttctgatcaactggaatttgagcccagacatttctgcgcccaaaaggtgttcgatgaaatgtctgaaccactaattctagagattcgtgaccatgtaccaaggtattggttgcagggagcgttttggctttaacttgttgattcgtaatgcctgttaggttagctctcgtcaatggtgattgagtttgggactaggttaactggagagtctctgttgcggtggcacttagatttggttaatgaacttgttgtctagggttaatttattgagcatgtcaatcacctctcgggaattctttatctgattgaattctttgtttattctactgttgtttactgcatcttgttatctgtcgcttaatttctacagttctttcttgttactcgaccacccagttgtctggcaacagactgtgcaatcgagtatctgtgttttattttctgtctattactcgacctgtcactcgacctcacctagtgctctgcaaagagctgtgttggtcgagtgttttactgtttctgcttgaatttcggttttctgcatgttcacttagaactgctagaacacaccacaacctgttattgcttggcttgacttagtgactgctgatcacatcttgattgttagcatcacaaccatttggattgacaaccttcagtactacaacgacatgatagtgctttaggtttaattgatttaaaaacctattatcactaaacactaaacgtcaaaccatagaccccaaactttaaacctaaatcctacttacgtttagtgcaccaaacatcnnnnnnnnnnnnnnnnnnnnacctgattttaggttaataggtatgcccaccttaggtatctattactggaactatcttagatgtgtgctagcgtcgattacttaggtgaacttatcaaacctgattattatgcttgcttagttctagggatttacaagagagttgggatcaatactattaagcatagttgagttttgcggaacactcatcggttactttatattagtgatttgtgttctagaatggttcaataataatcctaatttactgctagatctactattctgatatttcctgagaatttccctaaacccgacatcttaatcatctgaatcaaaaaccaactttaattgctttcttgtcttttacttttataatattttttgtttagctttatttgaaactattaatctatggtgtgatttgagagctttgtggaatttgaccctaaagtactacaatcgatctcttatttgagagagtggtcttaggattaatttgacctatatcattaaggtttaagggtttagggttaagagtatagggtttagggtttacggtttcagatttaggatttaggattcaggggttagggtttaggggttggattttaggttttgggatttagggtgtagagtttaggttaagtgtttaggatcaaatatactatgatactttaagaggcaagaagaatcttggttagcgtttcggtgtgaaatatgactacatgtcatgtgtaggattgaatataaaactagaacctcaacgagatcccaaaaagtaaagtagtgcttcgttgttatacgattcaaaaccaaaaaactcataagaacatcagcttcaccatcaaagctttgagaatcaagaacaagcttggttagcagatttatagtcaaatatgactagatgatttgtgtatcgttgagcataaaaactagaaccgcaaccagattcgagaagttaaagtaggattagggtttaggatctatggtttcgggtttagggtttaggatctatggtttagggtttagggtttatggtttcgggtttagaatttagggtttaggtgttagggtttaggggtaggattttaggttttgggatttagggtgtagagtttaggtttaatgtttaggatcaaatatactatgatacttgatataagtcaaattaatcctacgaccactctctctgataacactagattttaaccattttaagcccttgtttttcatgcatttagcttagtttcaagtatcttttcatgcattcctagtctcttttcctatcttttcacattttgcattgcattgcataccatacttgcatttagattattttacaggtgaatcaagtactttttggactcaacttggacgtttctagcccaaggagtggactagctcgagtttctgtgatcaaaggaaggacatgaagtatactcggggtatttactcggctgaagatcaagtggagcacgcgtgaggaacaaggagtatactcgaccatagcactcggctagaagtcgagtgagggaaataaaggagaagagaagctactcgaccaagctgctaggcctgaagtcgagtgatgtgacaaagaggagctgctcgacttttctactcggcctagacccgagtggtgttgcgccgactttcttattttatctttttcccaattagggtatcctagtattgcatataaatagacctcttatgttttttgcccaaaatatctttgctttgtctactggatattagggttcttagatttctattgcattttctggttgttgtgttgagaatttgaatttgatttcttctgcaaacttgtttatcttattaagatctatcatttgctaagtttataatgatttctgggttttatgatttttctgagttttgttctatgatgttcttcattgttcttgagtagtcttcttcaaagttcttgaggatgggttaggtttaggtggattcctctgttctttagctagctaagtttataaatgcatggttcccttctgttttaggagttcttaatgctattttctttctaatcaattgaaaattgattttagactttctccccctaataagtgtttgatgaaatgtttgaaccaactaatttcagagatttgtagattctagcccaagaccttggatgtttagactgcttgttgaatttaatagattggtgtttcatcaatgaaaattgagattaggaagtggtaaagttatgagaatcattatcacgaaagtggattgatttggttctgaatctattgtctagggataacttgattgagtttgttagttagctaatggattgaggagtccactagaaccaattaccccatttttaagagctctgtttcgtttcattgtgcaaatctcgtgtctttagtactctgttcgttttgtttagttcttgtgcaaaattggtgtttttagtattctactcgacctatttaagtaatatgctcggccgagtaccttacttagtgcttggtttactttcctgttcttgcacttgacagttccttgattttagtttcatttatgtttttatcacttgtgctctttaccttctgcttagtatagtttcatttccgaatttgatttgcatattaacctattgtttaggattagtagaaacacaccaaacctattcacacttggcttgacttagtattctctgaccacatcctgattgttagcaattccacccaattagattgacaccttaaatgctacaatgacataagatgcatttagggaattgacacacaaaaccttgtatcactctcaaataaagaggtcagttgcagcacttagggatcgaattcacaaagttctcggatcacgcaatagactaatggctattgaatttagctaagtaaaatagtaatgaaaataaaagaaacaaaaagtaagcaatatcaatcaattgtgagttgtgaaaacaagataataaaagcgtcaggttagggtannnnnnnnnnnnnnnnnnnngatgtttggacactaacactaaacctaaactctacaccctaaatcccaaaacctaaaatccaacccctaaaccctaaccccggaaccctaaaagctaaacccaaaaccgcaaaccctaaacccttaaacctaaaccctaaaccatagatcctaaactttaaaacctaaatcctactttaggcttccggaatctggttgcggttctacttcttatgctcaatgatacacaaagcatctagtcatatttcactacaaatcagctaaccaagcctattcttgattctcaaagctttgataatgaagccgaattcttatgagtttttttgttttgaatcgtttaacaaggaagcactactttacttttcgggatgtggttgaggttctagttttatatttaatcatacacatgacaacacgtggtcatatttcacaccgaaacgctaacaaagattttcttgcttcttaaagtattataatatatttgctcctaaacactaaacctaaaacctccactctaaatcctgaaccctaaaatctaatccctaaatcctaacgctaaatcttaaaccctaaaccctaactctaaaccctaaaccgtacaccctaaaccttaaaacctaaacccgaaacgcaaaatgttaaccttaaaccttaaaccttgaatcctattttaacttccgggttatttttgtgtttctagtttttatactgaatgataatcaaaatatcaagtcatatttgactacaaaaacacaaacgaagcttcttcatgattctcaaagctttgatggtgaagccgaagttcttaacagtttttggttttgaatcgtataacaaggaagcactactttactcttcgcgatctcgttgaggttctagttttatattctatcatacacatgacatctactcatatttcactctgaaatgctaatcaagatctttcttgcttcttaaagtatcatattgtatttgatcctaaacactcaacctaaactctacaccctaaatcccaaaacctaaaatccaacccctaaaccctaaccctggaaccctaaaacctaaacccaaaaccgcaaaccctaaacccttaaacctaaaccctaactcaatcaccattgacgagagctaacctaacaggcattacgaatcaacaagttaaagccaaaacgctccctgcaaccaataccttggtacagggccacgaatctctggaattagtggttcagacatttcatcgaacaccttttgggcgcagaaatgtctgggctcaaattccagttgatcaaaaagcaataggcattaagaacaactaatccataagggatctatcaatcaatactcaatcacctagcatactaagaattctacactactctaacccatcctcaaacctattcactactcagacatcataacagaaagcataaacgttgaacaagttgaaaacatgataacaacagtgtaacagcaggatgataacagaatgaacaacagtaaacgaaattaagaacaaaaactgaatactgaatattgaatagataaagagaaatccggattacaaaaggtctcgaacacaaggtctgcggaataaaactagaaaaaaaacttgtttgcgaaaatgtgaagtacatgctacttatagccaaatatcccgaaaccctaatactcaaaacgacgaagtattgggacggattaagaactgtactcgacccaagtggtcgagtgggaggtcgagtgaatagctggagtcttcttttcttcattgtgctcgagtgtctggttgagtgcggaatgaagaagactctgaagcttgccatcgggtatgtagtcgagttgtggtgatggtgatactcgacttcaaggtagagtggtgagatcgagtagtggtctggcaatgaaggtgaagacactcgaccacggggtcgagtggtttgatcgagtgatggtcaggtgatggagatgaggacactcgacctcgtggtcgagtggtgaggtgaagtggtgatttcttctactcgacctgggggtcgagtggtctcttgagatcttgaagctcctagtcgacctcggggtcgagtgctttgacatgatcaggtccgcttcttccagatagctcgtcaacagctccaaatcacctgaaatcaacacaaatatgcaacatgcatgtaaatctatcctaaaaatgtaaagtgatgacaaatgatgagaaatggtataaaacagtgatgatatgatgctaaagtgatgacaaatggatgctcaaaacatgcaaaatacacacttatcagtaactcctaaattctatcaagcgagtaaggtctggtggtactatcttcggatcccaaaagattagaatagtactcaacaatcatgcctttgatctgatcaacattaaccacacgatccccattatcccttctgagaaacttaataagattctgagcctaatgagcaagcaccactctgtggaataatcttgtgttagcatcaccttcctttaaccatttgattctggacttctgtttgtaaaaggattccagagcagcagcgaagaaattccaatttttgcgggcaacatgttcagccctgaataagaagtcagacggattggacatcaattgagcttgaatattactgaagccacgtctattcagacctctacaggccttcttagcctcttttaagagttctcctaaggaaaacatgaaagaacccacagctatctccttctgccacgcagccaaaatagaagagataaaatccggatgcgtcgataagaaagaaaagtacttgaaacttttcttttttgaaagaggcggagagttattgagaatgaccatacacgctgcgtggtcagagtcgctaggagggtcaaagatagcagacgccgttgggaaggtagcaagccaacaaccattaacaatggctctatcaagcttccttagaattggattatcttgctggtgattagaccaagtgtacagcacacccctacacggtagatccacaaggtcactgtctctcatacaagcttgcaggtcctccaagccttgtaaggaaatattagacggcatgagagagtaatgctctgtgacagaagcaatttggttaaagtctccaacaacaagccatggagaattacaaagaggagaggaagcagacaaccttgtaatatcatcccaaagagaccttctctcagcctcagtattccttccataaacaaaaagtaacagcaaacgactaagcaatatcaggaattttaatcgagcagaccattaactgatcagtcctgctgaaaaccaaaacagaaactgacggatcccaaactatccagatccgtcccagctctgaacagcaataattagaatccatcctccaacctggtagagtagcagccaaaacagaactagcattgtcctaagcgacgtgagttaccaaaaaataacctaccaggagattattcgaagcaatccagcttcttactatccgttggcgagacggactattaaggcctctaacatttcaaaaacagatcgccataagtaacccaaaagatgataatgggaacaactatcaatggaaagagaggactggcgggggatcctagagtcatcacatctcaacttagacaaaaagaactctctcttgaaatgagcgctgccggttgtgccacatttttcaattgcttcttcttctccttattggacatcgcaccccaaccaggaggaggaggaaaaggaggatcaactagctgatcccttgtggaccgaatgtcttcgacacacagactagttggacctccatcggagacctttgaaatagaaggcgccaccttagggatctcagaaagagggctaagaccagcttgaacaacagtaagagaagaagaagttactgttatgggtgccttcacgtctgatttgggaatccatttctgtttaggcaccgctgataacatcccggataacagctctttggatccatctgatgacttgataggaccaggaggcaagctgtttgatctcttttttgaacgggacctccttcttttgaacttgatatttatattgaatcatacatataacatctagtcatatttcactctgaaacgctaaccaaaattctttttgcttcttaaagtattatagtatatttgctctaaaacactgaacctaaactctactccataaatcccaaaaactaaaatttaacccctaaaccctaaacctaaaccctaaaccctaaatccaaaaccttaaactcttaaccctaaacccttaaaactaaacactaaaccctaaaccatagaccccaaactttaaaacctaaatcctactatagcttccgaaattcggttgggtttctattttttatactaaatgatatacaaagcatttagtcatatttgactacaaatccgctaaccaagcttcttgattgtcaaaccttttatggtgaagccgaatttcttatgagttttttgttttgaatcgtacaataaggaacctatactttacctttcgggatttggttgaggttctagttttatattcaatcatacacatgacatgtagtcatatttcactccgaaactgtaatagtgcacaaactactnnnnnnnnnnnnnnnnnnnncttctgtggtatgctgatcacgtcaattacctggttagtggtgaagagcccccaaatctttcgagctatgagaagaagaagttcttcaaggacattaaccatttttactgggacgaaccttatctctacacactctgcaaaaataagatctacaagagatgtgtctcagaagacgaaatcgaaggcatcctactgcactgccatgggtctgcctatggtggccactttgcaacgttcaagacagtgtcaaaaatccttcaagctggtttttggtggccgacaatgtttaaggatgctcaagaatttatctcgaaatgtgactcatgtcagagaagagggaacataagcagaaggaatgagatgcctcagaatccgatcctagaagttgagatctttgacgtttggggaattgattttatgggtctatttccttcttcttacgggaacaagtacatactggtcgcagtagactatgtatcaaaatgggtggaagccatagctagccccaccaatgatgctagagttgtgttaaagctgttcaagacaattatcttccctagatttggagtcccgagagttgtaatcagtgacggagggaaacattttatcaacaaggtttttgagaaccttttaaagaagcatggagtaaaggacaaggtagccactccttatcatccacagacgagcgggcaggtggaaatctcagacagggagatacaagcaattctagagaaaacagtgggaattacaaggagagattggtcttctaaactcgatgacgcactatgggcttacagaacagccttcaaaacccctattggcacgactcctttcaacctcctctatggaaaatcctgtcatttgcctgttgaactcgagtataaagccatgtgggcagttaaactcctgaactttgacattaaaaccgtcgaggagaagcggttgatctaactgaacgatctcaacgagattcgcttagaagcttatgagagttccaaaatctacaaggagcgaaccaagtctttccatgacaagaagatagtctcaagagattttaaggttggtgatcaagtgttgctgttcaactctcgcctaaggctttttccaagcaagctcaagtctagatagtctggtcctttctctgttactgcagtctgaccttatggtgctatcactctagctggaaagaatggagacttcacagtcaatggctagcggctcaagaaatacatgatagatcagtttattccagaaggagcttctgttcctttggaggagcctataaacgcttaatgagtatgaggagtcaagttagagacctaaaacaagctcacttgggaggaagtctcatgcctatctttgtacatatctttaattttccttgttgtttttgatgcatcttgttagtgttttcaggagataagtatgaagagctaagggaaatagattctggctttgagggaacaaagatacactcgaccacggagttatcaaggacactcgacattgttctggtttccccaccccaggaaatcactcgaccacaccctacagggaccgaatgacgatgtgatcgagtatagcgagttatgcaatcaaaacttctccatgtcagtaaatcactcgaccgcggtgctggccgcagcagaagaagagaggtcgagtatcatcagagcggtgctggccgtgacgaaggagcagaggttgaatacccccaggcggaagctgagacacaacagggagattcttcgatggcctgggagcaatcacaggcagctattgacgaccaaatttgctccttcttccactgaggtaagcacctcactccaccattgtaatataccatctcctgtttttattttgtttctatgatgtgttttgtcctgagtactcttttccaaatttgatcacacagtggactgtgtgatttaagtttgggggaggactcaggaagtgtgtgtttcattgtatataatcttgagtctgcattcatctgaggcatagaaaaaaccaaaaaaattgaaaaatttcagaaaatgatttcacaaaaatagagtgttcatgtagttgcattgcatttaggatcgagtgtagagtatttcgtttaggattgttgcatatgcataggggataatgatgagatagccttgtaagcattttggttcaccagataagctcagtgccctcgttgttagttgtttgatgcgtagtcaatgaaattgaagtaaaactgcaccatgcctagattgctctactcgaccacactgttaggatctaataccattccctatcaatttgaacttgaatctgatttagaattatcatgtcttggcattgaatttgaacacatggataccctaaaatacttggattttcttactcattttaaccactcttgttaatccaagtagttgactctccttattagagcagttaacccgaacccaaacctaaactctctttcaagccctatatcacttgtgagtgtttgtgaggtcttatttccattgagcttggtagaaagtgttaggttcgtaacgagagagatagtgtctcatgtagttctagttcgcgtttttcggacaggataggattggtgggcgcttatatcatgggttgggatgtgtttaaaagaaaagggtgaattcattgttgataaggaaagggaaagaattctaggggaagtaagctaaagaagttagaaaaaaaaaatctagtaaaggttttgggaatgttaaagaaaagaatgaggttcttgttagctaaagaagaagggttaaaagccttttgttttaaatattaaaaacaggaaccttagttgttaaagaaatccaaatccgcttgatgtatcagagtgttgagaaagcttctcctagagttaagagaaaagaaacgaatgatatgaaaaagagtttgaaagattcatgagtgcaaagggtagagttaagttcttgtattgggactggagttgggattaccattagagcttcattgttatactctgggtagatgagatttatctctgtatgcataacttgggacttacctttagcattctactaaagctcaatcattcttgagagatcccctgttacttaagcctattctgtaagggaccatctctgtctcttgaccttcaccttagccaaatgatttcattgatgatgcattgcttgattcacgttccagaactaatgaatgttaaagggattggtagatttgaaagcatgtgtaggtcgagtataagagacggattgattgataacaaggcatgactaacgtttttgagtaaaattctatcatatcgcatcttagaactaccaacttggacattgattttatttgctctacctgatgctttggttctgagtccccaccttcaaacctctccttcaactatgtcttcttatttgcttgagggcaagcaaaaactaagtttgggggaattgatatatctataatttgcatgttttcagtatccattcatcatcgttttgagtttagtttcgtatcattnnnnnnnnnnnnnnnnnnnngatgtttggtcactattgtactggaggtggacaatgccatgacgctggttgtggttgtgagggaagtcactagcaccaatgttgttaggttgctcttgcgcatctacaatgtcagccattgtgtctgttgctgtccgttctttcagttggcgagcaatacggttgatgttatcgttgaattaggaagttctaattcccttgtgaccgtgtatgacatgtatcaacctgactataacagacgaataaagtgtgttgctaagtacctgaaatacaaattctgaaaagacacaatgttagtatctcttataacaaaaacgaacttgatcttaacaattttgaaatctcaaatatagcaaacaaacacccaattggcaacggcgccatattgataataaatttttaatcaattatcctaaaacacaattcatgtcattgtagtattttaggtgtcaatccaaatgggtgtgatgcaaacagatgagatgtgatcagaagtcactaagtcaagccaagcaataacagttttggggtttctaacagtcctaagcgaacatgcagaaaacagaagcaataacagaattactaaaatcactcgaccacaacaggctgatgccagaagtaggatgtggtcgagtaacaggtcgagtaacagacaggatatgaaacagctatactcgactgcacagtctgttgccagacactgggtgtggtcgagtatactggacgagtaacagacaggaaacaagacaatcttactcgactgcacagtctgttgccagacactgggtgtggtcgagtaagttggtcgagtgattgtaaaaactaagaaacaggcaatgagaacgattaagcgataacgataaaacagagaaataagatagacgagaaattcctaaggatggggtaatcgagtagagtggtatcctagcctattcgaatggttaacaagcgcaatcaagctatcactagacaacaggttcaacaacagatcaattcactcccgtgatagaaatcctcaagcaaagctaacccagactaattcccattaacggaatctaactatgcaggcaataagaacatactgataaagtcaataaacgctctaaacagccaatcccttgggatagagacgcatatctcaggaactagtggatcaagcattccatcgaacaccttctgggtgcgggaatgcttgggatcgaattccagttgatcagaaagaattaaccagtaaacgcaactagtcctaaagggattcaattaattctaaaacttaaccattctacagactacgaattccacaactactttatcccatccctaagaattctaagtcactactcagacaacatgctcaaagatataaacgcagataaacgataatattgcataagtaaagagataaagagtagagaaacaagatgacagatgaaatcaaatgcggaatctgaataacttggaaaaatctcgaattacaggttgcagaagcaaaaacggcgcaacagagtaaaacagaaaataaaactgaaggaaaaattcaatgtcgactggatgtcccaggacagaaccctaagacatctatttatacaaaacgaaataaaatgatagtagacgggccaataacctaatcgctcggcccatagagagataatgggccgagatggacttcgtgatccgatggaggtccaggcgcttccaaacactttgtcttctcctcttctcctccttgtgctcagcttgtctggttgagtgcggatttgagtagactgtgaagacgtgatcgagtgtccggtcgagtgatgctgatggtggtgagtgatgatactcgaccagggggtcgagtaacttggtagagtgattggtcgagtgttgtcaggtggtgtggcgaagtgatactcgaccagggggtcgagtagtgtcatcgagtcgcctgagctgaggttactcgacccggtggtcgagtggatgggaagaatggctacaaagtcactcgacctgggggtcgagtatgtgggaagaatggctccaaagtcactcgacctgggggtcgagtatgtcttctggttctggctcgtttcttccaatttgcttgcaaacagctccaaatcacctgaaaacaactcagaaatgcaatatgtatgcaaagctatcctaatcatgcaaagtatgcaagaatgatgagaaatgatataaaacagtgatgaatgatacgaaactggactcaaaacgatgatgaatggacactgaaaacatgcaaattatagacatatcaactctcccaaacttagtctttgcttgccctcaagcaaataagaagacatagttgaaggagaggagtgaaggcggggactcagaaccaaagcatatgatagagcaaataaaattaatgtccaagttggtagttctaagatgcgatatgattgaattctactcaaaaacgttagccctgccttgttatcaatcaatccgtctcttatactcgacctacacatgctttcaaatctaccaatccctttaacattcattagttctggaacgtgaatcaagcagtgcatcatcaatgaactcatttggctaaggtgaaggtcaagagacaaagatggtcccttacacaataggcttaagtaacaggggatacctcaagaatgattgagctttagtagaatgctaaaggtaagtcccaagttatgcatatagagataagatcccatctacccagagtataacaatgaagttctaatggtaatcccaactcctgtcccaacttaactctaccctttgcactcatgaatctttcaaactctttttcatatcattcttttcttttctcttaactctaggagaagctttctcaacgctctcatacatctagcgggtttggatttctttaacaactaaggttcctgtttttttttatctttaaaaccaaaggcttttaacccttcttctttagctaacaagaacctcattcttttctttaacattcccaaaacctttactagattttttttttctaacttctttagcttacttcccctagaattctttccctttcctcatcaacaatgaattccctcttttcttttaaacacatcccaacccatgatataagcgcccacctagtcctatccagtccgaagaacgcgaactagaactacatgagacactatctctgtcgttacgaacctaacactttctaccaagctcaatcgaaataagacctcacaaacactcacaagtgatatagggcttgaaagaaagttcaggtttgggtatgggttaactgctgtaataaggagagtcagctacttggatcaacaagagtggttaaaatgagtaagaaaatccaagtattttagggtatccatgagttcaaattcgatgccaagacatgataattctaaatcagattcaagttcaaattgatagggaatgatatcagatcctaacagtgtggtcgagtagagcaatctaggcatggtgcagttttacttcaatttcaatgacaacgcatcaaacaactaacaacgagggcactgagcttatctggtgaactaaaatgcttacaaggctatctcttcattatcccctatgcatatgcaacaatcctaaacgaaacactctagactcgatcctaaatgcaatgcaactacatgaacactctatttttgtgaaatcattttctaaaaattttcattttttttggtttttctatgccttagatgaatgcagactcaagattatatacaatgcaacacacacttcctgagccctcccccaaacttaaatcacacagtccactgtgtgaccaaatttggaagagagtactcaggacaaaacacatcacaaaaacaaaataaaaacaagagatggtatattacaatggtggagtgaggtgcatacctcagtggaagaaggagcggagttggtcgccaatagcttcctgtgattgctcccaggccatcgacgaatctccctgttgtgtctcagcttccccttgggggtactcgacctctcttcttctgctgcagccagcaccgcggtcgagtgaattactgacatggggaagtcgtgattgcatcattcgctatactcgatcacatcttcattcgctccctgtagggtgtggtcgagtgatttcctagcgtggagaagccagaacaatgtcgagtgtctttgattgctctgtggtcgagtgtattgttgttccctcaaagccagaatccatttccctcagctcttcattcttatctcctgaaaactctaacagaatgtattaaaaataacaaggaaaaataaaagatatttacgaaaatagacatgggacttcctcccaagtgagcttgttttaagtctctagcttgactcctcacactcataagacttaaggagggtgatagagaagaattgaaatcttctcttcttcctttgcagatacaacatcggacttagcttgctctcttgacatgtctgtaattgagcactcaatggccctttctttgtaagcttcttaaatttcttgtgggtagtcttcttcttcacaccattctgaaacgaacttcttctttggtataacttcaatgccgagttgaggttgaatagcttccctttgcatctgactcactgtatccctaacttcttcaacagtgcaagctagcttctggatggtttcttctttgagatcagaattccttttaagttctagccaatcaactatagagagcgtactagactgagtggttgagcttgaaggtcgtgttggagctaaactcggttcctttactctttcagtttcaaatctttcttctgtaaccactccttggaccccaaaggtctgtccctctatggttgatcttcttggagttttgttgatgtcaaactgtaacctgatatccttcccaagattgatttcaatctttccatctttgacgtctatcactgctccaactaaggccaagaaacgtcttcctaggatgagaggatccttaggttcttcatccatctcaagcacaacaaaatctgtaggcacttgtactccattaatcttgataggcatatcttctagtaggccataaggttttcttaaggtcctatcagcaaggatcaaggataggtcgtatggcttatatttgaaaaatcccagcttccttgccacagaaagtggcattacgctgactgaagctcctagatcacatagacagttgctgaaagtcagttgcctaatagagcatggtagagtacaagatcccggatcttccaacttttcttgaataatgttcttctagatgattgcactaaactcgtgaggtaacgccactgttccttgaacttctttgatcctctctgtaatcatgtccttcacacgtttgtgtgagttcggtattagcgcaagacagtctactagaggcattgtgatttcaaggtccttcaattttttttccaagagagcttcatacttctttatcagttgcttcttaaatctccctggaaatggtaatggaggcttgtagggtggaggaacaaagactttatctttggttttagcagatgcaggctttttaactgaagaaagtactacttgagcttgggatcgagtactgtgatcgagtatgggctcctctaatgctattttagcttgaatttcattctgaacaaaatcctccccttcttgaacttcactgtccctagtgatggaggtagaggcatgtcgagttggcagctctcgatcatggcagatattgatggcgtgagcagtggcgtactccttaggattctggattgctctccctggaagctggcctgggttgttgttaacagatggtgtagcgaggatgccttccacatatctcatcctagtgctcagtgcttcgaacttgctgttaagttcgacgctttgtcggtcgactttgttatttaatttacccaacttcttagcgatttccattgctcctgtggcttgtccttgaatgagcagctggagcatagtcattatgtctgaattctgaggcgcaactggctgttgttgatgtggtgtgaaaccaggtggtggttgctgttgttgatatcctccttgaaactgcatctttgggacgaatccttggctttggttgtaaggaataaagggtttgggttggttttgctgttgctgagggtagacttggtcatgagggttggcgatattggtgcttctgtatgacagatttgggttgggtctgtaattgttgtaccccttgttgtagccaccttgattctgaacatagctgtaagcacactgatcattctccccctcttgtacttggaatggttcatcttgagagatgaggtgaacatgtttctgctgcacttggaggattttgtctagtttgtcattgagaactttcatgtctctacggtgcttgtcatcagagtcagaactggtgcggatgcttctgtcataatcttcattataattgccatccgactgagcaaagttttcaactagctcccacccttcttcaacatccttctttaagaaattcccctttgaagcggtgtcaagtagcatccttatcttaggcaagacgcctctatagagtgtgctgagaagagaagcttgcttaaatccgtgatgagggcattttgtttgataacccttaaagcgttcccaagcttcatagaaactttcactttgtttctgagtgaatccggatatctcattccggagtcttgcagttctggagtaggagaagaattttgccaagaaagcttttttgcagtcatcccaggtcgtgattgatccctggggtagcgtcttttcccacagatgggctttgtctccaagtgagaatggaaacaagcgaagcttgaaaccatcttcactaactccattgattttagtaaggctacagagcctttcaaactcgtctagatgatcgagtggatcctccattggcaagccatgaaacttgttcccctgcaccattgcaatgagactgcttttgatctcaaagttgttgttttgtactggaggtggaacaatgccatgacgctggttgtggttgtgagggaagtcactagcaccaatgttgttaggttgctcttgcgcatctacaatgtcagccattgtgtctgttgctgtccgttctttcagttggcgagcaatacggtcgatgttatcgttgaataggaagttctaattcccttgtgaccgtgtatgacatgtatcaacctgactataacagacgaataaagtgtgttgctaagtacctgaaatacaaattctgaaaagacacaatgttagtatctcttataacaaaaacgaacttgatcttaacaattctgaaatctcaaatatagcaaacaaacacccaattggcaacggcgccaaattgataataaatttttaatcaattatcctaaaacacaattcatgtcattgtagtattttaggtgtcaatccaaatgggtgtgatgcaaacagatgagatgtgatcagaagtcattaagtcaagccaagcaataacagttttggggtttctaacagtcctaagcgaacatgcagaaaacagaagcaataacagaattactaaattcactcgaccacaacaggctgatgccagaagtaggatgtggtcgagtaacaggtcgagtaacagacaggatatgaaacagctatactcgactgcacagtctgttgccagacactgggtgtggtcgagtatactggacgagtaacagacaggaaacaagacaatcttactcgactgcacagtctgttgccagacactgggtgtggtcgagtaagttggtcgagtgattgtaaatactaagaagcaggcaatgagaacgattaagcgataacgataaaacagagaaataagatagacgagaaattcctaaggatggggtaatcgagtagagtggtatcctagcctattcgaatggttaacaagcgcaatcaagctatccctagacaacaggttcaacaacagatcaattcactcccgtgatagaaatcctcaagcaaagctagcccagactaattcccattaacggaatctaactatgtaggcaataagaacagactgataaagtcaataaacgctctaaacagccaatcccttgggatagagacgcatatctcaggaactagtggatcaagcattccatcgaacaccttctgggtgcgggaatgcttgggatcgaattccagttgatcagaaagaaataagcagtaaacgcaactagtcctaaagggattcaatcaattctaaaacttaaccattctacagactacgaattccacaactactttatcccatccctaagaattctaagtcactactcagacaacatgctcaaagatataaacgcagataaacgataatattgcataagtaaagagataaagagtagagaaacaagatgacagatgaaatcaaatgcggaatctgaataacttggaaaaatctcgaattacaggttgcagaagcaaaaacggcgcagtagagtaaaatagaaaataaaactgaagcaaaaattcaatgtcgactggatgtcccaggacagaaccctaagacatctatttgtacaaaacgaaataaaatgatagtagacgggccaataacctaatcgctcggcccatagagagataatgggccgagatgggcttcgtgatccgatggaggtccaggccgcttccaaacactttgtcttctcctcttccctcccttgtgctcagcttttctggttgagtgcggatttgagtagactgtgaagatgtgatcgagtgtccggtcgagtgatgctgatggtggtgagtgatgatactcgaccagggggtcgagtaacttggtagagtgattggtcgagtgttatcaggtggtgtggcgaagtgatactcgaccagggggtcgagtagtgtcatcgagtggcctgagctgaggttactcgacctgggggtcgagtatgtgggaagaatggctccaaagtcactcgacctgggggtcgagtatgtcttctggttctggctcgtttcttccaatttgcttgcaaacagctccaaatcacctgaaaacaactcagaaatgcaatatgtatgcaaagctatcctaatcatgcaaagtatgcaagcatgatgagaaatgatataaaacagtgatgaatgatacgaaactggactcaaaacgatgatgaatggacactgaaaatatgcaaattatagacatatcaactcccccaaacttagtctttgtttgccctcaagcaaataagaagacatagttgaaggagaggagtgaaggcggggactcagaaccaaagcatatgatagagcaaataaaatcaatgtccaagttggtagttctaagatgcgatatgattgaattctactgaaaaacgttagctatgccttgttatcaatcaatctgtctcttatactcgacctacacatgctttcaaatctaccaatctctttaacattcattagttctggaacgtgaatcaagcagtgcatcatcaatgaactcatttggctaaggtgaaggtcaagagacaaagatggtcccttacaaaataggcttaagtaacaggggatccctcaagaatgattgagctttagtagaatgctaaaggtaagtcccaagttatgcatacatagataagatcccatctacccagagtataacaatgaagttctaatggtaatcccaactcctgtcccaacttaactctaccctttgcactcatgaatctttcaaactctttttcatatcattcttttcttttctcttaactctaggagaagctttctcaacgctctgatacatctagcgggtttggatttctttaacaactaaggttcctgtttttttttatctttaaaaccaaaggcttttaacccttcttctttagctaacaagaacctcattcttttctttaacattcccaaaacctttactagattttttttttctaacttctttagcttacttcccctagaattctttccctttcctcatcaacaatgaattccctcttttcttttaaacacatcccaacccatgatataagcgcccacctagtcctatccagtccgaagaacgcgaactagaactacatgagacactatctctgtcgttacgaacctaacactttctaccaaactcaatcgaaataagacctcacaaactctcacaagtgatatagggcttgaaagaaagttcaggtttgggtatgggttaactgctctaataaggagagtcagctacttggatcaacaagagtggttaaaatgagtaagaaaatccaagtattttagggtatccatgagttcaaattcgatgccaagacatgataattctaaatcagattcaagttcaaattgatagggaatgatatcagatcctaacagtgtggtcgagtagagcaatctaggcatggtgcagttttacttcaatttcaatgacaacgcatcaaacaactaacaacgagggcactgagcttatctggtgaactaaaatgcttacaaggctatctcttcattatcccctatgcatatgcaacaatcctaaacgaaacactctagactcgatcctaaatgcaatgcaactacatgagcactctatttttgtgaaatcattttctaaaatttttcatttttttttttgtttttctatgccttagatgaatgcagactcaagattatatacaatgcaacacacacttcctgagccctcccccaaacttaaatcacacagtccactgtgcgaccaaatttggaagagagtactcaggacaaaacacatcacaaaaacaaaataaaaacaagagatggtatattacaatggtggagtgaggtgcatacctcagtggaagaaggagcggagttggtcgtcaatagctgcctgtgattactcccaggccatcgacgaatctccctgttgtgtctcagcttccccttgggggtactcgacctctcttcttctgctgcagccagcaccgcggtcgagtgaattactgacatggggaagtcgtgattgcatcattcgctatactcgatcacatcttcattcgctccctgtagggtgtggtcgagtgatttcctagcgtggagaagccagaacaatgtcgagtgtctttgattgctctgtggtcgagtgtattgttgttccctcaaagccagaatccatttccctcagctcttcattcttatctcctgaaaactctaatagaatgtattaaaaataacaaggaaaaataaaagatatttacgaagatagacatgggacttcctcccaagtgagcttgttttaagtctctagcttgactcctcacactcataagacttaaggagggtgatagagaagaattgaaatcttctcttcttccttagcagatacaacatcggacttagcttgctctcttgacatgtctgtaattgagcactcaatggccctttccttgtaagcttctttaatttcttgtgggtagtcttcttcttcacaccattctgaaacgaacttcttctttggtataacttcaatgccgagttgaggttgaatagcttccctttgcatctgactcactgtatccctaacttcttcaacagtgcaagctagcttctggatggtttcttcttggagatcagaattccttttaagttctagccaatcaactacagagagcgtactagactgagtggttgagcttgaaggtcgtgttggagctaaactcggttcctttactctttcagtttcaaatctttcttctgtaaccactccttggaccccaaaggtctgtccctctatggttgatcttcttggagttttgttgatgtcaaactgtaacctgatatccttcccaagattgatttcaatctttccatctttgacgtctatcactgctccaactaaggccaagaaacgtcttcctaggatgagaggatccttaggttcttcatccatctcaagcacaacaaaatctgtaggcacttgtactccattaatcttgataggcatatcttctagtaggccataaggttttcttaaggtcctatcagcaaggatcaaggataggtcgtatggcttatatttgaaaaatcccagcttccttgccacagaaagtggcattacgctgactgaagctcctagatcacatagacagttgctgaaagtcagttgcctaatagagcatggtagagtacaagatcccggatcttccaacttttcttgaataatgttcttctggatgattgcactaaactcgtgaggtaacgccactgttccttgaacttctgtgatcctctctgtaatcatgtccttcacacgtttgtgtgagtccggtattagcgcaagacagtctactagaggcattgtgatttcaaggtccttcaattttttttccaagagagcttcatacttcttcatcagttgcttcttaaatctccctggaaatggtaatggaggcttgtagggtggaggaacaaagactttatccttggttttagcagatgcagtctttttaactgaagaaagtactacttgagcttgggatcgagtactctgatcgagtatgggctcctctaatgctattttagcttgaatttcattctgaacaaaatcctccccttcttgaacttcactgtccctagtgatggaggtagaggcatgtcgagttggcagctctcgatcatggcagatattgatggcgtgagcagtggcgtactccttaggattctggattgctttccctggaagctggcctgggttgttgttaacagatggtgtagcgaggatgccttccacatatctcatcctagtgctcagtgattcgaacttgctgttaagttcgacgctttgtcggtcgactttgttatttaatttacccaacttcttagcgatttccattgctcctgtggcttgtccttgaatgagcagctggagcatagtcattatgtctgaattctgaggcgcaactggctgttgttgatgtggtgtgaaaccaggtggtggttgctgttgttgatatcctccttgaaactgcatctttgggacgaatccttggctttggttgtaaggaataaagggtttgggttggttttgctgttgctgagggtagacttggtcatgagggttggcgatattggtgcttctgtatgacagatttgggttgggtctgtaattgttgtaccccttgttgtagccaccttgattctgaacatagctgtaagcacactgatcattctccccctcttatacttggaatggttcatcttcagagatgaggtgaacatgtttctgctgcacttggaggattttgtctagtttgtcattgagagctttcatgtctctacggtgcttgtcatcagagtcagaactggtgcggatgcttctgtcataatcttcattataattgccatccgactgagcaaagttttcaactagctcccacccttcttcaacatccttctttaagaaattcccatttgaagcggtgtcaagtagcatccttatcttaggcaagacgcctctgtagagtgtgctgagaagagaagcttgcttaaatccgtgatgagggcattttgtttgataacccttaaagcgttcccaagcttcacagaaactttcactttgtttctgagtgaatccggatatctcattctggagtcttgcagttctggagttggagaagaattttgccaagaaagcttttttgcagtcatcacaggtcgtgattgatccctggggtagcgtcttttcccacagatgggctttgtctccaagtgagaatggaaacaagcgaagcttgaaaccatcttcactaactccattgattttagtaaggctacagagcctttcaaactcgtctagatgatcgagtggatcctccattggcaagccatgaaacttgttcccctgcaccattgcaatgagactgcttttgatctcaaagttgttgttttgtactggaggtggaacaatgccatgacgctggttgtggttgtgagggaagtcactagcaccaatgttgttaggttgctcttgcgcatctacaatgtcagccattgtgtctgttgctgtccgttctttcagttggcgagcaatacggtcgatgttatcgttgaataggaagttctaattcccttgtgaccgtgtacgacatgtatcaacctgactataacagacgaataaagtgtgttgctaagtacctgaaatacaaattctgaaaagacacaatgttagtatctcttataacaaaaacgaacttgatcttaacaattctgaaatctcaaatatagcaaacaaacacccaattggcaacggcgccaaattgataataaatttttaatcaattatcctaaaacacaattcatgtcattgtagtattttaggtgtcaatccaaatgggtgtgatgcaaacagatgagatgtgatcagaagtcactaagtcaagccaagcaataacagttttggggtttctaacagtcctaagcgaacatgcagaaaacagaagcaataacagaattactaaaatcactcgaccacaacaggctgatgccagaagtaggatgtggtcgagtaacaggtcgagtaacagacaggatatgaaacagctatactcgactgcacagtctgttgccagacactgggtgtggtcgagtatactggacgagtaacagacaggaaacaagacaatcttactcgactgaacagtctgttgccagacactgggtgtggtcgagtaagttggtcgagtgattgtaaaaactacgaaacaggcaataagaacgattaagcgataacgataaaacagagaaataagatagacgagaaattcctaaggatggggtaatcgagtagagtggtatctcagcctattcgaatggttaacaagcgcaatcaagctatccctagacaacaggttcaacaacagatcaattcactccggtgatagaaatcctcaagcaaagctagcccagactaattcccattaacggaatctaactatgcaggcaataagaacagactgataaagtcaataaacgctctaaacggccaatcccttgggatagagacgcatatctcaggaactagtggatcaagcattccatcgaacaccttctgggtgcgggaatgcttgggatcgaattccagttgatcagaaagaaataagcagtaaacgcaactagtcctaaagggattcaatcaattctaaaacttaaccattctacagactacgaattccataactactcattcccatccctaagaattctaagtcactactcagacaacatgctgaaagacataaacgcagataaacgataatattgcataagtaaagagataaagagtagagaaacaagatgacagatgaaatcaaatgcggaatctgaataacttggaaaaatctcgaattacaggttgcagaagcaaaaacggcacagcagagtaaaacaaaaaataaaactgaagcaaaaactcaatgtcgactagatgtcccaagacagaaccctaagacatctatttatacaaaacgaaataaaatgatagtacacgggccaataacctaatcgctcggcccatagagagataatgggccgagatgggcttcgtgatccgatggaggtccaggccgcttccaaacactttgtcttctcctcttctcttccttgtgctcagcttgtctggttgagtgcagatttgagtagactgtgaagacgtgatcgagtgtccggtcgagtgatgctgatggtggtgagtgatgatactcgaccagggggtcgagtaacttggtagagtgattggtcgagtgttgtcaggtggtgtggcgaagtgatactcgaccagggggtcgagtagtgtcatcaagtggcctgagctgatgttactcgacccggtggtcgagtggatgggaagaatggctccaaagtcactcgacttgggggtcgagtatgtgggaagaatggctccaaagtcactcgaccggggggtcgagtatgtcttctggttctggctcgtttgttccaatttgcttgcaaacagctccaaatcacctgaaaacaactcagaaatgcaatatgtatgcaaagctatcctaatcatgcaaagtatgcaagaatgatgagaaatgatataaaacagtgatgaatgatacgaaactggactcaaaacgatgatgaatggacactgaaaacatgcaaattatagacatatcaccaaccctagtgatagtctagtgttgggcgacccggagtaggtcttatatcattaaacactcggctgcttttaagaaaacaatgtatacgtagtatatagcttatactttgcaaagagttacccaaaaatatatctttatgtcggatccttgttaaaaatacataataacaagtaattttacagaagcaacgcaaacatcctatttttggcaattcctagtgttcgtcttcccgctatgctcatcccactatgattacctataagacaagtagaatcatgagtaatctagcatcccttagtgagctgggtctatgcacaaataaattgctagggtttaatcaacttaataagtaaacttagccatcagagatcacaaaacacctaataaacgtattatcatatagttataataatacaagaatatgcagtcaaactagacacatgaatgaatcttgggctcagcatactgccaaccttaccaaaaaggtgcaccacaacatcagcaaaacctcccgcatacgtgtatacatgttctccacacgtatgctaccacacacacgtacatgcacacccacaccacacgtacgtacacaactatgaacacccgagctatagccacaaaggcttataaccggaacatcactttattgcatcgtcatgcattacccaacatacactctgagtcttgtgccatcatgtaagtgaccacgcaagatcaagacttactgacacaatcacaaaaaaaaaatgaaggcagcagcttactctaagcatgatggtatcgggtaaaccttgaataccacttagacacaataacctcatgcagtactaaatataaatagtttaccacaccccaaacaagtataacacaatcaagtaccaaatcacgtatttatatatatatatatatacataatatagcaaggacttattcacaacctcatcgcatatctcatataagtataacaatctaacaaggcaagtaagccctcgaatcaaatttcaattcatcaagtaaacttagttaagtccaaattcacttagcctagtcatgcaccagtctattccattccttaatgatattaactatcaagttcttcaaatacccatcattttaagattcaagttctaacttagactgaattctgattagttaagtctaagtgagtaagcatgcatatgattgataagtgtgtattttgcatgttttgagcatccatttgtcatcattttagcatcatatcatcactgttttataccatttcacatcatctgtcatcactttgcatgtttaggatagttttgcatgcatgttgcatatttgtgttgttttcaggtgattttgagctgtcgatgagctaactgaaagaagcggacctgatcatgacaaaccactcgacctagaggtcaagtaggagcttcaagatctcaagagaccactcgacccccaggtcgagtagaagacaccaccactctatcacatcactcgacccccaagtcgagtttcttcatctccatctcttgaccaccactcgatcacctcactcgacccccaggtcgagtgacttcatctccatcttctgaccatcactcgatcacatcacttgacccccaggtcgagtgacttcatcccattgccagacatctacacgacctcgtcactctacctggaactcgagtatcaccatcacaccactcgactgcatactcgatgaaaagcttcagagccttcttcattctgcactcaaccagacactcgagcacaaggaagaaaaaaagactccagctattcactcgacctcccactcgaccacatgggtcgagtacagttcttaatccgtcccaatacttcgtcgttttgagtattagggtttcagaatatttggctataagtagcatgtacttcacattttcgcagacaagaagttttttatcgagttttatttccgcagaccttgtgttctagacttttgtaatccagatttctctttatctattcagtattcagtattcagcttttgttcttgatttcgttacactgttgttatcatgtcttcaacctgttcaacgtttatgctttctgttatgatgtctgagtagtgaataggtttctgaggatgggttagagtagtgtaggattctcagtatgctaggtgattgagtattgattgatagatcccttatagattagttgtttttaatgcctattgctttctgatcaacttgaatttgagcccagacatttccgcgcccaaaaggtgttcgatgaaatgtctgaaccactaattccagagattcgtgaccctgtaccaaggtattggttgcagggagcgttttggctttaacttgttgattcgtaatgcctgttaggttagctctcgtcaatggtgattgagtctgggactaggttaacttgagggtttctgttgcggtggcacttagatttggttaatgaacttgttgtctagggttaatttattgagcatgtcaatctcttgtaaactgagaaaacgaatctactcaattaccccatcctcgggaattctttatctgattgaattctttgtttactctactgttgtttactgcatcttgttatctgtcgcttaatttctgaagttctttcttgttactcgaccttatactcgaccacctagttgtctggcaacagactgtgaagtcgagtatctgtgtttcattttctgtctgttactcgacctgtcattcgacctcacccagtgctctgcaaagagcacgttcacttaggactgctagaacacaccaaaacctgttattgcttggcttgacttagtgacttctgatcacatctggattgttagcatcacacccatttggattgacaacctaaaatactacaacgatatgattggtgttttaggataaatgatctgaaaaacctattatcaatttggcgtcgttgccaattgggtgtttgtttgttacatttgagatttcagacttgcttcgatcaagttctttttcaattttcattttagttactgactgtgtgtttttcttgttgtcttctcgaccgaggtacatctctactatattcaaactcgatcaacaggcaaccagaacctccttttcaatgataacatcgaccgcctagttcgtgaacttagagaaaggagaaacatagtcaaccttataccgcagcaacgactcgaaatggctgacgaacaaattcaacagaatggccctacaaacattggtgctggagatgcaccacgggaccaccgtcaaaggaaaggaattgcacctcctgctatccagaacaacaacttcgagattaagagtggtcacatctcgatgattcaggggaataaattctatggtctgccaatggaggatccactcgaccaccttgatgaattcgataggctctacaacctaacaaagatcaatggtgtcagtgaagacggattcaagctccgtttgtttccagtctccttgggcgacaaagcacacatctgggagaagaatctgccccatgactcaatcaccacctgggatgattgcaagaaagcttttttatcaaagtttttctccaatgccagaactgcaagactcagaaatgagatttcttgtttctcacagaagactggtgaaagcttctgtgaagcatggtagcgtttcaagggttacaccaaccaatgccctcatcacggctttactaaagcctctctgctcagcactatttacaaaggagtctaccacgcatcagaatgcttctggataccgccagcaatgggaatttccagaacaaggatgttgaagaaggctgggaattggttgagaacctcgctcaatcagatggcaattacaacgaggactgtgataggaccgtcagaggaacagctgactctgatgacaaacacaggaaggagatcaaagcgttgaatgacaagctggacaggattcttcttagccagcagaagcatgtgcacttccttgttgatgacgagcaggttcaagtccaagatggggagggtaaccagttggaagaagtcagctacatcaacaacaatcagggtggttacaaacgatacaacaacttcaaaaccaacaaccccaacctctcctaccgcagcaccaacgttgctaatcctgaagatcaagtgtatcctccacaacaacaacaaggtcagaacaaaccttttgttccctacaatcaaggtttcgttcccaagcaacaatttcaggggaactaccagcaacaaccacctgggtttgcacctcagcaaaaccaaggtcgtactgctcctgatgctgaaatgaaacagatggtacaacaactgctacatggacaagcatctagctccatggaaattgctaagaagttatctgaattgcaccacaagctggcctgcaactacaatgaccttaatgcaaaagtggaggcgttgaattccaaagtcagatacttagaaggacaatccgcatcttcctctgctcccaaagttacgagacttccaaggaagtcaattcagaatcccaaggagtatgctaatgttcatgctatcaacataaggagtggaagtgagttatccactcgagagagacccaagtcagtcactgaggacagtgcataccaagatggggaggatttcagtctcaataaagatcaagctgacaaacaactcgagcagccactcgaccagtcactcgagcagccactcgaccagttactcgagcagccactcgaccagtcactcgagcagccactcgaccagtcactcgagcagccactcgaccagtcactcgagcagccacttgaccagttactcgagcagccacttgacagtactcgagagccactcgactagtcactcgagcagccactcgacctgtcactcgagctgccactcgaccacttcactcgaccgaccttcccagcaatatcaccaactgctccgaaacatgttgctgtcaaaaacaaagaaaaagtcttcattcctcatccttacaagcccccactttcatttcctagtcgacataagaaagagttagaagaaaagtacagagctatgtttgccgagaacatcaaggaagtcgaattaaggatacctgttgctgatgctctaacgcgtatcccggattcccaaaagttcctcaaagacttgatcatggagagaattcaagaggttcaaaaaacaacagttctaagccatgagtgcaatgccatcatacaggagaacgatgtcccagaaaagccaggagaccctggttcattcactctaccatgctccctaggttcattgactttcaatacatgcctttgtgacctaggagcatcagtaaatctcatgccactcgcagtagctaagaggttggttttcaacaagtataaatactgcaatatctccttgatcttggctgataggtctgttagactacctcatgtgttattagaagatttgcctaacaagattggaaatgtggaggtgcgtacagacttcgtagtgctaaacatggatgaagaaccaaaagatcccttgatattaggaaggccttttttggctacagctggagcaatcatagatgttaagcaaggaaagattgatcttaatctggggaagaatttggaaatgaagtttgatatcaatgatgctatgaagaagccgacaatagaagaacaaaccttcttagttaaggaagtggaacagttagctggtgaactgctagtggaacttgaagaagcaaataattcaaaaactgttttgaccaagagtggtaaaggtgggtatctccctagtgaaactttgagttctaagaagtcattagactcacacaaggcagcagttggctcagaggcttacaagggcttgatggggtctggcacaaaggttatgaaagctaatgaagtaagttcaacacatgctcgaccaactaattccactaacaactcgaagaagcctccaacttgtcctgagagatcatgctcgaccaaacaactcaaggcaagcacttagatgtcaaatgattggttagaactcaaggagagatctaaatggcaagaaaaagccgtacaagagctaacacatattgtgaaagagctaaaggatcaaatcaaggagctcaatggaaaagcaaaccaagtactactcaacatcaaggacgcccctgacgatggcgccactatacttgttagcaaagaaggatgtgaattcacgtcggaatggtctagaggagaagactatcttgataaaaaagaagcttactgtgaggacatgaccactgagtacccaattgcagacatgtcaagaaaccctaatgagtatgatgatcacgctaccaaagaaggagaggagacctcatttcctctctacaacccaccctaagcctaatgagtatgagaagtcaagcttagagacttaaaacaagctcacttgggagcaaaacccttgtctatctttgtacatatctttatttttccttgttgtttttgatgcatttggttagtgttttcaggagataagtataaagagctgagtgaagtggattctggctctgagagtacaacactatactcgaccacagagcaatgaaggatactcgaccatgttttagcttatctacggcaggagatcactcgactgtggtgctggccgcagcagaacaatggaggtcgagtatactcatggcggtgctggccgccagagagctgatgaggtcgagtacccacctgctggagctgatacagaacaaggtggttcgtctatggccttggagcaatcacaggcagccattgacgagcaactacgttcattcttcgattgaggtacgcgcctcacttcaccattgtattataccatctgttgtgatttgtttcttcattttttgtttctgtgatttgatttgtcctgagtactctcttccaagtttattcacacagtggactgtgtgatttaagtttaggggagggctcaggaagtgtgtgttgcattgtgtatatttttgagtctgcattcatctaaggcatagaaaaacaaaaaaaaattgaaaaatttcagaaaatgatttcacaaaaaaaagagtgttcatgtagttgcatcacatttaggatcgagtctagagtgtttcatttagacttgttgcatatgcataggggatgatgatgagatagccttgtaagcattttgattcaccggataaactcagtgccctcgttgctagttgtttgttgcgtagtcaatgaatttgaaataaaactgaaccacgcctagattgctctactcgaccacactgtcatgatctgataccattccctatcaatttgaacctgaatctaatctttaattatcatgtctgcatcaaatttgaactcatggataccctaaaatacttggattttcttattcattttgatcactcttgttaatccaagtagctgactctccttattagagcagttaacccaaacctagactttctttcaagccctatatcacttgtgagtgtttgtgaggtcttattccgattaagcttggtagaaagtgttaggttcgtaacgacagagatagtgtctcatgtagttctagttcgcatttttcggactagataggactaggtgggcgcttatactttgggctgggatgtgtttaaaagaaaaaaaggggttgattcattgatgagaaaaggtaaaggactctaggtgaagtaagctaaagaagcagaaaaagtctagtaaaggttttgggatttgtaaagaaaagaaagagttcttgttagctattggagatgggcaaaagcccttggttttaaaatgttaaaaacaggaaccttagttgttaaagaaatccaaatccgctagatgtaacaaagtgttgagaaagcttctcctagagttaagagaaaagaaaagaatgattagaaaaagggcttaaaagattcatgaatacaaagggtagagttaagttcttatattgggattggagatgggattaccattagagcttcatttaacatactctgggtagatgggatcttatctctgtatgcatagcttgggacttacctttagcattctactcaagcttaattattttttgagagatcccctgttactgaagcctattctataagggaccatctttgtctcttgaccttttaccttagccaaatgagtttttttgatgatgcattgcttgattcacgttccataactaatgaatgttaaagggagtggtagatttgaaaacttgtgtaggtcgagcatatgagtcggattgattgattgatgaggcatggctaacgtttttaagtagaattcgatcttgcagcttagaacttttaacttggacatttatttcatctggtctatctggtgttttggctctaagtccccggtttcaaacctcacctccagcttgttcttgattgtttgcttgagggcaagcaacgactaagtttgggggagttgataagtgtgtattttgcatgttttgagcatccatttgtcatcattttagcatcatatcatcactgttttataccatttcacatcatctgtcatcactttgcatgtttaggatagttttgcatgcatgttgcatatttgtgttgttttcaggtgatttggagctgtcgacgagctaactggaagaagcggacctgatcatgacaaaccactcgacccagaggtcgagtaggagcttcaagatatcaagagaccactcgacccccaggtcgagtagaagacaccaccactctatcacatcactcgacccccaagtcgagtttcttcatctccatctcttgaccaccactcgatcacctcactcgacccccaggtcgagtgacttcatctccatcttctgaccatcactcgatcacatcactcgacccccaggtcgagtgacttcatcccattgtcagatatctactcgacctcgtcactctaccttgaactcgagtatcaccatcacaccactcgactgcatactcgatgacaagcttcagagccttcttcattccgcactcaaccagacactcgagcacaaggaagaaaagaagactccagctattcacttgacctcccacttgaccatataggtcgagtacaaatcttaatctgttccaatactttgtcgttttgagtattagggtttcaaaatatttggctataagtagcatgtacttcacattttcgcagacaagaagttgttttatctagttttatttccgcagaccttgtgttctagacttttgtaatccggatttctctttatctattcagtattcagtattcagcttttattcttgatttcgtttactattgttcattctgttatcatcctgctgttacactgttgttatcatgtcttcaacctgttcaacgtttatgctttctgttatgatgtctgagtagtgaataggtttctgaggatgggttagagtagtgtaggattctcagtatgctaggtgattgagtattgattgatagatcccttctggattagttgttcttaatgcctattgctttttgatcaactggaatttgagcccagatatttccgcgcccaaatggtgttcgatgaaatgtctgaaccactaattccagagattcgtgaccctgtaccaaggtattggttgcagggagcgttttggctttaacttgttgattcgtaatgcttgttaggttagctctcgtcaatggtgattgagtctgggactaggttaacttgagggtctctgttgcggtggcacttagatttggttaatgaacttgttgtctagggttaatttattgagcatgtcaatcacttgtaaactgagaaaatgaaactactcaattaccccatcctcgggaattctttatctgattgaattctttgtttactctactgttgtttactgcatcttgttatctgtcgcttaatttctgcacttctttcttgttactcgacctcatactcgaccacctagttgtatggcaacagactgtgcagtcgagtatctgtgtttcattttctgtctgttactcgacctgtcattcgagctcacccagtgctctgcatagagctgtgttggtcgagtgttttactgtttctgtttgattttttgttttctgcatgttcacttaggactgctagaacacaccaaaacctgttattgcttggcttgacttagtgacttctgatcacatcttgattgttagcatcacacccatttggattgacaacctaaaatactacaacgatatgattggtgttttaggataattgactaaaaacctattatcaatgatctaaagactagctctagaaaaaatgcaaacaaacacacaattcgaccacaacacatagattcggtaattcggaaggtttctgtgtcttgggcaaaattcctcgatcacggtcgacgatcccttactcatggtcaagttgtctcgcccacaagcgatgattctccagtattggacagagtttcctcgaccacgggcaagatttattgaatttgggcaagttttctcggttgtggacgagttatttgttgggcagccttacactctctctcttgccttcaaaaaagaaaattggtggagaagagcatcatttatagtccacccaaggtcagctatgcagcattgtcccctgccacatttccggacaactgctgcgcccccatgcgacaggtgtctcgaacaatggcgtggcgacagttggcgacgggtgtcactccaccgccctatcagcttcggctacaagactcagccaactttggctctaaggttggtgacttgagctgtaaggcactgcgagtgaggtgtccactcatgtcggttccgcgggcgacggggcaaacttcactacaacatgcccaacttttcccatcttcgcccattcgtgcccattcctgcctccattcctgcccatctttgccctttgatggtttggcaccttttgggcacatacggtcaactagccatgcattcgggcaacattttctcattcggtcctttggccgtgtccgatgcccttatgcgggtcactagaggtaatctcttgtttagtcaggtggttaagattaggtagatccctttttaattcgttcgccctaatgcttatttcactcagttaagtttggaattcgacccaaggtattccagtgtccaaaagacgttcaaatggatgcctgatctacgaattctagagattagtagactctagcctatagtttgaggtagatgacaaaaacaaagcatcgacttcgaatgctgaaccgacgatgaaggagcatgttctggagcctcaccaataaatgttcctgaactcgtttcactttgcttttattttaatttgaacttattatatgctccggcccatttataatttatggaaacttttgctattttcccaatctcgaaatattcattttggagatactctttaaatgcagggctgattggaaggcatgaatttttccgcgaatcactccgctccaggatggaaatcgccaacctcaagggataaggtttctttataaattggcactgtaattttctttattcctcaccattctatttttttccttggcagatatggaattcaaccttcggtgctcggaatccatgccagatttctcgagggtcgaaatgatggacggtgaaattctgattgtgccgagtaggcggccttctccatcttgcggcttcttcaggtcccaaattcgagctccgtgtgctctgatcaaggatctttcggatagagaccaagaaatcttgatggcgttcatataggtgcttgcgattcaacatcagaagcgtacgctggagaggaggaaactcgagaaactgattcaatgaatgcaacatagggtgaccgtgattcaagggaactttataccctcaactcccagtttagttacccgcataacggcatcggacacggccaaaggaccggatgaaaattttttgcccgaatacaaaggcaatcgaccgcgtgtatccaaaaggtgccaaaacattaaagggcaagaacgggcaagaatgggctcgaatgggcaaagatggaaaaagttgggcgtgccgcggcgaagtttataccccgtcggctgcggaaccgacatgagtaggacacatcacacgcagtgccttgcggctcaagtcaccaaccttggagccaaagtcaactgagtcttggagccgaagttgatggggcggtggagtgacacccgtcgccacctgtcaccacgccgtcgtccgagacacctgtcgcctgtgggcgcagcagctgtctggacatttggcagcgggcggtgctgcatgggcgaccttgggcggattataaacagagctctctccgcccagtttcatttttgaaggcaagagagagagactgaaaggctatacgattataaactcgaacgaaactaagaaaaactcgcctgaatcgattaaatcttgcccgtggtcgaggaaacattgtctgagactagaaaaaattgcatgtggttaagaaaacctcaccgtgagtaagggatcgtcgaccgtgcttgagaagttgcacgagacccaaaaaactttcctaactactgaatccgtgagttgtgctcgaattttgtgtttgtttgcatgttttctagagctagtctttagattatatgcatgcttactcacttagacttaactaattgaaattcggcttgagttagatattgaatctcaaagttaatattggcatttgacgaacttgataatactatcactaaggaatggaatggactggtgaatgactaggctaaatgaatatggacttaactaagtttacttgattaattgagatatgattcgagggcttacttgcgttgttagattgttatacttatatgagatatgctatgagcttgtgaataaatccttgctatattatgtatatatattgatttggtgcttgattgtctatacttgtttggggcatggtaaagtacttatatatagtactacatgaggttattgtgtctaagtggtatttagggtttactcgataccatcatgcttagagtaagctgatgccttcctttatgtgtctgtaagtcttgatcctgagtggtctcttacatgatggcacaagactcggagcgtatgtcgggtaaagcatgacgatgcattaaagtgatgttccggttataagcctttgtggctatagctcgggtgttcacagttgtgtacgtacgtgtggtgtgggtgtgcacgtacgtgtgtttggtagcatacgtgtggagaacacgtatacacgtatgcgggagtttgtgttgatgttgtggtccaccttttttgtaaggttggcagtatgttgggcccaaggttcattcatgtgtctagtttggctgcatattctggtattattataagtatatgataatacgtttattacgtgctttgtgatctttgatggataagtttacctattaagttgattaaaccctagagatttatttgtgcatagacccagctcactgagtaatcttagattactcatgattctacttgtcttacaggtaaccatagtgggatgaccatagcgggaagacgaacactaggaaatgccggaaataggatgttttacgttgcttctgcaaaattacttgttattatgtaaattttaacaaggatctgatataaagatatatttttgggtaactctttgctaagtataagctatatactatgcataaagtgttttcttaaaggcagccgaatgtttaatgatataagacctagtctgtgtcgctcaccactagaatatcacgagggttggcaagcctaagtggtgttcctagtaggaggagggtcgattataatttggttaaggaaccaaattcatttggaacctctactaagttgtggtcgatcatcttcactgtagcgtaattgggtcgttcatggcttgtccggccatagggcgattcgggggcgttacacccaccccgatgattgggccgagcttggaatttctgaatttgcacgcaaatcggacctcgctggtcaaggagtccaagtgttctgcacgttaagaagagtttcctgattcgaagtgcacacatgataaaacttcgtctcctttgcttattacttgaataaatgtcgctttgtttcctgtctttacatgttcacatagccgaactttactttccttgttcgttcaaacagtcaaactctttttcttttaatgacaaaataaaaaaaaaaatattagtagctgaactcgtttccgagcagcctacgtatccatttcgggatcaagccacaccgtagttcatgtacataacaaaaaatgcgtgttacttaaacataaaatatgtttagatttcaccacattccaaggacgctggactggcctgtcttctaaatgcttctcgctactgttttctttaggcgcgctgggcttagctatggttgaaccttttgacttcctttgcttgaacggtggcaattctatctcaagctcaccacgattacgtgccgcagctcgagaccttgtaatgacttaaatttctttctcctctttattgctttgctccgaaatgccttctaccggaatgactcttttctccttaggatgctgactcggcttttgtactctatatcatactcgcttagctccactgcccattttgccaatcttccgtactaaattggaccatgaagaattgttcgaagtggctggttggttaacacttcgatcggatcagattggaaatatggatgcagctttcgggcagaggttaccaccgcaagtgcgagtttttccatcattgcatacttggttttggaatctgtcatggacttacttatgtagtaaattggtttttgttctccacaatcttgcaggatcaagactccgctaactgcatggttcgacaccgaaacgtacaaatatagcttttcatccacttccggtttgaacaatacaggtggcgtggtcaagttcgctttaagctgtccaaatgcctcttcacatttcttgtcccaaaggaatcctttgtttcctttcagaatctgatataaaggtaaagacttgtctgttgatcttgaaataaaatggttcaaagctgcaatctgaccggttaaccgttgtacttatttgaagaactttggagatgacatgtttaagaaagcgttaatttggttcagattggcttcgattcctctttttgtcacaatgtaaccaagaaattctccggatgggactctgaatgtacatttcgccaggttcagtttcatttgatattgattaagaatttcaaaacattccttcaaatgcctgatgtggtcttctttcttcaatgacttgaccaacatattgtctatgtagacttccattgtttttccaagatgctcgtagacattttattgaccaaccgttggtaagttgctcctgcattctttaaaccaaaaggcattaccttataacaataaatacctctatacttgacaaatgacgttttttcctggtcatcaagatttatcattatttaaatataacaagagaaggcatccatgaaagttaacaactcgttccctgtagtagattccacgaggcgatctatatgtgggagtgagaaatatcctttgggcaagctttattgaggtctgtgaagtcgatgcaaaccctgtcttttccattcttctttttcaccacgacggtatttgccactaactctggataaaggacctcccttatagaccttatcttcaaaagtttgtctacctcgtcgtttaccgccttcgctcattctactccgagagttttcttcttttttgttttacaggcttgaagctcggatccacgttcaactcgtggcaaattatgcttggatctataccaggcatgtctgcttccgaccacgcgaacgatgttttctttttcctcaaaagttcaatcaaggcttcttttattttttcagttaaagtagctccaattcgaactgtctgatctggtttatcttcttctagtactactttgatttcgacgtcatccactttttgatctcggggattattcattttttcgcggggttnnnnnnnnnnnnnnnnnnnngcttcaattctcattctagacagatgatcagctacaccgttttcaattcccttcttatcaacgatctccatgtcaaactcttggagcaataagatccatctcaacatcctaggtttggtatccttcttcgcatatatatgcctcagagcagcatgatcagtgtagactatcacctaagagcccaccaggtagcttctaaatttcttgaatgcaaataccacagctagcagttccttctctgtggtggcataccttacttgtgcatcatccatcgttctactcgcgtagtagatcacatgcagctttttatcaatccgctggcccagaactgctcctactgcataatctgaagcatctcacatgatctcgaatgggaagtcccagtttggagcttggactattggggcagtgaccaaagcttccttgattaacttaaaggctgtcaaacattcttcatcaaatgcgaactcggtttccttgcacagcagtctggtgagcggtcttgccaacttggagaaatccttgatgaatcttctgtaaaatcctgcatgtccaagaaaactcctgatgtccaagaaaactcctgatgtccttgaaagtatttggtggctgtaactgcatcatcacgtcaaccttagccttatcaacctctattccctcctcagaaattttgtgccccaaaacgatgccttctttaaccataaaatggcatttctccaagttcagcaccaggtttgtctcttcacatcttttgagtaccctgcataggttcgacaaacacgaggagaagaaagagccatacacagaaaaatcatccatgaatacctccaccatctcctctatcaaatctgagaaaatggaagtcatacaccgctgaaaagtagcaggtgcattacagagaccgaaaggcatacgcttgtaagcaaaggtcccataaggacaagtaaaagtagttttctcttggtcatttgggtgaatagggatttgaaaaaatctgctatagccatccaagaagcaatagtaaggatggtttgctaatctttctagcatctgatcaatgaagggcaatgggaaatggtcttttctagaggcagcatttaacttcctataatcaatacacatcctatgtctagttatagtcctagtgggtatcagttcatctttataatttttaataactggcatacctccttttttaggagcgcagtgaactggagataccgaagtgctatcagagatagggtaagtatctcctttttcacaacctctttcaagtttgggtttaatctcctttgaggtttaatgctagagtaggattcattttcaagatggattatatgggtgcataaggtgggtgaaatccccttaatatcatctaacgagtatcctatagctctcctatacttcttgagctcagttatcagcaggtttacttgatcagtagttagctcgtcattcactatgacaggataagtagagtttagtccaagaaaaacgtaccttagcccttttggtagcgttttcaaatctactttgggtgccttgagttcagaccagtcatcggatactaagttggcttcagaggaggggttgtgatcgagtagttcggtcgagtacactgaatggtctattggtcgagtgatgtggtcgagtatattgataagtgtgtattttacatgttttgagcatccatttgtcatcaatttagcatcatatcatcaatgtttcataccatttctcatcatttgtcatcactttacatgtttaggatagatttgcatgcatgttgcatatttgcgttgatttcaggtgatttggagttgttgacgagctatctggaagaagcgggcctgatcatgacaaaccactcgaccccaaggtcgagtaggagcttcaagatctcaacagatcacttgaccccgcggtcgagtagaggacatcactacttcaccacatcactcgaccccgaggtcgagtgtcttcatcccatcacctgaccatcacttgatcacatcactcgaccccgaggtcgagtgtcttcaccttcattgccagaccactactcgaccttttcactctacctggaagtcgaatatcaccatcaccaccactcgactgcatactcgatgataagcttcagagccttcttcattccacactcaatcagacactcgagcacaaggaagaaaagaagactccagttattcactcgacctcccactcgacctccggctattagggtttcggaatatttggctataagtagcatgtacttcacattttcgcagaccagttttcatctagttttattccgcagaccttgtgttctagatcttttgtaattcagatttctctatatctattcggtattcagtattcagcttttgttcttgatttcatttactgttgttcattctgttatcatcctgctgttacactgttgttatcatgttttcaacttgttcaacgtttatgctttctgttatgatgtctgagtagtgaataggtttcttaggatgggttagagtagtgtagaattctcagtatgctaggtgattgagtattgattgatagatcccttctggattagttgttcttaatgcctattgctttatgatcaactgaaatttgagcacagacatttccgcgcccaaaaggtgttcgatgaaatgtctgaaccaaggtattggttgcagggagcgttttggctttaacttgttgattcgtaatgcctgttagattagctttcgtcaatggtgattgagtctgggactaggttaacttgagggtctctgttacggtagcacttagatttggttaatgaacttgttgtctagggttaatttattgagcatgtcaatcacctgtgaacttgttgttgaggaaacgaaactactcaattaccccatcctcgggaattctttatctgattgaattctttgtttactctactgttgtttactgcatcttgttatctgtcgcttaatttctgcaattctttcttattactcgacctcatactcgaccacccagttgtctggcaatagactgtgcagtcgagtatctgtgttatactttctgtctgttactcgacctgtcactcgacctcacccagtgctggcaatagagctgtgttggtcgagtgttttactgtttctgtttgattttctgttttctgcatgatcacttaggactgctagaacacaccaaaatttgttattgcttagcttgacttagtgacttctgatcacatcttgattgttagcatcacacccatttggattgacaacctaaaatactataacgacatgattggtgttttgggataattgactaaaaacctattatcaatttggcgttgttgccaattgggtgtttgtttgttacatttgagatttcagacttgcttagatcaagttcttgttcaattttcttttctgttactaactgtgtgtttttcttgttgtcttcttgatccaggtacacctctactgtatgcaaactcgatcaacaggcaatcagaacctccttttcaacgacaacatcgaccgcatagctcgcgaactcagagaaaggaaaaacacagtcaaccttgtaccttagcaaccactcgaaatggctgacgaacagaatcaacaaaatggccctaccaacattggtgctggagatgcaccacgttatcaccgtcagaggaaaggaatagcacctcctgctatccagaacaacaacttcgagattaagagtggtctcatctcgatgatttaggggaacaaattccatggactgccaatgcaggatccactcgaccaccttgatgaattcgataggctctacaacctgacaaagatcaatggtgtcagtgaagacggattcaagctccgtttgtttccattctccttgggcgaaaaagcacacatctgggagaagaatttgccccatgactcaatcaccacctgggatgattgtaagaaggcttttctatcaaagttcttctccaatgccagaactgcaagactgagaaatgagatttctggttttacacagaagactggtgaaagcttatgtgaagcatgggagcgtttcaagggttacaccaaccaatgccctcatcatggctttactaaagcctttctactcagcactctttacagaggagtcctaccacgcatcaaaatgcttctgcataccgccagcaatgggaatttccagaacaaggatgttgaagaaggctgggaattggttgagaacctcgctcaatcagatggcaattacaacgaggactgtgataggaccgtcagaggaacagctaactctgatgacaaacacaggaaggagatcaaagcgctgaatgacaagctggacaggattcttcttagccagcagaagcatgtgcacttccttgttgatgacgagcagtatcaagtccaagatggggagggtaaccagttggaagaagtcaactacatcaacaacaaccagagtggctacaaagggtataacaacttcaaaaccaacaaccccaacctctcctaccgcagcaccaacgttgctaatcctcaggatctagtctatcctccacagcaacaacaaggtcagaacaaaccttttgttccctacaatcaaggtttcgttcctaagcagcaatttctggggaactaccagccgccaccaccacctgggtttacacatcagcaaaaccaaggttctgctgctcctgaggctgatatgaaacaaatgctacaacagctgcttcacgggcaagcctctagctccatggagatggcaaagaagatatctgagttacataacaagctggactgtagctacaatgatctcaatgtcaagatggaaacactgaataccaaagtccgatacttagagggacattctgcatcttcttcagctccaaaacagacaagccaactaccatgcaaagcagttcagaatccaaaaaaatatgctcatgctatcacactgcgtagtggaaaagcacttccaactagggaggaaccaaagacggtcactgaggacagtgaagatcaagatggggaggatttaagtctcgagaaagatcaagctgacaaaccactcgagcaaccactcgatctgccactcgacaactttactcaaccaacaactcgacctatcttcccagcagcatcaacaactgctccaaaacaagttgctgtcaaaaacaaagaaaaggtctttgtccctcctccctacaaaccacagcttccatttcctggccgtcacaagaaagctttggcagataaatatagagctctgtttgccaagaatattaaggaggttgagttgcggatacctcttgttgacgctctagcgctaatcccagactctcacaagtttctgaaagacttgattgtggagagaattcaagaagtgcaagggatggtggtattgagtcatgaatgcagtgctatcatacaaaagaagatcattcctaagaagcttagtgatcctggttcattcactctaccatgctctttaggtccattggctttcaatagatgcctatgcgatttaggagcatcagtcagtctcatgccgctctctgtcgccaaaagattggggttcactcaatacaagtcctgcaatatatccctcatcctagctgacagatcagtaaggatccctcatggtttgcttgaaaacctcccaatcaggatcggtgttgtggacataccaactgactttgtagtcgtggagatggatgaagagcccaaggaccctttgattctagggagacctttcttagccactgcaggagctatgattgatgtcaagaaagggaagattaatctaaatcttggcaaagactttaggataacctttgatgtcaaagacgcgatgaagaagcctaccatagaagggcaactcttttggatcaaagaaatagatcagttagccgatgaattactggaagagctggcagaagaagatcatcttaacagtgctttaaccaaaagtggtgaagatggttttctgcatttggaaacattgggatactagaagctgttagactcccataaagcgatggaaaaatcagaacgctttgaggaattgaatggaccagcaacggaggtaatggtaatgagcgaagaagggtcaactcgagttcaacctgcactctcgaggacgtactcgaccagccactcgaccttgtctgccaacgaatctggggagccgatcattccaactttagatgactggtctgaacttaaggcactgaaggttgatctcaaaccacttcctaaaggtctaaggtacgcattccttggtccaaactctacttaccctgtgatcattaatgctgagttaaatagtgatgaagtgaacctgctattatcttagcttagaaagtataggagagcgattggttattcattatccgacattaagggaatttcacctagtttatgcaaccataggatccatcttgaaaacgaattctattctagcattgaaccacaaaggaggttaaatcccaatttgaaagaagtagtgaaaaaataaattttgaaactgcttgatgctggtgtcatctaccctatctctgatagtacatgggtttctccagtgcattgcgtccctaaaaagggtggaatgatgttgtcaaaaatgaaaaagatgaactgatccctactagaactataactggtcatagaatgtgcattgattataggaagttgaatgctccatataggaaagatcattttcctttaccattcattgaccaaatgcttgaacgtttagctaatcatccatactattgctttcttgatggatacagtggtttctttcaaataccaattcaccctaatgatcaagaaaaaaacactttcacatgtccttatggaacttttgcttataagagaatgccatttggtttatgcaatgctcctgcaacatttcagaggtgtatgacctctatattttcagacttaatcgaggagatggtggaggttttcatggatgatttttcggtctatggcccctctttctcgtcatgtttgttgaatcttggcagggtattgactaggtgcgaagagacgaatcttgttctcaattgggaaaagtgtcatttcatggtgaaggaaggcatagtgctggatcacaagatatcagagaagggtatagaggttgacaaaggaaaagttgaagtgatgatgcagttgcagccaccaaaaacggtgaaggacatcagaagtttccttggtcatgctgggttctacagaagatttattaaagacttctccaagatagccaggccgttaactagactattgtgcaaggaaacagaatttgaattcgatgaggacagcctcaaatcctttcaaaccatcaaggatgctttggtatctgctccggttgttcgagcgccaaattgggactatccatttgagatcatgtgtgatgcatcagattacgcaataggagctgttttaggccagaaaatagacaagaagcttcatgtcatatattacgccagccgaacgttggatgacgctcagggaagatatgcaacaactgagaaggagcttctagctgttgtatttgcatttgagaagttcagaagctatttggttggatcaaaggtaactgtctatacagacctttgaggcatctgtatgccaagaaggatactaaaccaagactgttgagatggatacttttattgcaagagtttgacatggagatagtagataagaaaggcattgaaaatggtgcagctgaccatctgtcaaggatgagaattgaaaaaccccttcccatagacgattcaatgccacaagagcagctcatggttgtagagttcttcggaaggagctacagtgggaaagagttccaccaactgaatgctgttgaaggagaatctccatggtatgctgatcatatcaattacttggcgtgcagagtagagcctcccaacctgacaagttatgaaaggaagaagtttttcagagacatacaccattactactaggatgagccttatctttacactctctgtaaagataagatctacaggagatgtgtcttagaagatgaagtggaaggtatcctgctgcattgccatggctcagcatatggtggtcacttcgcgacgttcaagacagtgtccaagattcttcaagcaggcttttggtggccaacaatgtttaaggacgctcaggagtttgttttaaagtgtgattcatgccagagaaaaggcaacatcagcagaagaaatgagatctttgatgtatgggattgattttatgggtccattctcatcttcatacggtaataaatatatactggtcgccgtaaactacgtatcaaaatgggtcgaagctattgctagtcctaccaacgatgcaaaagttgtgctgaagctgttcaagaccataatcttcccaagatttggagttcccagggtagtaatcagtgatggcgggaagtatttcatcaacaaggtttttgagaacctcttgaagaagcatggagtaaagcacaaggtcgccactccctatcatccacagacaagcgggcaggttgagatctccaatagggagataaaaacaattctggaaaagactgttgggattacaaggaaagactggtctgcaaagctagatgatgcattatgggcttactgaacagccttcaagacccccattggtacaactcctttcaatcttctctatggaaaatcatgtcacctacctgtagagctcgagtacaaggcaatgtgggcggtaaaacttctgaactttgacataaaaactgctgaggagaagtgattaatccaactcagtgacctcgatgagatccgtctagaagcttatgagagctctaaaatctacaaggagagaaccaagcttttccatgacaagaagatcatcactaaggatttccaggctggagatcaggtgctgctgttcaactctcgcttgaaactctttccaggaaaactcaaatccagatggtctggccccttctgtatgactaaggtccgtctttatggagcagtcactctagctggtaaaagtagagacttcacagtaaatggtcaaagactcaagaaatacttaacagatcaaatccttccagaggtgacatcggttcatctccaggaacttcttgatgattaaaggagtaaaggagtcaagcttatgactttaaacaagctcacttgggaggaagtcccatgactatctctgtaaatatttttttttattttcttgttatttttgatttgtcttggttgtgtttgtgattctcaggaacgaaggaacaatgtggagatagagtaaaaattcaaaacttttactatatagaagacctggagatcgagtgtataacccgttggagtacaaaattttgaaaatcttctattgcacctagtgaccttacactcgagtacgttggtcgagtatgtgtgatgtttaaaacgcaaaaaacttttaaatcatcattttacttgacccacaaaagctacagagacttgtagggatttcctgcagtctaaagtgggttttctgcaaaattttcccagtcaacagagtgtggaccacgcactgaggataagatggagagagaatctcaaactcaatctcagccattcctttttacatttcactcgaccttgctatcttctgttatccaccactcgatcaaaacaaattactcgacctaataatccttagccactctcgacctccgccgcttcagcagaattcaaggaaccactcgaccaatcgatctacttgacccccgggaatcactcgacctccgccgccgtcatcatttcgttctatccgtcactcgactagactagatcaatcgattccttttggctatagtcgaccaattcacccgtctctttcaaaagaagctactcgacctcgttacccagtctcctagccgcactcgaccgacgccgcctcagccgatttcaacaattgactccaccgccgtgaatcactcgacctttccagccgagtactcctcctcgttctccgtcgaattctcagggttcaagatttcactcgacctcgagttttaactcgacctctacaactgcaactcgacttcttgaaatcaacagagccctgaagcactgtaatagaggttactcgacctgaagacttcaccggcagaactcgacatccacaactcactcgacctccaggaacagctcaggttactcgagtacagaattgtactcgatcaattcaatctatttcattgcctattgataacaattttggtttcattgctatctttgagactaacctattgacatttgagctttgagttctaaatttctaccggagaatcatgaggaattacagtggcagttcttctggttatcctgactacaacatggatgagacagagtcgtcatcttcaaggccagagagagaacagagagaatatgaaagcttcagaaggaaagctgagatagcccgagggaagagagcgatgacatagaggtatgagcttatagacgaagatctggaagacgagtacatgcctgaacagactagcagagctaccaaacttctgcacaagccaaacgtattgcctgctgaggaatatgttaggcttttctagctgaatgagttatgtagcacgaggtatccttgctcgacctcacttgcacaactcggtttattggaagatgtttagcacctgtaccaaagttgtcatctggacactctaatggcttattcgtatgtagcgtatgaagatgagacaatacaattcctctccatgctgcaagtagagctctaccaaggtatgacctctgaagagttggattgtgaaggattgggattcttgcgattctctgagtatggtcatgagtataggttatcaatcaagcgcttggaaggattgtttggcttccccagtggaacgggatctaagcccaagtatgatagagaagagttgaaagacttgtggatcaccattggcagctctgtaccgctgaattc

SEQ ID NO: 186 - DNA, 67088 bp, Arabidopsis thaliana
  modified_base (27227)..(64728): N = A, C G, or T/U
ttagtgttttggagtcaaatatgactagatgtcatgtctatgattgactataagaagtagaagcacaaccagatcctaaaagctaaagttgtgtttccatgctagaagatacatagccagatactcatacagacttttatggatgtcggattcacacactcaagtatttatattatttgtgggctaaagctctcaaatacaaaagtacacgacatatatgcataagaaaagtataagagagtatatagaaatgtatgaagaattgtacatagaaaatggtatagtattccttatgtaaagatcttacataaaaagagaagaaataatcttttgtgtatttatgagaaaataacaatgtttaagtttaagatttgtggtcagaatatagaatctctagccccccttatcttggagtcatcacctctcttttatagcctctttccttcttccaatgtgccattaattatagaactaattcataaaataactttcacaatcaattcatacacttgaatgacaactcgccaaaatgtgtatcctaactaatgctcatgcttcatccagctcatgtgcagctcctaattatgaaactgaaactcacgatcaagggacggccactcctgctttgaaccaagacgagattacaccgagtgttgatgaggcttcagctcatcttaactcttttatggctattaccataaaatctggggattgtcccaatttattttatgaatacgactttcccgaaagggaatttttatttgcccaaggggttttaaaatttgttggttgtgtgcccaagaggggtttttaaaacttttttccttttcgttgtccataggggttttggaatgacacttgcttaaagtatttgcttcgaagttgccggatttgcaaagtccgtactttttcaaaaatttgggccatgtggctaagagaaatttgggccatgtggctaagagagaaataggttgatcaaacccccaaactcaatctttggactttctttgattgcgagaattgtgctccgcctaagaagtattaggtagatcgactaaacaccgtaaagatctttgttttgctagttgaccccttgtccaagaggattaaatccattttattgactcaaactcgtcagttcaaccatggagttttggtatcagaattaaactcgagttatgcatgggagctgacctcgagttaagttgttgcgaagtgaactcgactttcgaatcgaagctataagcttgagtttagaaagtgtattctgcttatagaatacaaaggcaggttattgagcagcaatctagagagaaactgaagatcttcttccgagcttgtactcaaagacttcgtcataaatgcttgttgatgtgaggtggtatctaaatttgtgaagagcgatctcaacacttagatttcacagagatttatttttccaagagttggaacttggaaaaacccttcacgagatagttcagtgaagagcgaactcaacacttatagtccaccaaaataatcttatttttccaagagttgaaacttggaaaaaccttcttgggatgagatctagtttcgtgaagagcgaattggacacttgaaccccgccgaaattaaccaatattcccaagagtttcaactatgatctggtgagacatagataaagtcgcagcttccaagttgaagtgactacatcaatcgcaagtttctccattatagtgtaacttaattttggactggttgatgacttgctcatgtaacaaatcggctttcactctcttctgtcttcagaaattattactccattaacggcatgatttgaaaatgagatgtataagtacaatttttcatcggcttcaggcttcagagaattagagcaacacttaagtatgtctttagttgaccgaaagcatcttcacatctttcatccaactcaactctttgttcccttttagtatttgatagaaagaaaggcatttatcggctgactgagatgttaaccggtttaacgcagtaatcctaccaaagagtctttagacatctttgatgttccttggggctagcatgttcgaaaagagcgttaatctgtcttgggtttgcttcggtttctctctttgttgctaagtaaccgagaaactctccggatgggactcagaatgtctacttggcaagattcaacttcatctgaagcttgttcaagatattaaagcattctcccaagtcttaaatgtgaccgctctcttttgacgatttcacgagcatgtcatctatatagacctccaccgtttttcaagatgattatcgttggtatgtcacacctacatgtttagttcacacggcatgatcgtaaaatagtatatacctcggttggtgctgaatgaattatttttcttaatcgttaggattcattgatatatccctatttttaccgtttttaagtatgttttaggtataggctttagagtctaattgttatttatacagttttttctagtctttttcaggtctttacatgttttagatgcatttgaagattatggagcattctggagtaaaacatacaatttaagctgaagaagcaatccagagacgaaaatgcacgtaggtgtcgaacgacaccacccctggtgtcgtgcgacaccaatacctgacggcaattgaaagacgcaacttattgttgttttgaagattttttgaattcggcccaaaactttctcctatgtttaatgaaggcccaacacgttcttaagacatatttatatagctttgaggttaatgtttagaccctaagctttgggaggctattccctttttcaattctgtactttgggagcaaaaccctatggagactccctgtagagaagatccttctaaaccttattctcctcttgttttattcattgatttcttattcaatcatgttttgtttttctatgatcatttttgagtaatcttcttgttaggtttagggtttctcattagggatttagatgatttagtagattgcccccttgctaagttatctgtaggattcttcatcttcattgttcttaatgctagttctagagtacctaactagaatttgatattagataataggtatgcccaccataggtacttgttatttgacctatcatagatgagcctaagcatttaagaaagaacaggtaggctcatagaaaggctgtggtttagatactaggtgaactaatcaaacttgataataatgaatgctttagtataggatttctcggcttttccggtaatcttagctctaagtatagagagttttgcggaacactaccggttactctaaaatcatagtttgagttcgagaacggttccataataatctagctatttctagatctactatcatctattttctgagaataccctaagcctaacgcctttattatcttgttttcacaactcataatgttattgcttactttttgtttcttttattttctttactattttacttagcttaatttgattagccattagtctcctgcgtgatccgagaactttgtgaattcgatccctaagtgctgcaactgacctctttatttgagagagtggtcttaggattaaattgaattatatcaaatttgccgcggttgccgaagttctctgtgattcaccattagactaggtgtagaatttagactaagtttttatttttctttcttttgtttctcacacgttttctttcttctttttcctatgacagggaaactacaagatggaacgcaacaaacagctggcagatttcaacgacagtgtcgatcgacaccctgttggtgtcgttcaacaccatctgttggtgtcgttcgacaccatctgttggtgtcgttctacaccatctgcagaacaaaccagctaccataggcgacttcaacagagctgagcttttctattccaatcgatcagcgatccagctacctcctattgcaagagaagaatttgctattcaccctgcctactattatcttgtttcacgaggaaagtttcgaggtcattttgatgaatcactactagatcatctagaggtcttcgaagacttagtgtcctcaatcaaagcagatggggtacaagctgattatcatctttgcaaactcttcccacactctctcgctggcagaggaacatcatggctgcgacaactagaacccggttcactaaccaattggagtgacacgaagaacgcattcatgatccacttccttgatgattcagtgacaaaattactaagggagaagatctctttgttttctcaagctccaacagaaggtttgaaggtagcttggatcagattcaaatcctatcagagggattgtccacaacatggtttctaggaaagcaaactaatcaacatattcttccgtggaatcgataagcagtatcggttatgttttggtggtgcaagtaatggcaatttcatgacaaagactccaaccgaagcatcagttcttatcaacaacgctgtcacaagtctctccacaaaggaaatagactatgatcgaagaaaatttgctgaggcttccgacaatcgcagagaggaacaaggatctacacgcattgcttctccacctaggaaagatcgtggttgagtttactggcaagtttgattctctctacacagatcttaatgggaagatcgacaatctgagatctcatatatcttagccttctcctacattagcatttatcactgcagtcacactacgaagtggaaagcaactaaacccaattctttagtgtgaacgttcagctcagacctcatctatcccagttgcagaaaaagcctcaatgtcgattgatacatcagggtgtcgatcgacaccaattgatcttgacggctctgtatttcctttatcgtgtggatacgatactttcacagaggaggaggaacttcttcccgatggtgtcgaacgacacccacctcatgtcgatcgacaccaataccacataggcaacccagtgctgacgtttgacagagcaggatcgatgccacacagtagtgtcgatcgacactcacctagtggcgatcgacacaagacttaaactgccccaatatgccttgcatctccacctgttactatacaagtctacacaccacaagttccttgtctactacctcgacagtccaagaaggagattcctgagatgcattgcatgggtatcatggatgagattctacttcagttgcctccagttgatatagagaagttgtcaccctctcttcaaagtgatatgatacgagatgatgctccagagaagcaagatgacaagacaaagataatggttgtgtcataacaggtactcagtaacagcaagcgtccacatgaggccaatttcagattcgttgctgagaatcaatctgtagagatggtgttgatcgacaccatcacctgtgtcgatcgacatcccaaacaggctaaaccagaattgtataatgaagctgctttgcaagttcagatcactgctgaaatttgaggacatgttgccacgtcacccacatcacctctactccttcatctacctcgtaaacggcaaaggtactcatctcctcctcctaaacctcctgatttcatcaacaagagtttacaatttcaaaaaactgttttacggttaagcaagccacgagtttctcgtcgagcacttgttctttctcttgatgattgtgcaggtacaaggagtccaccacccatacctctgtcctgcccagctgacattcctcacttccttggtagaccgcacacaccgactgttaatacgccaccttggttgatgcggggttctactaggcagtatttacttcctccatttgatccacctgatccctaaactccaccaaagtcaagctattgactctaaacaagcgcttagtgcgaggcaacccactagtatggttttctttttcttgttcttttcttttacgttttttttttctttttctcgcttactctgaattcgaatgccattggggacaatgacgtttaagtgtgggggaggcagttactaactacgtttttctttttgagtcttattcttattcttatttttctttttaagtcgttttattgagtcaaaattttgttaggaattatgatctatattctttagattattgcctggttgattaatgctgcaggtttgactcaatccgactattggaaaatctagatggcaaaccaatagacttgaggatatcctagtttccaacaccaccaccaaggctggagctaatctcactgctcttccttttaccttttcaaacggttagtattcatagatcttgactccttttcatacctgatattgagaccaatgtgataaaaagaatgtgttcctctgcccagaaaaaaaaaatgaatgatgaatgagagattgataggattttcagatagtgtataggggtagaaatgtttcttatgatcctattattatacattatttggaatgatcaattacaaaggttggaaaaagtcaagggtgtcgatccagtatgcgagttcccctttgtttactctctaaaaaaataagtttgggagagaaagaacaccaaagaaaaaatattatataagagaccggtcgatttatcacggtatagcacaggaatgagtctagaaggatcttgaatgttaacttgtttgatgagactcagcgatgaaagcctgatagatatagttgtggaacttaggtatggaatctataatgttgtgtaagcttgcggagaagtacaagttggttaggatttgattagacttgctagccatatggatttagttagaatgatcatggcaataggttagagaatattgggagttcctgtgttttcaaacctcttccatgggttcgacttttgtgctttgcttgagggtaagcaaaagccaagtctgggggagttgatatatccctatttttaccattttaactatgttttaggtataggttttagagtctaattgttatttctagagtcttttttagtctttttcaggtctttacatgtttgggatgcatttcgagattatggggcattctggcccaaaacatacaacttaagctgtagaagcaatctggagacgaaaatgcacgtaggtgtcgaacgacaccatccctggtattgaacgacaccacccctggtttcgagcgataccaatacctgacggcaattgaaagacgtaacttattgatgttttgaagatttccgaattcggcccagaactttctcctatgtttaatgaaggcccaacacgttcttaagacatatttatagtttttaggtcaatgtttagaccgtaagctttgggaggctattccctttttctattctgtactttgagagcaaaccctgttgagactccctttagagaagatccttctaaaccttattctcctcttgttttattcaattatttcttattcaatcatgttttgttcttctatgatcatgtttgagtaatcttcttgttaggtttagggtttctcgttagggatttagagtatttagtagatagcccccttgctacgttatttgtaggattcttcatcttgattgttcttaatgctagttctagagtagctaactagaacttgatattagataataggtatgccaccataagtacttgttatttgacctatcatagatgagcctaggcatttaagaaagaacaggtaggctcatagaagggctcttgtttagatactaggtgaactaatcaaaattgataataatgcatgctttagtataggatttctcggcttctccggtaatcttagctctaagtatagagagtttcgcggaacaccaccagttactctaaaatcatagtttgagttcgagaacggtttgataataacctagctatttctagatctactatcatctatttcgtgagaatactctaagcctgacgcctttattatcttgttttcacaactcacaatcgattggtattgcttactttttgtttcttttattttctttactgttttacttagcttaattcgattagccattactctactgcgtgatccgagaactttgtgaactggtcttaggattaatttgacttatatcattcatcgttatttggttgtaactagatgctactttcttccaaattcttcgttcgtgatctttctcatcaatggccacttcgattatgacgtcatccactacttgcccgcttgatattcctaaaatcacttctttcttcacgagatttgttaattggataaccatccgatgagtcgttaaataacaagattttgaagattcttgatctccttgtaaaattttcacaccattcgggattaaatatttaacgtattgacaatagattgatgggataaccttgatccgataaatccatggggctccaactatgtcagcctggctactttccattctctccaagcgtactcaagaatagtagatctatcaaacttccaacatcaatcacaatctttgaaaccccgacgtcagccacgtctaaggtgaggacaaaatcaacgtcatcaggttctgcaaggtgacgaatttcttcttccttgaatgttgtgattgctctagcgagttcgagtttgtcgcttgtgctcgcctttaatagaacattcccctaaactttttgattgtagtggtcgaatctctacaaaacttagacccgttcatgattacttcaatcttcttcttattaccaaaagattagatgttttaggtattttcttagctagtgatgaacttttgacttccgccttttcttcgtggtaaattttcacgaactctccgacgtcgaggttttgcgaggtcacctctttgtccgtagctcagcaagatgcctcttgatatcggtacagtcttttgtagtataattatttactctatggatgttgtcgtatgccttttcatcgcaaccatgttgtcagagatggttgtctcgatcttctcttttccaagagatggtgtaatgccccttaccttgactatgtggccggacgtacagtctatcgagtagaatgcgagatcaagccaaaaaaatgcaagatcagttcgaccatttagtgtggcaagtcatgggtaagaagcattgaattggatcaagtccatgggtaaaggaatgactcaccatgagacggatcaagtttagctacaatgcgacaaatcattagaaggtcgaggggaatccatttggacagtgagatatgtgtatgggtcgtgaatggtcgcgagattgatcggagaatgcggataagtgacgatagctggcttactcggttaattatggcatggaacgtgttatagtcctaaggaaaccttaatttgcgtcatggaccctcaagagacattggaacggaatgtgccgtattaatgttcttgcggtctggtgacagatcgtaggtttccccggaatgaagaaatggacggccaggattgaaccgtgcctcatgtttatccgtaaaggctcaagcttatccatattttggtcatccttatctttttagggtcgtgcttatccatttttggatgatgtttatccgaaaaatggaaggaaccaatcggaggccgattagtgtcttggagcggccgttggtcgacatttttcacgttttgattaatccaggacacctcctgcttgccttggccgacctaatcaccgaccttggaccatataaataccccctccgcccatttgattccttagacctaaaaatcgcctagaagagctaagttcacgggagaaaacattcggaagccaaaccgctcagaaatccaagtgagtcttgagttacgtgaagtagcacgtgaataggatagtttcttcattaatttccttaatatagcttaggaggttaattatgattacgtagcttaattattcgcttaatccttgattaggatagttaatttggtttattaattgttaattaggaatagtgatcattaattacaattagtatttcctaaggatgattagggttagttaaaccatgattaggggactaaccgctattagtaataattaagtgtgattagttgtttgattagtagagttttgcatataggatgaatgcatgatagtatgtgagtctgttgtcatgttagttagtctttaattagatgactagcattagcataaccatgaggatcccgtccgtatgttgtccgttatggcatacgaaggctcgaggctgaattgctaccgaccgggcgctacacgacgatgtagtataaaggaatgctatgtctcttatagactttgtgtctaagagtatggagtcatgtccttgggagatcatggattcgtacaaagccttacctaggttgatagaagcatgcttgcattagttatccgttgaatataaggaaattcgagtctacatgcattctgcatggtgcattatattttgcttgtgttgtatgttgcgtgttatctttgtttatgtcttgcttgttaggtagtattattgttacgtgttgttgctgcttagggggtaaggaagggtattaggataacattgtctagatccggggttcactaagtaatactagattacttatgacgttacttatctttttcaggaaatcttagttgaccaaccttgtagagggtgctgatgacttaggacgaactaatgtaggttttactaagtatattatgtatgtttttttgtaaattcttactaagtatattatgtatggttttcaaagaggatccggaaactatatacgttttggtaaccatttctcgtatgatatatatatatatataagactcggatttctaaaatttatatggttatactgactgatattagtcttgttcgtactatcacaactcacggccgcgatagggttgaaaagccttaggtcacgggcgggaggctagactcttgcggctggacgactcaggcgaacgaattcattttggaaacctggattggccgactgcgggcgtctaacgtgacgctcctatttcgtttatatttatatagcggtataggggtcttacagatggtgtctccacattattgttaaatgggtttaatccaagtggtttgatctctttgttgccctttaactttggtttcctggaagggacagtaacaattggcatagtcggctttctttttcttgcgaagtgaagctaatcttctcgtcttccacttttatccgattgattgctcggaataaagcaggtaaactatggaaaaaactcttaaattccatcgaatgaacacatttttccaagagttagaacttggagaaatctcttctcgatggaatctaatttcgtgaagagcaaactcaacacttagattccaccaattgaaattcacatctccatgaaggtgaataacattggaaggttgtggtatagcatcgaagttgtctttttcaaacttgaatctcttcttgttgacaaatgtcgcattttgactccttgaattttgagtgatgatataaatatggactccaaacttgtagcaatgatttgtcaatcacgttaagtgataatgctgtataattctcctccaaagaggcttgactttgctttatattatttggaagatgcccccacctgtttggtcttagacatctatgcttttcgtcataacattttgtgtaccttaagatggagacattcctgttaaggagtaaacgtgtacaccatagttgaacttatctttgatgcttcatacatgatctgatccaaatgttttgagccaatatgatcttgtcctgtcatggctgtaattgttgaagtcattcgctaatgatttccgaagaaacgccatgaaaacttctctgtatcattgtgtcatggcttgatcgattgagttgatcttagtagactcaaccttgcttctacctagacttgtgctcctactttggaggtgacaaggttgttgtttcgccaccacgagctgtagtcttgttgaggtccaggagttctttggtgaagtttgtgtagctaatgggaaatctcggaacatcatgagacgttgatggcctctttttttttttgtttgcttttacgagtttcttgcttccgagaaaaagtgaatcgccaccgctttaactggaatttgagtccatgacgagttaaatcgatacataaattccatcgaaatgagcacattcttccggtggtcggacatcaaaagcatctttgagggatgaaaatctagcaatgtgaagagcaacctcaacacttagatttcaccaaaatgaatataattttcaagaagtggaacttggaaaaatccttgacggatgaaatctagtcttgtgaagcgcgaactcaacacttagatttcaccgaaatgaatatatttttccaagaggtggaacttggaaaaatctttgagggatgaaatatagtcttgtgaagagcgaactcaacacttagatttcgctaaaatgaatacattttttcaagaggtgaaacttggaaaaatccttgagggatgaaatctagtcttgtgaagagcgaactcaacacttagatttcaccaaaatgaatatatttttccgagcggtggaacttggaaaactttttgagggatgaaatcttgtcttttgaatagcaaactcaacacttagatttcaccaaaatgaatatatttttccaagaggtggaatttgaaaaaatccttgaaggatgaaatctagtcttgtgaagagcgagctaaatgaatatatttttccaagaggtgaaacttggaaatatccttgagggatataatctagtcttgcgaagtatgaactcaacacttagatttcactgaaatgaatacatttttccaagaggtggaacttggaaaaatccttgaggaatgaaatctaatcttgtgaagagcgaactcaacacttggatttcaccgaaatgattatatttttcaaagaggtggaacttggaaaaatccttgagagatgaaatttagtcctgtgaagagcgagcttcacatttagagttcaccgaaataaatatatttttcaaaaaggtggaactcgaaaaaatccttgaaggatgaaatcttgtcttgtgaagagcaaactcaacacttaatttcacaaaaatgaatatatttttccaagaggtagaacttgaaaaaatcgttgagggatgaaatctagtcttgtgaagagcgaactcaacacttagatttctccaaaatgaatatatttttccaagaggtgggactcagaaaatgttttgagggatgaaatcttgtcttgtaaacaacgagctcaacacttatctttcaccgtaatgaatatatttttttccgagaggtggaacttggaaaaatccttgagggatgaaatctagtcttgtgaagaaagagctcaacacttagatttcaccaaaatgaatacatttttcaaaaaggtggaacttggaaaaatacttgagggatgaaatctactcttgagaagagcgaactcaacactgggatttcaccgaaatgcatatattttttcaagaggttgaacttggaaaaatccttgaggggtgaaatttagtcttgtgatgagcaagttcaacacttatatttcaccgaaataaatatatttttccgagaggtggaactttgaaaaatacttgagggatgaaatctagtcttgtgaagagcaaattcaacatttaaatttcaccgaaatgaatatatttttccaagaggtggaacttggaaaaatctttgagggatgaaatctagtcttgtgaatagcgaactcaacactaacatttcacaaaaatgaatacattttttcaagaggtggaacttggaaaaatccttgagggatgaaatctaatcttgtgaaaagcgaactcaacacttggatttcaccgaaatgattatatttatctaagaggtggaactaggaaaaatccttgaggggtgaaatctagtcttgtgataagcgagttcaacacttagatttcaccgaaatgaatatatttttccgagaggtggaacttggataaatccttgacggatcaaatctagttttgtgaagagctaactcaacatttagatttcaccgaaatgaatatatttttccaagaggtggaacttggaaaaatctttgagcgatgaaatctagtcttgtgaagagcgagctcaacacttaaatttcgctgaaatgataatattttttcaagaggtgaaacttggaaaaattcttgagggatgaaatatagtcttgtgaagagcgaactcaacacttaaattttaccgaaatggatatatttttccgagaggtggaacttggaaaaatccttgagagatgaaacctagttttgtgaagagcaaactcaacacttagatttcaacaaaatgaatatatttttccaagaggtggaacttggaaaaatccttgagggatgaaatctggtctggtgaagagcgaacacaacgcttaaatttcatcaaaatgaatatatttttccaagaggtggaacttggaaaaatccttgacggatgaaatctagtcttgtgaagcgcaaactcaacacttagatttttccaaaattaatatattttttcaagaaatggaacttggaaaaatctttgagggatgcaatctagtcttgtgaaaagccaactcaacacttagatttcaccgaaatgaatatatttttccaagaggtggaacttgaaaaactttttgagggatgaaatcttgtcttgtgaatagcaaactcaacatttagatttaaccaaaaatgaatatatttttccaagaggtggaacttgaaaaaatccttgaaggatgaaatctagtcatgtgaagagcgagctaaatgaatttattttttcgagaggtggaacttgaaaatatccttgagggatgaaatctagttttctgaagagcgaactcaacacttagatttcgctgaaatgaatatattttttaaagaggtgaaacttggaaaaatctttgagggatgaaatctagtcttgtgaagagcgaacgcaacacttagatttcaccgaaatgaatatattttccaagaggtgaaacttggaaaaattcttgagggatgaaatctagtcttgtgaagagcgaactcaacacttagatttcaccgaaatgattatatttttttccgagaggtggaacttggaaaaatcattgacggatgaaatctagtcttgtgaagtgcgaactcaatacttagatttcaccgaaatgaatatatttttccaagaagggcaacttggaaaaatccttgagggatgaaatccagtcttgtgaagagcgaactcaacacttcgatttcaccgaaatgaatatattttctcaaactcttggactgcgagactaaggaatgatatctccggtttcacacaaacaaataatgagactttctgtgaagcatgggagcgcttcaaaggttaccagacgcaatgtcctcatcatggtttctccaaagcttcacttctcagcactctctacagaggtgtccttcccaagatcaggatgcttcttgataccgcttctaacgggaacttcctcaacaaagacgttgaagaaggatgggagctggtagagaacttggcacagtcggatggcaactacaatgaagattacgatagaagcatccgccacagctctgattctgatgagaagcaccacagggaaatgaaagctataaatgacaaactggacaagctactccttgtgcaacagaagcacattcattttctgggtgatgatgagacgttccaagtccaggatggggatactctgtagtcagaagaggtcagctatgtgcagaaccaaggaggttacaacaaagatttcaacaacttcaagcagaaccatcccaatctgtcttacagaagtacaaatgttgcaaacccacaggaccaagtctacccctctcagcagctgaataaacccaagccctttgttccatacaaccaaggtcaggggtatgttcctaagcagcagtatcagggcaactatccgccgcaacttccaccacctgggttcacacagcagcaacaacaaccagcttcaacaactccacattcaaacttgaagaacatgttacagcaaatactccagggacaagcagcaggggcaatggatctcgccaacaagatggcagaaatccataacaaggtcgattgcactttcaacgatctgaacattaaacttgaggcactcacctcaaaggtcagatacatggaaggacaaactgcgtcgacctctgctcccaaagtaagaggacttccaggaaagttcatacagaacccgaaggattacgccaccgctcacgctatcaccatctgtcatgatcgagagttgcctattcgacatgtctccacatcaatcaccgaggacagtgatgttcaggacgggaaggcttctactcagattgaaatttcagttgttggactcgaccatttagctggatcccgttttcaaactcagtccaacctagacgagaaagcagccatcattgagaggatggtaaaacgattcaagccagcaccattaccttcacgtgctcttccatggaaattcaggaaagcatggatagaaagatacaattctcttgcagagaagcagcttgatgagatggaagcggtgatgcctctaatagaagttctcaacctgatcccggatcctcacaaagatgtgagaaattcaattctggaaaggatcaagatttatcaagattcagaagatgattgtgaggctaatccatctagggccactgttaagaggagtgttcaagaaaaactggaagatcctggaactttcactctaccatgttccattggtcaattggttttcagcaattgtctatgtgatttgggagcttcagtaagcttaatgccactcttcatggcaaggaagctggaattcactcagtacaagccttgcgacctgactttgatccttcctgataggtcttcaaggaaaccctttggcctgctacaagatctgccagtaatgattaatggagtggaagtacctacagatttcgttgtgcttgagatgaaaccagaacctaaggatcctctaatcctaggaagaccattcttagcctccgtgggagcgatgatagatgtcaaagacaagagaataagtctcaaccttgggaagcacatcaagctgcagtttgacatcaacgaaacttcgcaaaggacagctgtagaagaaaagatcagggctcagcctcaaccttcggattcaatcaccagaccaagcacaacctctacacctgacttgcgagatctcaaaaagaaatctgatgagcaagaagaaaccatagagaagctagctcagacagttgaggaacttaagagtaaactggatcagatgcaagagaaagctcaatcaaaatgcgggattgatactatcccgagaaaaaagtttacttcaagatggtctgaggagatagattatccaccagaagagaaagaggcctatttcgagaaaagaagaattaagtattctgctacgcatctctcaagagaggatgctgaatatgatgatgagattagagaggactatgcagatcctctctatcacccattttcttcttaataagtgtgaggagtcaagctagagactttaaacaagctcacttgcgaggaattcccaagactgtttctataaataaaatttttattttcttgttatttttgatttgtttttggctgtgtttgtgattctcaggaaaatagaaacagcgtggaggtagagtaaaaattttaaaattttactctacagagcaacaggggatcgagcatgtcagtgtaaagaaattcaagaatttgaaaaaagttctgttgcaatcagagaccatgagatcgagtagtttggtcgagtattagtgatgattttaaaaacccaaaattttgaaatcatatttatactcgaccaacagaagctacaaagacttacagagagtttatcaagtttacagaggattacagaaggttctaagacattcctagtcaacagagaacagtgcttcaggacaaacagacagagtgtggcccaccacctctcacctttgttcccacatgcgtttttagagataacgaaatcccaagactacttctccaccactcgatctcaccctatcctttcccaccgacatcatctcttttcctctccattcactcgacctcgcagacacattctccgtcacgtctctcactcgaccaaacatcactcgacatctctctcaccgcctctctttcactcgatcgaaacgcctctcctctctattctccgcctactctaccgccggaccttcaccgtctcaacgtcgcctcctcttcactcgacctcgccgtcccaacttcaccatccctcaccacttcgtcaactttctcactcgaccaaaattcagctttcatcgctcacgccactgccttctccctctcttccactcaacgacgggaccggtttcatcatctctcaccgctctcgcctcctcttcactcgaccgcacgagcacctcaacctctactccgatttctttttctcacctctccatactcaaccgctactcgacctcatctccgttccctctcttttactcgaccgccggaccggcttcaccatctctcaactatccaccgttcactcgacctcgccattcattgcgcctccgtttatctcttcactcgaccgctcctcaaaccgccactgtcttctctccattcgccgttcactcgaccacgcatttaccgtctctcattcgtcttcactctaccgctaaactcgaaaccataatttcactgtactcgaccgtaatactcgaccgtgtacttgaccggtttagtgtttgcatttatttggactaacatattgacgtttggctttgagttacattctttttcaggaaatcaatatgagtaactacagtggcgaatcctccatggatgcggattacaacatcgatgaagctgaatcttggtcaactggaccagagagagagcgacaagcttatgagagcttcagagcggagacccaacgctcagtaacttgacgcaatgagaggagagctgagattgctagaggaaagagagcaatgaccagcagatatgagttgatcgacgatgatattgacgtcgagtatgagcctgagtcatggcatagagagacgaagctgttgaacaggcctaatgaagtcccagtggaggagtacatcagacttttcgagctgaacgacttctggggaacgaagtacccctattatcagactttagcccagctggggctaccggaggacgtacaacacctattcgagaagtgtcatctggagacactgatgtcttacccgtacgtcgcttacaagaaggaaataagagagtttctctccactctgcaagtggagatgtatcagggacttacagcagatgagctggagagtgaagggttggggttcttgactttttccgtgagcgagcagtgttaccagctatctatcaggagcttggaaggattgtttggcttacccagtggaaagggaactaaacccaagttagagagggaagagttgaaggatttgtggttaactattgggaacgatatggcgctcaactctgcgaggtccaagagcaaccagattcgaagccctgtgatctgctactatcaacgctctatagcgaatgttctgtactctagggaatctacaggtaccgtgtctaacacagacatggagatgattaattctgcactcaagggcattctccgtagaacaaaggggaagaaggtcctgaagggcgacctcaatgatgcaccaccagttatgcttctgttgatccacctgtgtggatacaggaagtgggcgcacaccaacgggaagaagagggcgcgaggagccctttgtgtaggtggtgttgtgacaccaattctgattacatgtggtgtacctttcacgtctccagggtttgatccgaggatgatggatttagatcacttgcgtcgttgtgagtttctggagcacgacatggttggcgatttctatcgctacaaatttgagcactccttgacccgaacagccaacattctgcttccctgcaccgaggccacaaccatacttcagggcgaaaacattgacttcaagcctgcgcgtgattacctctactttgagagcgctccaccgactgatgacaacgtccctacaaagaagctacccaagctgagattgctgagacagatgaggatagggaggaggagtacgatacgcgcatgtatcatttcagtgagcatgtacctccagcgagggagagcaagagcttgagcgaagctcacagaaacaacagtaagttgcagaggtggtgcaagaaacaagataggctactcatcaagtgcttcaaggccatcaagtttctgacagacaagctaagctgctcctcttctaccacagcgattccgcagggagagcctcctcaggacatgccctcgaggagatatgacgcgccagagccaactcgccacaggcctgagccaagtcaccacatgcctgagcctagtgaccgagtagtctcacaagtccctgcgtggcattcatcattcgagcctcgggagctcgggagaaagaagaaggctgcactcgctcggtctggcagcaggagtacacgacttctccagtcccgtagcttacgcgatcgcggtgctggccgcagcagaaaaagagagatcgagtatcatcagagcggtgctggccgcgactaaggagcagaggttgagtacccccagggggaagctgagacacaacagagagattcttcgatggcctgggagcattcacaggcggctgttgatgaccaactccgctccttcttccactgaggtaagcacctcactccaccattgtaatataccatctcctgtttttattttgtttctgtgatgtgttttgtcctgagtactctcttccaaatttggtcacacagtggactgtgtgatttaagtttgggggagggctcaggaagtgtgtgttgcgttgtatataatcttgagtctgcattcatctaaggcatagaaaaaaccaaaaaaaaaattgaaaaatttcagaaaatgatttcacaaaaacagagtgttcatatagttgcattgcatttaggatcgagtctagagtgtttcatttaggatcattgcatatgcataggggacaatgatgagatagccttgtaagcattttggttcaccagataaactcagtgccctcgttgttagttgtctgatgcatagtcaatgaaattgaagtaaaactacaccatgcctagattgctctactcgagcacacgactgttaggatctgataccattccctatcaatttgaacttgaatctgatttagaattatcatgtcttggcatcgaatttgaactcatggataccctaaaatacttggattttcttactcattttaacaactcttgttaatccaagtagctgactctccttattatagcagttaacccaaacccaaacctaaactttctttcaagccctatatcacttgtgagtgtttgtgaggtcttatttcgattgagcttggtagaaagtgttaggttcgtaacgacagagatagtgtctcatgtagttctagttcgcgtttttcggactggataggactaggtgggcgcttagatcatgggttgggatgtgtttaaaagaaaagggtgaattcattgttgataaggaaagggaaagaattctaggggaagtaagctaaaaaagttagaaaaaaaatctagtaaaggttttgggaatgttaaagaaaagaatgaggttcttgttagttaaagaagaagggttaaaagccttttgtttaaaaaattaaaaacaggaaccttagttgttaaagaaatccaaatccgctagatgtatcaaagtgttgagaaagcttctcctagagttaagagaaaagaaaagaatgatatgaaaaagagtttgaaagattcatgagtgcaaagggtagagttaagttcttgtattgggactagagttgggataaccattatagcttcattgttatactatgggtagatgggatcttatctctgtatgcatagcttgggacttacctttagcattctactaaagctcaatcattcttgagagattccctgttacttaagcctattctgtaagggaccatctttgtctcttgaccttcaccttagccaaatgagttcattgatgatgcattgcttgattcacgttctagaactaatgaatgttaaagggattggtagatttgaaagcatgtataggtcgagtataagagacagattgattgataacaaggcatggctaacgtttttgagtaaaatttaatcatatcgcatcttagaactaccaacttggacattgattttatttgctctacctgatgctttggttctgagtccccaccttcaaacctctccttcaactatgtcttcttatttgcttgagggcaagcaaagactaagttttggggagttgatatgtctataatttgcatgttttcagtgtccattcatcatcatttcgagtcaagttttgtatcattcatcactgttttatatcatttctcatcattcttgcatactttgcatgattaggatagctttgcatacatattgcatttctgagttgttttcaggtgatttggagctgtttgcgagcaaattagaagaaacgagccagaaccagaagatatactcgaccaccatgtcgtgtgcatccagcgccatactcgaccccctggtcgagtgactttggagccattcttcccatctactggacccccagatcgagtaacctcagctcaggccactcgatgacgccactcgaccccctggtcgagtatcacttcgccaaaccacctgaccacactcggccgttcactctaccacgttactcgaccagtgggtcgagtatcatcactcaccaccaacaccactactcgaccgggcactcgatcacatcttcttagtctactcaaatccgcactcaaccagacaagcggagcacaaggaagagaagaggagaagacgaagtgtttggaagcggcctggacctccatcggatcacgaagcccatctcggcccattatcactctatgggtcgggcgatgaggttattggcctgtctcctatcattttatttcgttttgcataaatagatgtctttgggttctgtcctgagacatctagtcgacattgggtttttgcttcagttttattttctgttttactctggctgcgccgcttttgcttctacaacctgtaattcgagatttttccaagttattcagattccgcatttgatttcatttgttatcttgtttctctactctttatctctttacttatccaatattatcatttatctgcgtttatgtctttgagcatattgtctgagtagtgacttagaattcttaaggatgggatagagtagttgtggaatccgtagtctatagaatggttaagttttagaattgattgaatcccttcaggactagttgtgtttactgcttatttctttctgatcaactggaattcgatcccaagcattcccgcaaccagaaggtgttcgatggaatgcttgatccactagttcctgagatattcgtctctatcccaagggattggccgtttagagcgtttattgactttatcagtctgttcttattgcctgcatagttagattccgttaatgggaattagtctgggctagctttgcttgaggatttctatcacgggagtgaattgatctattgttgaacatgttgtctagggatagcttgattgcgcttgttaaccattcggataggctaggataccactttattcgattaccccatccttaggaatttctcgtctatttgatttctctgttttatcgttatcgcttaattgttctcattgcatgtctcttcgtttttgcaattactcgatcaacttactcgaccacactcagtgtctggcaacagactatgcagtcgagtacagttgtcatatttcctgtctgttactcgaccatatcttacttctggcatcagcctgttgtggttgagtgattttagtaattctgttattgtttctgttttctgcatgttcgcttaggactgttagaaaccccaaaactgttattgcttggcttgacttagtgacttctgatcacatctcatctgtttgcatcacacctatttggattgacaacctaaaatactacaacgacatgattggtgtttttggataattgactaaaaacctattatcacttaacacttagatttcaccgaaataaaatatttttccaagatgtggaacttggaaactttttgagggatgaaatcttgtcttgtgaatagcaaacacaacatttagatttcacgaaaatgaatatatttttccaagaggtgtaacttgaaaaaatccttgagggatgaaatctagtcttgtgatgagcgaactcaacacttagatttcaccaaaatgaatatatttttccaagaggtgggactcgaaaaaattcttgacggatgaaatcttgtcttgtgaatagcaaacacaacatttagatttcacgaaaatgaatatatttttccaagaggtgtaacttgaaaaaatccttgagggatgaaatctagtcttgtgaagagcgaactcaacacatagatttcaccaaaatgaatatatttttccaagaggtgggactcggaaaaattcttgacggatgtaatcttgtcttgtgaacagcgagctcaacacttatatttcatcgtaatgattatatttttttcgagaggtggaacttgcaaaaatccttgatggatgaaatctagtcttgtgaagagcgaactcaacacttagattttgctgaaatgaatatatttttcaaaaaggtggaacttggaaaaatccttgagggatgaaatcaagtcttgtgaagagcgaactcaacacatggatttcaccgaaatgattatattttttcaagaggtggaacttggaaaactctttgaggggtgaaatctagtcttgtgatgatcaagttaaacacttagatttcatcgaaataaatatatttttccgagaggtggaactttgaaaaatccttgagggatgaaatctagtcttgtgaagagcgagctcaacatttaaatttcaccaaaaggaatatattttttcaagaggtggaagttggaaaaatctttgagggatgaaatctagtctcatgaatagcgaattcaacacttagatttcaccgaaatagatatatttttccgagaggtggaacttgaaaaaatccttgagggttgaaatctagtcttgcgaagagcgaactcaacacttagatttcaccaaaatgaaatatatttttaaaagatttggaacttggaaaagtccttgaaggatgaaatctatttttgtgaacagcgagctcaacacttagatttcaccgaattgaatataattttccaaaatgtggaacttggaaaaacttttgagggatgaaatctagtcttgtgaagagcaagctcaacacttagatttcaccgaaatgaatatatttttttccgagaggtggaacttggaaaaatctttgaggggtcaaatctagtcttgtgaattgcgaactcaacacttaatatttcaccgaaatgaatatatttttccgagaggtggaacttggaaaactttttgagggatgaaatctcgttttgtgaatagcaaactcaacacttagatttcaccaaaatgaatatatttttccaagaggtggaacttggaaaaatccttgagggatgaaatctagtcttgtgaaacgcgaactcaacatttagatttcaccgaaatgaatatatttttccaagaaatgcaacttggaaaaatccttgaggaatgaaatctagtcttatgaagagcgaattcaacacttggatttcaccgaaatgaatatatttttccaaaaggtgtaacttggaaaaatccttgaagaatgcaatctagtcttgtgaagagcgagctcaacacttagatttcaccgaaatgaatatatttttccaagaggtggaacttggaaaaatccttgagggatgaaatctagtcttctgaagagcgaactcaacacttacatttcaccaaaatgaatacattttttcaagaggtggaactttgaaaaatccttgagggatgaaatctaatcttgtgaagagcgaactcaacacttggatttcaccgaaatgattatatttttttaagaggtggaactaggaaaaatccttgaagggtgaaatctagtcttgtgataagcgagttcaacacttagatttctccaaaatgaatatatttttcggagaggtggaacttggaaaaatccttgagggatgaaatctagttttgtgaagagctaactcaacaattagatttcaccgaaatgaatatatttttccaagaggtggaacttggaaaaatctttgagggattaaatctagtcttgtgaagagcgagctcaacacttagatttcgctgaaatgaatatattttttcaagaggtgaaacttggaaaaattcttgagggatgaaatatagttttgtgaagagggaactcaacacttagattttaccgaaatggatatatttttccgagaggtggaacttggaaaactttttgatggatgaaatctagttttgtgaatagtaaatttaacacgtagatttaaccaaaatgaatatatttttccaaagaggtggaacttgcaaaaatctttgatggatgaaatctagtcttgtgaagagcgaactcaacacttagattttgctgaaatgaatatatttttcaaaaaggtggaacttggaaaaatccttgagggatgaaatcaagtcttgtgaagagcgaactcaacacatggatttcaccgaaatgattatattttttcaagaggtggaacttggaaaactctttgaggggtgaaatctagtcttgtgatgatcaagttaaacacttagatttcatcgaaataaatatatttttccgagaggtggaactttgaaaaatccttgagggatgaaatctagtcttgtgaagagcgagctcaacatttaaatttcaccaaaakraatatattttttcaagaggtgaaacttggaaaaatccttgagggatgaaatctagtcttgtaaagagcaaactcaacacttagatttcaccgaaatgaatatatnnnnnnnnnnnnnnnnnnnnnnnnnnnnnnnnnnnnnnnnnnnnnnnnnnatttaggtgacactatagaatactcaagctttcatggtgtaggcaaagtccatatgagtctatggctttgtgtcttctaacaaggaaacactacttaggcttttaagatcaggttgcggtttaagttgttatactcaatcatacacatgacatcaagtcctattcgactccaaatatgtaaccaaccttcttcttgcttctcaaagctttcatggtgtggccaaagtctatatgagtctttggctttgtgtcttctaacacggaaacactacttaggcttttaagatcaggttgcagtttaagttgttataatgaatcttacacatgacaacaagtcatatttgactccaaaacactaaccaaccttcttcttgcttctcaaagctttcatggtgtaaccaaagtccatatgagtctttggctttgtgtcttctaacaaggaaacactacttaggcatttaagatcgggttgtagtttaagttcttatactcaatcatacacatgacatcaagtcatattcactctaaaacactaaccaaccttcttgttgcttctcaaagcttccacggtgtagccaaagtccatatgagtcttcggctttgtgtcttctaacaaggaaatactacttaggcttttaagatagggttgcggtttaagttcttatactcaatcatacacatgacatcaagtcatattcgactccaaaacactaactaaccttcttgttgcttctcaaagctttcatggtgtagtcaaagtccttatgagtctttggctttgtatcttctaacaaggaaacactacttaggcttataagatcgggttgcggtttaatttcttatactcaatcatacacatgacatcaagtcatattcgactcctaaacactaaccaaccttcttcttgcttctcaaagctttcatgttgtagccaaagtccatatgagtcttaggctttgtgtcttctaacaaggaaacactacttaggcttttaagatcaacttgcggtttaagttgttatactcaatcatacacatgacaacaagtcatattcgactccaaaacactaaccaaccttcttcttgcttctcaaagctttcatggtgtagccaaagtcgatatgagtctttggctttgtgtcttctaataaggattcaattcttacgcctttaagatccggttgcggtttaagttcttatactcaatcatacacatgacatcaagtcatattcgactccaaaacactaaccaaccttcttcttgcttctcaaagctttcatggtgtaaccaaagtccatatgagtctttggctttgtgtcttctaacaaggaaacactacttaggcttttaagatcgggttgcggtaaaaattcttatactcaatcatacacatgacatcaagtcatattcactccaaaacactaagccaaccttcttcttgcttctcaaagctttcatggtgtagccaaagtccatatgagtctttggctttgtgtcttctaacaaggaaacactacttaggctcttaagatcgggttgcggtttaagttatttttctcaatcatacacatgacatcaagtcatattcgactccaaaacactaaccaaccttcttcttgcttctcaaggctttcatggtgtagtcaaaatccgtatgaatctttggctttgtatcttctaacaaggaaacactacttaggcttataagatcgggttgtggtttaagttcttatactcaatcatacacatgacatcaagtcatattcgactccaaacaactaaccaaccttcttcttgcttctcaaagctttcatggtgtagccaaattccatatgagtctttggctttgtgtcttctaacaaggatacaattcttacgcctttaagatccagttgcggtttaagttcttatactcaatcatacacacgacatcaagtcatattcaactccaaaacactaaccaaacttcttcttgcttctcaaagctttcatggtgtagtcaaagtccgtatgagtctttggctttgtatcttttaacaaggaaacactacttaggcttttaagatcgggttgcggtttaagttcttatactcaatcattcacatgacatcaagtcatattcgactccaaaacgctaaccaacattcttctttctttttaaagctttcatggtgtaggcaaagtccatatgagtctttggctttgtgtcttctaacaaggaaacactacttaggcttttaagatcagattgcggtttaagttgttatactcaatcatacacatgacatcaagtcctattcgactccaaatatgtaaccaacctttctgaaagctttcatggtgtagccaaagtctatatgagtctttggctttgtgtcttctaacacggtaacactacttaggcttttaagatcaggttgcggtttaagttgttataatgaatcttacacatggcatcaagtcatattcactctaaaacactaaccaaccttcttgttgcttctcaaagctttcacggtgtagccaaagtccatatgagtctttgcctttgtgtcttttaacaaggaaacactacttaggcttttaagatagggttgcggtttaagttgttatactcaatcatacacatgacatcaagtcgtattcgactccaaaacactaactaaccttcnnnnnnnnnnnnnnnnnnnnnnnnnnnnnnnnnnnnnnnnnnnnnnnnnngaacttggaaanatccttgaggaatgaaatctagccttgtgaagcgcgaactcaacacttagatttcaccgaaatgaatatatttttccaagaaatgcaacttggaaaaatccttgagggatgaaatctagtcttgtgaagcgcgaactcaacaattagatttcaccgaaatgaatatattttttcaagaaatgcaaattggaaaaattcttgagggatgaaatctagtcttgtgaaaagcgagctcaacatttagatttcaccgaaatgaatatatttttccaagaggtggaacttggaaaaatccgtgagggatgaaatctagtcttgtgaagagtgaactcaacacttagatttcaccgaaatgaatatatttttccaagaggtggaacttggaaaaatccttgacggatgaaatctagtcttgtgaagcgcaaactcaacacttagatttcaccgaaatgaatatatttttccaagaagtgcaacttggaaaaatccttgagggatgaaatctagttttatgaagagcgaattcaacacttccatttcaccgaaatgaatatatttttctaaaaggtgtaacttggaaaaatccttgaaggatgaaatctagtcttgtgaagagcgagctcaacacttagatttaaccgaaatgaatatatttttccaaaaggaggaacttggaaaaatccttgagtgatgaaatctagtcttgtgaagagcgaactcaacacttagatttcaccgaaatgaatatatttttccaagaggtgaaacttggaaaaatccttgagggatgaaatctattcttgtgaattgcgaactcaacacttcagatttcaccgaaataaatttatttttctgagaggtagaacatggaaaaatccttgagagataaaatctagttttgtgaagagcaaactcaacacttagatttcaccaaaaatgaatatatttttccaagaggtgtaacttggaaaaatccttgagagatgaaatctagccttgtgaagcgcaaactcaacacttagaattcaccgaaatgaatatatttttccaagaaatgcaacttggaaaaatccttgagggatgaaatctagtcttgtgaagcgcgaactcaacacttagatttcaacaaaataaatatattttttctagaaatgcaaattggaaaaatccttgagggatgaaatctagtcttgtaaaaagagagctcaacacttagatttcaccgaaatgaatatatttttccaagaggtggaacttggaaaaatccttgagggatgaaatctagttttgtgaagagtgaactcaacacttagatttcaccgaaatgaatatatttttccaagaagtggaacttggaaaaatccttgacggatgaaatctagtcttgtgaagcgcaaactcaacacttagatttcaccgaaatgaatatatttttccaagaaatgcaacttggaaaaatccttgagggatgaaatctagtcttgtgaagagcgaactcaacacttccatttcaccaaaatgaatatatttttccaaaaggtgtaacttggaaaaatccttgaaggatgaaatctagtcttgtgaagagcgagctcaagacttagatttcaccgaaatgaatatatttttccaaaatgtggaacttggaaaaatccctgagtgatgaaatctagtcttgtgaatagcgaactcaacacttagatttcaccgaaatgaatatatttttccaagaggtgaaacttggaaaaatccttgagggatgaaatctagtcttgtgaagagcaagctcaacacttaaatttcaccaaaatgaatatatttttttccgagaggtgaaacttggataaatctttgagtgatgaaatctagtcttgtgaagagcgaactcaacccttatatttcaccgaaatgaatatattaatccaaaaggtggaactcggaaaaatccttgagagatgaaatctagtcttgtgaagcgtgaacttaaaacttagatttcaccgaaatgaatatatttttccaagaaatgcaacttggaaaaatccttgagggatgaaatctattcttgtgaagcgcgaactcaacaattaaatttcaccgaaatgaatatattttttcaagaaatgcaaattggaaaaatccttgagggatgaaatctagttttgtgaagagcgagctcaacacttagatttcaccaaaatgaatatatttttccaagaggtggaactaggaaaaatccttgagggatgaaatctagtcttgtgaagagtgaactcaacacttagatttcatcgaaatgaatatatttttccaagaggtgaaacttggaaaaatccttgagggaagaaatctattcttgtgaattgcgaaatcaaaaattcagatttcaccgaaataaatatatttttctgagaggtagaacttggaaaaatccttgagagataaaatctagttttgtgaagagcaaactcaacacttagatttcaccaaaaatgaatatatttttccaagatgtggaacttggaaaaatccttgaggaatgaaatctagccttgtgaagcgcgaactcaacacttagatttcaccgaaatgaatatatttttccaagaaatgcaacttggaaaaatccttgagggatgaaatctagtcttgtgaagcgcgaactcaacaattagatttcaccgaaatgaatatattttttcaagaaatgcaaattggaaaaattcttgagggatgaaatctagtcttgtgaaaagcgagctcaacatttagatttcaccgaaatgaatatatttttccaagaggtggaacttggaaaaatccgtgagggatgaaatctagtcttgtgaagagtgaactcaacacttagatttcaccgaaatgaatatatttttccaagaggtggaacttggaaaaatccttgacggatgaaatctagtcttgtgaagagcaaactcaacacttagatttcactgaaatgaatatatttttccaaaaaatgcaacttggaaaaatccttgagggatgaaatctagtcttgtgaagagcgaactcaacacttccatttcaccaaaatgaatatatttttccaaaaggtgcaacttggaaaaatccttgagggatgaaatctagtcttgtgaagagcgaactcaacacttccatttcaccaaaatgaatatatttttccaaaaggtgtaacttggaaaaatccttgaaggatgaaatctagtcttgtgaagagcgagctcaacacttagatttcaccgaaatgaatatatttttccaaaatgtggaacttggaaaaatccttgagggatgaaatctagtcttgtgaatagcgaactcaacacttagatttcaccgaaatgaaaatatttttnnnnnnnnnnnnnnnnnnnnnnnnnnnnnnnnnnnnnnnnnnnnnnnnnntgagggatgaaatctagtcttgtgaattgcgaactcaacacttcagatttcaccgaaataaatatatttttctgagaggtagaacttggaaaaatccttgagagataaaatctagttttgtgaagagcaaactcaacacttagatttcaccaaaaatgaatatatttttccaagaggtggaacttggaaaaatccttgagggatgaaatctagtcttgtgaagcgcgaactgaacacttagatttcatctaaatgaatatatttttccaagaaatgcaacttggaaaaatccttgagggatgaaatctagtcttgtgaagcgcgaactcaacacttagatttcactgaaatgaatatattttttcaagaaatgcaacttggaaaaatccttgacggatgaaatctagtcttgtgaagagcgagctcaacacttagatttcaccgaaatgaatatatttttcgaagaggtggaacttggaaaagtccttgagggatgaattctactcttgtgatgagtgaacacaacacttagatttcaccgaaatgaatatatttttccaagaggtggaacttggaaaaatcctagagggatgaattctagtcttgtgaagtgcgaaatcaacacttaatattttacttaaatgaatatatttttccgagaggtggaacttggaaaaatccttgagagataaaatctagttttgtgaagagcaaactcaacacttagatttcaccaaaataaatatattttttcaagaggtgaaacttggaaaaatccttgacggatgaaatctagtcttgtgaagcgcaaactcaacacttagatttcaccgaaatgaatatatttttccaagaagtgcaacttggaaaaatccttgagggatgaaatctagtcttgtgaagagcgaactcaacacttccatttcaccaaaatgaatatatttttccaaaaggtgtaactgggaaaaatccttgagggatgaaatctagtcttgtgaagagcaagctcaacacttaaatttcaccgaaatgaatatatttttttccaagaggtggtacttggaaaaatctttgagtgatgaaatctagtcttgtgaagagcgaactcaacacttatatttcaccgaaatgaatatatttttccaagaggtggaacttggaaaaatccttgagggatgaattctagtcttgtaaaatgcgaactcaacacttaaaatttcacttaaatgaatatatttttccgagaggtggaacttggaaaaatccttgagagataaaatctagttttgtgaagagaaaactcaacacttagatttcaccaaaatgaatatatttttccaagaggtggaacttggaaaaatccttgacggatgaaatctagtcttgtgaagcgcaaactcaacacttagatttcaccgaaatgaatatatttttccaagaagtgcaatttggaaaaatccttgagggatgaaatctagtcttgtgaatagcgaactcaacacttccatttcaccgaaatgaatatatttttttaaaaggtgtaacttggaaaaatccttgaaggatgaaatctagtcttgtgaagagcgagctcaacacttagatttcaccgaaatgaatatatttttctaaacggtggaacttggaaaagtccttgagggatgaaatctagtcttgtgaagagcgaactcaacacttagatttgaccgaaatgaatatatttttccaagaggtgaaacttggaaaaatccttgagggatgaaatctagtcttgtgaattgcgaactcaacacttcagatttcaccgaaataaatatatttttctgagaggtagaacttggaaaaatccttgagagataaaatctagttttgtgaagagcaaactcaacacttagatttcaccaaaaatgaatatatttttccaagaggtggaacttggaaaaatccttgagggatgaaatctagtcttgtgaagcgcgaactgaacacttagatttcatctaaatgaatatatttttccaagaaatgcaacttggaaaaatccttgagggatgaaatctagtcttgtgaagcgcgaactcaacacttagatttcactkaaatgaatatattttttcaagaaatgcaacttggaaaaatccttgacggatgaaatctagtcttgtgaagagcgagctcaacacttagatttcaccgaaatgaatatatttttcgaagaggtggaacttggaaaagtccttgagggatgaattctactcttgtgatgagtgaacacaacacttagatttcaccgaaatgaatatatttttccaagaggtggaacttggaaaaatccttgagggatgaattctagtcttgtgaagtgcgaactcaacacttaagattttacttaaatgaatatatttttccgagaggtggaacttggaaaaatccttgagtgataaaatctaattttgtgaagagcaaactcaacacctagatttcaccaaaatgaatatatttttccaagaggtggaacttggaaaaatccttgacggatgaaatctagtcttgtgaagcgcaaactcaacacttagatttcacttaaatgaatatattttttcaagaagtgcaatttggaaaaatccttgagggatgaaatctagtcttgtgaatagcgaactcaacacttccatttcaccgaaatgaatatatttttttaaaaggtgtaacttggaaaaatccttgaaggatgaaatctagtcttgtgaagagcgagctcaacacttagatttcaccgaaatgaatatatttttccaaacggtggaacttggaaaagtccttgagggatgaaatctagtcttgtgaagagcgaactcaacacttagatttcaccgaaatgaatatatttttccaagaagtgcaacttggaaaaatccttgagggatgaaatctagtcttgtgaagagcgaactcaacacttccatttcaccaaaatgaatatatttttccaaaaggtgtaactgggaaaaatccttgagggatgaaatctagtcttgtgaagagcaagctcaacacttaaatttcaccgaaatgaatatatttttttccaagaggtggaacttggaaaattttttgagtgatgaaatctagtcttgtgaagagcgaactcaacacttatatttcaccgaaatgaatatatttttccaagaggtggaacttggaaaaatccttgagggatgaattctagtcttgtaaaatgcgaactcaacacttaaaatttcacttaaatgaatatatttttccgagaggtggaacttggaaaaatccttaagagataaaatctagttttgtgaagagaaaactcaacacttagatttcaccaaaatgaatatatttttccaagaggtggaacttggaaaaatccttgacggatgaaatctagtcttgtgaagcgcaaactcaacacttagatttcaccgaaatgaatatatttttccaagaagtgcaatttggaaaaatccttgagggatgaaatctagtcttgtgaatagcgaactcaacacttccatttcaccgaaatgaatatatttttttaaaaggtgtaacttggaaaaatccttgaaggatgaaatctagtcttgtgaagagcgagctcaacacttagatttcaccgaaatgaatatatttttccaaacggtggaacttggaaaagtccttgagggatgaaatctactcttgtgaagagcgaactcaacacttagatttcaccgaaatgaatatatttttccaagaggtgaaacttggaaaaatccttgagggatgaaatctagtcttgtgaattgcgaactcaacacttcagatttcaccgaaataaatatatttttctgagaggtagaacttggaaaaatccttgagagataaatctagttttgtgaagagcaaactcaacacttagatttcaccaaaaatgaatatatttttccaagaggtggaacttggaaaaatccttgagggatgaaatctagtcttgtgaagcgcgaactgaacacttagatttcatctaaatgaatatatttttccaagaaatgcaacttggaaaaatccttgagggatgaaatctagtcttgtgaagcgcgaactcaacacttagatttcactgaaatgaatatattttttcaagaaatgcaacttggaaaaatccttgacggatgaaatctagtcttgtgaagagcgagctcaacacttagatttcaccgaaatgaatatatttttcgaagaggtggaacttggaaaagtccttgagggatgaattctactcttgtgatgagtgaacacaacacttagatttcaccgaaatgaatatatttttccaagaggtggaacttggaaaaatccttgagggatgaattctattcttgtgaagtgcgaactcaacacttaagattttacttaaatgaatatatttttccgagaggtggaacttggaaaaatccttgagtgataaaatttaattttgtgaagagcaaactcaacacctagatttcaccaaaatgaatatatttttccaagaggtggaacttggaaaaatacttgacggatgaaatctagtcttgtgaagcgcaaactcaacacttagatttcaccaaaatgaatatatttttccaagaagtgcaacttggaaaattccttgagggatgaaatctattcttgtgaagagcgaactcaacacttcgatttcaccgaaataaatatatttttccaaaaggtgtaacttggaaaaatccttgaaggatgcaatctagtcttgtgaagagcgagttcaacacttaaatttcaccgaaatgaatatatttttccaagaggtggaacttggaaaaatcctagagggatgaattctagtcttgtgaagtgcgaaatcaacacttaatattttacttaaatgaatatatttttccgagaggtggaacttggaaaaatcnnnnnnnnnnnnnnnnnnnnnnnnnnnnnnnnnnnnnnnnnnnnnnnnnnttaagatagggttgcggtttaagttcttatactcaatcatacacatgacatcaagtcatattcgactccaaaacactaactaaccttcttgttgcttctcaaagctttcatggtgtagtcaaagtccttatgagtctttggctttgtatcttctaacaaggaaacactacttaggcttataagatcgggttgcggtttaatttcttatactcaatcatacacatgacatcaagtcatattcgactcctaaacactaaccaaccttcttcttgcttctcaaagctttcatggtgtagccaaagtccatatgagtctttggctttgtgtcttctaacaaggaaacactacttaggcttttaagatcagcttgcggtttaagttgttatactcaatcatacacatgacaacaagtcatattcgactccaaaacactaaccaaccttcttcttgcttctcaaagctttcatggtgtagcctaagtccatatgagtctttggctttgtgtcttctaataaggattcaattcttacgcctttaagatccggttgcggtttaagttcttatactcaatcatacacatgacatcaagtcatattcgactccaaaacactaaccaaccttcttcttgcttctcaaagctttcatggtgtaaccaaagtccatatgagtctttggctttgtgtcttctaacaaggaaacactacttaggcttttaagatcgggttgcggttaaaattcttatactcaatcatacacatgagatcaagtcatattcactccaaaacactaaccaaccttcttcttgcttctcaaagcgttcatggtgtagccaaagtccatatgagtctttggctttgtgtcttctaacaaggaaacactacttaggctcttaagatcgggttgcggtttaagttgtttttctcaatcatacacatgacatcaagtcatattcgactccaaaacactaaccaaccttcttcttgcttctcatgtatttcatggtgtagtcaaaatccgtatgaatctttggctttgtatcttctaacaaggaaacactacttaggcttataagatcgggttgcggtttaagttcttatactcaatcatacacatgacatcaagtcatattcgacgccaaacaactaacaaaccttcttcttgctttttaaagctttcatggtgtagccaaagtccatatgagtctttggctttgtgtcttctaamrrrkayamwwytcwyrcsyytwwgakmyagwtgcggtttaagttcttatactcaatcatacacacgacatcaagtcatattcgactccaaaacactaaccaaccttcttcttgcttctcaaagctttcatggtgtagtcaaagtccgagtctttggctttgtatcttctaacaaggaaacactacttaggcttttaagatcgggatgcggtttaagttcttatactcaatcatacacatgacatcaagtcatattcgactccaaaacgctaaccaacattcttctttctttttaaagctttcatggtgtaggcaaagtccatatgagtctttggctttgtgtcttctaacaaggaaacactacttaggcttttaagatcaggttgctgtttaagttgttatactcaatcatacacatgacatcaagtcctattcgactccaaatatgtaaccaaccttcttcttgcatctgaaagctttcatggtgtagccaaagtctatatgagtctttggcttggtgtcttctaacacggaaacactacttaggcttttaagattaggttgcggtttaagttgttataatgaatcttacacatgacaacaagtcatatttgactccaaaacactaaccaaccttcttcttgcttctcaaagctttcatggtgtarccaaaktccatatragtctttggctttgtgtcttctaacaaggatacaattcttacgcctttaagatccagttgcggtttaagttcttatactcaatcatacacacgacatcaagtcatattcgactccaaaacactaaccaaccttcttcttgcttctcaaagctttcatggtgtagtcaaagtccgagtctttggctttgtatcttctaacaaggaaacactacttaggcttttaagatcgggatgcggtttaagttcttatactcaatcatacacatgacatcaagtcatattcgactccaaaacgctaaccaacattcttctttctttttaaagctttcatggtgtaggcaaagtccatatgagtctttggctttgtgtcttctaacaaggaaacactacttaggcttttaagatcaggttgctgtttaagttgttatactcaatcatacacatgacatcaagtcctattcgactccaaatatgtaaccaaccttcttcttgcatctgaaagctttcatggtgtagccaaagtctatatgagtctttggcttggtgtcttctaacacggaaacactacttaggcttttaagattaggttgcggtttaagttgttataatgaatcttacacatgacaacaagtcatatttgactccaaaacactaaccaaccttcttcttgcttctcaaagctttcatggtgtaaccaaagtccatatgagtctttggctttgtgtcttctaacaaggaaacactacttaggcatttaagatcgggttgcagtttaagttcttatactcaatcatacacatgacatcaagtcatattcactctaaaacactaaccaaccttcttgttgcttctcaaagctttcacggtgtagccaaagtccatatgagtctttggctttgtgtcttttaacaaggaaacactacttaggcttttaagatagggttgcggtttaagttcttatactcaatcatacacatgacatcaagtcatattcnnnnnnnnnnnnnnnnnnnnnnnnnnnnnnnnnnnnnnnnnnnnnnnnnnttaagtcatattcactccaaaacactaaccaaccttcttcttgcttctcaaagctttccagcacaattccatatgagtctttgtctttgtgtcttctaacaaggatacaattcttactcctttaagatccggttgcggtttaagttcttttactcaatcatacacatgacatcaagtcatattcgactccaaaacactaacaaaccttctttttgcttctcaaagctttcatggtgtagccaaagcccatatgagtctttggctttgtgtcttctaacaaggaaacattatttaggcttttaagatcgggttacggtttaagttgttatactcaatcatacacatgacaacaagtcatattcgactccaaaacactaaccaaccttcttcttgcttctcaaagctttcatggtgtagccaaagtccatatgagtctttggctttgtgtcttctaacaaggcaacactactgaggcttataagatcgggttgcggtttaagttcttatactcaattatacacatcacatcaagtcatattcgactccaaaacaataacaaaccttcttcttccttctcaaagctttcatggtgtagccaaagtccatatgagatttggctttgtgtcttctaacaaggcaacactacttaggcttataagatcgggttgcggtttaagttcttatactcaatcatacacatgacatcaagtcatattcgactccaaaacactaaccaaccttcttcttgcttctcaaagctttcatggtgtagccaaagtccatatgagtctttggttttgtgtcttctcacaaggaaacactacttaggcttttaagatcgggttgctgtttaagttcttatactcaatcatacacatgacatcaagtcatattcgactccaaaacactaaccaacattcttcttgcttctcaaagctatgatggtgtagaggaagtccatatgagtctttgtcgttgtatcttctaacaaggaaacactacttaggcttttaggataaagttgcggtttaagttcttatacgcaatcatactcatgacatcaagtcatatttgactccaaaacactaaccaagcttctccttgcttctcaaagctttgatggtgtagccgaagtctttatgagtctttgtctttgtatcttctaacaatgaaactttactttggcttttaagatccggttgcggtttaagttcttatactcaatcatacacatgacatcaagtcatattcgactccaaaacactaaccaagcttcttcttgcttctcaaagctttgatggtgtagccaaagtctgtatgagtctttgtatttgtatcttccaacaaggaaacactacttaggcttttaaggataaagttgtggtttaagttcttatactcaatcatacacatgacatcaagtcatattcgactccaaaacactaaccaagctttttcttgcttctcaaagctttgatggtgtagccgaagtccgtatgagtctttctctttgtatctacgaacaatgaaacactacttagtccgtatggtgaaatctaagtgttgagttcgctcttcacaagactatatttcatccctcaaggattttttcaagttccacctcttgaaaaaatatattcattttcgtgaaatctaagtgttgtgtttgttattcacaagacaagatttcatccctcaaaaagttttccaagttccacctctcggaaaaatatattcatttcggtgaaatctaagtgttgagttcgctcttcacaagactagatttcatcccttaaggatttttccaagttccacctcttggaaaaatatattcatttagctcgctcttcacaagactagattttatccttaaaggattttttcaagttccacctcttgaaaaatatattcattttggtaaaatctaaatgctgagtttgctattcacaagacaagatttcatccctcaaaaagttttcgaagttccacctctcggaaaaataaattcatttcgctaaagtctaactgttgagttggcttttcacaagattagactgcatccctcaagaatttttccaagctccatttttggaaaaatatattaatttcggagaaatctaagtgttgagtttgcgcttcacaacactagatttcatccgtcaatgatttttccaagttccacctcttggaaaatatattcacttggatgaaatctaagcgttgagtttgctcttcacaaaactagatttcatctctcaaggatttttccaagttccacctctcggaaaaatatattcatttaagtaaaatattaagtgttaagttcgcacttcacaagactagaattcatccctcaagtatttttccaagttccacctcttggaaaaatatattcatttcggtgaaatctaagtgttgagtttgctctttacaagactagatttcatccctcaaggatttttccaagtttcacctcttgaaaaaatatatttattttggtgaaatctaagtgttgagtttgctctttacaaaactagattttatctctcaaggatttttccaagttccacctctcggaaaaatatattcatttaagtaaaatattaagtgttgatttcgcacttcacaagactagaattcatccctctaggatttttccaagttccacctcttggaaaaatatattcatttcggtgaaatttaagtgttgaactcgctcttcacaagactagattgcatcnnnnnnnnnnnnnnnnnnnnnnnnnnnnnnnnnnnnnnnnnnnnnnnnnnttaagatcgggttgcggtttaagttcttatactcaatcatacacatgacatcaagtcatattcgactccaaaacgctaaccaacattcttctttctttttaaagctttcatggtgtaggcaaagtccatatgagtctttggctttgtgtcttctaacaaggaaacactacttaggcatttaagatcaggttgcggtttaagttgttatactcaatcatacacatgacatcaagtcctattcgactccaaatatgtaaccaaccttcttcttgcttctgaaagctttcatggtgtagccaaagtctatatgtgtctttggctttgtgtcttctaacwcggaaacactacttaggcttttaagatcaggttgcggtttaagttgttataatgaatcttacacatgacaacaagtcatatttgactccaaaacactaaccaaccttcttcttgcttctcaaagcattcatggtgtaaccaaagtccatatgagtctttggctttgtgtcttctaacaaggaaacactacttaggcttttaagatcgggttgcggtttaagttcttatactcaatcatacacatgacatcaagtcatattcactccaaaacactaaccaaccttcttcttgcttctcaaagctttcatggtgtagccaaagtccatatgagtctttggctttgtgtcttctaacaaggaaacactacttaggcatttaagatcaggttgcggtttaagttgttatactcaatcatacacatgacatcaagtcctattcgactcttaatatgtaaccaaccttcttcttgcttctgaaagctttcatggtgtagccaaagtctatatgtgtctttggctttgtgtcttctaactcggaaacactacttaggcttttaagatcaggttgcggtttaagttgttataatgaatcttacacatgacaacaagtcatatttgactccaaaacactaaccaaccttcttcttgcttctcaaagctttcatggtgtaaccaaagtccatatgagtctttggctttgtgtcttctaacaaggaaacactacttaggcttttaagatcgggttgcggtttaagttcttatactcaatcatacacatgacatcaagtcatattcactccaaaacactaaccaaccttcttcttgcttctcaaagctttcatggtgtagccaaagtctatatgagtctttggctttgtgtcttctaacaaggaaacactacttaggctcttaagatcgggttgcggtttaagttgtttttctcaatcatacacatgacatcaagtcatattcgactccaaaacactaaccaaccttcatcttgcttctcaaggctttcatggtgtagccaaaatccgtatgaatctttggctttgtatcttctaagaaggaaacactacttaggcttataagatcgggttgcggtttaagttcttatactcaatcatacacatgacattaagtcatattcgactccaaacaactaaccaaccttcttcttgcttctcaaagctttcatggtgtagcccaagtccatatgagtctttggctttgtgtcttctaacaaggatacaattcttacgcctttaagatccagatgcggtttaagttcttatactcaatcatacacacgacatcaagtcatattcgactccaaaacactaaccaaccttcttcttgcttctcaaagctttcatggtgtagtcaaagtccgtatgagtctttggctttgtatcttctaacaaggaatcactacttaggcttttaagatcgggttgcggtttaagttcttatactcaatcatacacatgacatcaagtcatattcgactccaaaacactaaccaacattcttcttgctttttaaagctttcattgtgtcgccaaagtccatatgagtctttggctttgtgtcttttaacaaggaaacactacttaggcttttaagatcaggttgcagtttaagttcttatactcaatcatacacatgacaacaagtcatattcgactccaaaacactaaccaaccttcttcttgcttctaaaagctttcatggtatagccaaattccatatgagtctttggctttgtgtcttctaacaaggatacaattcttacgcctttaagatccggttgcggtttaagttcttatactcaatcatacacatgacatcaagtcatattcgactccaaaccactaacccaccttcttcttgcttctcaaagctttcatggtgtaaccaaagtccatatgagtctttggctttgtgttttctaacaaggaaacactacttaggcatttaagattgggttgcagtttaagttcttatactcaatcatacacatggcatcaagtcatattcactccaaaacactaaccaaccttcttcttgcttctcaaagctttcacggtgtagccaaagtccatatgagtctttggctttgtgtcttctaacaaggaaacactacttaggcttttaagatcgggttgcggtttaagttgttatactcaatcatacacatgacatcaagtcatattcgactccaaaacactaactaaccttcttcttgcttctcaaagctttcatggtgtagtcaaagtccgtatgagtctttggctttgtatcttctaacaaggaaacactacttaggcttataagattaggttggggtttaagttcttatactcaatcatacacatgacatcaagtcatattcgactccaaaacactaaccaaccttcttcttgcttctcaaagctttcatggtgtagccaaagtccatatgagtctttggctttgtgtcttctaacaaggaaacattacttaggtttttaagatcagcttgcggtttgagttgttatactcaatcacacacatgacaacaagtcatattcgactccaaaacactaaccaaccttcttcttgcttatcaaagctttcatggtgtagccaaagtccatatgagtctttggctttgtgtcttctaataaggatacaattcttacgcctttaagatccggttgctgtttaagttcttatattcaatcatacacatgacatcaagtcatattcgactcacaaacactaaccaaccttcttctttcttctcaatgatttcatggtgtaaccaaagtccatatgagtctttggctttatgtcttctaacaaggaaacactacttaggcttttaagatcgggttgcggttaaaattcttatactcaatcatacacatgacatcaagtcatattcactccaaaacactaaccaaccgtcttcttgcttctcaaagctttcatggtgtagccaaagtccatatgagtctttggctttgtgtcttctaacaaggaaacactacttaggctcttaagatcgggttgcggtttaagttgtttttctcaatcatacatatgacatcaagtaatattcgactcaaaaacactaaccaaccttcttcttgcttctcaaggctttcacggtgtagtcaaaatccgtatgaatctttggctttgtatcttctaacaaggaaacactacttaggcttataagatttgcggtttaagttcttatactcaatcatacacatgacatcaagtcatattcgactctaaaccactaaccaaccttcttcttgcttctcaaagctttcatggtgtagccaaagtccatatgagtctttggctttgtgtcttctaacaaggatacaattcttacgcctttaagatccggttgcggtttaagttcttatactcaatcatacacacgacatcaagtcatattcgactccaaaacactaaccaaccttcttcttgcttctcaaagctttcatggtgtagtcaaagtccgtatgagtctttggctttgtatcttctaacaaggaaacactacttaggcttataagatcgggttgcggtttaagttcttatactgaatcatacacatgacatcaagttatattcgactccaaaacactaaccaaccttcttgttgcttctcaaagctttcatggtgtagcccaaagtccatatgagtccttggctttgtgtcttctaacaaggaaacactacttaggcttttaagatcgagttgcggtttaagttcttatactcaatcatacacatgacatcaagtcatattcgactccaaaacactaaccaagcttcttctagcttctcaaagctttcatggtgtatccaaagtccgtatgagtctttggctttgtatcttctaacaaggaaacactacttaggcttttaagatcgggttgcggtttaagtttttatactcaatcatacgcatgacataaagtcatattcgactccaaaacactaaccaagcttcttttagcttctcaaagctttcatggtgtagccaatgtccgtatgagtctttggctttgtatcttctaacaaggaaacactacttaggcttttaagatcgagttgcggtttaagttcttatactcaatcatacacatgacatcaagtcatattcgactccaaaacactaaccaagcctcttctaccttatccaagctttcatggtgtagccaaagtccgtatgagtctttggctttgtatcttctaacaaggaaacactacttaggcttttaagatcgggttgcggtttaagtttttatactcaatcatacacatgacatcaagtcatattcgactccaaaacactaaccaaccttcttcttgcttctcaaagctttcatggtgtagccaaagtccgtatgattctttggctttgtgtcttctaacaaggatacaattcttacggcttttaagatcgggttgcggtttaagttctaatactcaatcatacacatgacattaagtcatattcactccaaaacactaaccaaccttcttcttgcttctcaaagctttcatggtgtagccaaattccatatgagtctttgtctttgtgtcttctaacaaggatacaattcttactcctttaagatccggttgcggtttaagttcttttactcaatcatacacatgacatcaagtcatattcgactccaaaacactaacaaaccttctttttgcttctcaaagctttcatggtgtagccaaagcccatatgagtctttggctttgtgtcttctaacaaggaaacactacttaggcttataagattgggttgcggtttaagttcttatactcaatcatacacatgacatcaagtcatattcgactccaaaacactaaccaaccttcttcttgcttctcaaagctttcatggtgtagccaaagtccatatgagtctttggctttgtgtcttctaacaaggaaacactacttaggcttttaagatcagcttgcggtttaagttgttatactcaatcatacacatgacaacaagtcatattcgactccaaaacactaaccaaccttcttcttgcttctcaaagctttcatggtgtagcctaagtccatatgagtctttggctttgtgtcttctaataaggattcaattcttacgcctttaagatccggttgcggtttaagttcttatactcaatcatacacatgacatcaagtcatattcgactccaaaacactaaccaaccttcttcttgcttctcaaagctttcatggtgtaaccaaagtccatatgagtctttggctttgtgtcttctaacaaggaaacactacttaggcttttaagatcgggttgcggttaaaattcttatactcaatcatacacatgagatcaagtcatattcactccaaaacactaaccaaccttcttcttgcttctcaaagcgttcatggtgtnnnnnnnnnnnnnnnnnnnnnnnnnnnnnnnnnnnnnnnnnnnnnnnnnnaaccccttgcggccgcccgggccgtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtatcgtcggtctgattattagtctgggaccacggtcccactcgtatcgtcggtctgataatcagactgggaccacggtcccactcgtatcgtcggtctgattattagtctgggaccatggtcccactcgtatcgtcggtctgattattagtctgggaccacggtcccactcgtatcgtcggtctgattattagtctggaaccacggtcccactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgacgagctcgcgagctcggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtccgagctcatcgctaataacttcgtatagcatacattatacgaagttatattcgatgcggccgcaaggggttcnnnnnnnnnnnnnnnnnnnnnnnnnnnnnnnnnnnnnnnnnnnnnnnnnnttgtgaagagcgagctcaacacttagatttcaccgaaatgaatatatttttccaaaagacggaacttggaaaagtccttgatggatgaaatctagtcttctgaagagcgaactaaacacttagatttcaccgaaatgaatatatttttccaagaggtgaaacttggaaaaatccttgagggatgaaatcgagtcttgtgaattgcgaactcaacacttcagatttcaccgaaataaatatatttttctgagaggtagaacttggaaaaatccttgagagataaaatctagttttgtgaagagcaaactcaacacttagatttcaccaaaaatgaatatatttttccaagaggtggaacatggaaaaatccttgagggatgaaatctagtcttgtgaagcgcgaactcaacacttagatttcaccgaaatgaatatatttttccaagaaatgcaacttgaaaaaatccttgaggggtgatatctagtcttgtgaagcgcgaactcaacacttagatttcaccgaaatgaatatattttttcaagaaatgcaaattggaaaaatccttgagggatgaattctagtcttgtgaagagcgagctcaacacttagatttcaccgaaatgaatatatttttccaagaggtggaacttggaaaaatccttgagggatgaaatctagtcttgtgaagagtgaactcaacacttagatttcaccgaaatgaatatatttttccaagaggtggaacttggaaaaatccttgagggatgaattctagtcttgtgaagtgcgaacttaacactttatattttacttaaatgaatatatttttccgagaggtggaacttggaaaaatccttgagggatgaaatctagtcttgtgaagagcaagctcaacacttaaatttcaccgaaatgaatatatttttttccgagaggtggaacttggaaaaatctttgagtgatgaaatctagtcgtttgaagagcgaactcaacacttatatttcaccgaaatgaatatatttttccaagaggtggaactcggaaaaatccttgagggatgaaatctagtcttgtgaagtgcgaactcaacacttaagatttcaccgaaatgaatatatttttccgagaggtgaaacttggaaaactttttgagggatgaaatttagttttgtgaatagcaaactaaacacttagatttcaccaaaatgaatatatttttccaagaggtggaactcgaaaaaatccttgagggataaaatctagtcttgtgaaacgcgaactcaacacttagatttcactgaaatgaatatatttttccaagaactgcaacttggaaaattccttgagggacaaaatctattcttgtgaagagtgaactcaacacttcgatttcaatgaaataaatatatttttccaaaaggtgtaacttggaaaagtccttgaaggatgcaatctagtcttgtgaagagcgagctcaacacttaaatgtcaccgaaatgaatatattttttcaagaggtggaacttgaaaaatccttgagggatgaaatctagtcttgtgaagagcgaactcacttttagatttcaccgaaatgaatatatttttccaagaggtgtaacttggaaaaatcattaagggatgaaatctattcttgtgaagagcgaattcaacacttcgattttaccgaaatgaatatatttttccaaaaggtgtaacttggaaaaatccttgaaggatacaatctagttttgtgaagagcgagctcaacacttagatttcaccgaaatgaatatatttttccaagaggtggaacttggaaaaatccttgagggatgaaatctagtcttgtaaagagcaaactcaacacttagatttcaccgaaatgaatatatttttccaagaggtggaacttggaaaaatccttgagggatgaattctagtcttgtgaagtgcgaactcaacacttaaaatttcacttaaatgaatatttttttccgagaggtggaacttagaaaaatccttgagagataaaatctagttttctgaagagaaaactcaacacttagatttcaccaaaatgaatatatttttccaagaggtggaacttagaaaaatccttgacggatgaaatctagtcttgtgaagcgcaaactcaacacttagatttcaccgaaatgaatatattttttcaagaagtgcaatttggaaaaatccttgagggatgaaatctagtcttgtgaagagcgaactcaacacgtccatttctccgaaatgaatatatttttttaaaaggtgtaacttggaaaaatccttgaaggatgaaatctagtcttgtgaagagcgagctcaacacttagatttcaccgaaatgaatatatttttccaaaaggtggaacttkgaaaagtccttgagggatgaaatctagtcttgtgaagagcaaactcaacacttagatttcaccgaaatgaatatatttttccaagaggtgaaacttggaaaaatccttgagggatgaaatctagtcttgtgaattgcgaactcaacacttcagatttcaccgaaataaatatatatttctaagaggtagaacttggaaaaatccttgagagataaaatctagttttgtgaagagcaaactcaacacttagatttcaccaaaaatgaatatatttttccaagaggtggaacttggaaaaatccttgagggatgaaatctaatcttgtgaagcgcgaactgaacacttagatttcacctaaatgaatatatttttccaagaaatgcaacttggaaaaatctttgagggatgaaatctagtcttgtgaagcgcgaactcaacacttagattttaccgaaattaatatattttttcaagaaatgcaaattggaaaaatccttgtgggatgaaatctagtcttgtgaagagcgagctcaacacttagatttcaccgaaatgaatatatttttccaagaggtggaacttggaaaaatccttaagggatgaaatctagtcttgtgaagagtgaactcaacacttagatatcaccgaaacgaatatatttttccaagaggtggaacttggaaaaatacttgagggatgaattctagtcttgtgaagtgcgaacttaacacttaatattttacttaaatgaatatatttttccgagaggtggaacttggaaaaatccttgagagataaaatctagttttgtgaagagcaaactcaacacttagatttcaccaaaataaatatatttttccaagaggtgaaacttggaaaaatccttgacggatgaaatctagtcttgtgaagcgcaaactcaasacttagatttcaccgaaatgaatatatttttccaagaagtgcaacttggaaaaatccttgagggatgaaatctagtcttgtgaagagcgaactcaacacttccatttcaccaaaatgaatatatttttccaaaaggtgtaacttggaaaaatccttgagggataaaatctagtcttgtgaagagcaagctcaacacttaaatttcaccgaaatgaatatatttttttccgagaggtagaacttggaaaaatctttgagtgatgaaatctagtcttgtgaagagcgaactcaagacttatatttcaccgaaatgaatatatttttccaagaggtggaactcggaaaaatccttgagggatgaaatctagtcttgtgaagtgcgaactcaacacttaaaatttcaccgaaatgaatatatttttccgagaggtggaacttggaaaactttttgagggaagaaatttagttttgtgaatagcaaactaaacacttagatttcactataatgaatatatttttccaagaggtggaacttggaaaattccttgagggatgaaatctattcttgtgaagagcgaactcaacacttcgatttcacttaaataaatatatttttccaaaaggtgtaacttggaaaaatcgttgagggatgaaatctagtcttgtgaagagcgagctcaacacttagatttcgctgaaatgaaaatattttttcaagaggtgaagcttggaaaaattcttgaaggatgatatatagtattgtgaagagcgaactcaacacttagattttaccgaaacggatatattttaccaagaggtgttacttggaaaaatcattaagggatgaaatctattcttgtgaagagcgaattcaacacttcgattttaccgaaatgaatatatttttccaaaaggtgtaacttggaaaaatccttgaaggatacaatctagtcttttgaagagcgagctcaacacttagatttcaccgaaatgaatatattttccaagaggtggaacttggaaaaattcttgagggatgaaatctagtcttgtaaagagcaaactcaacacttagatttcaccgaaatgaatatatttttccaagaggtagaacttggaacaatccttgagggatgaattctagtcttgtgaagtgcgaactcaacacttaaaatttcacttaaatgaatatatttttccgagaggtgcaacttagaaaaatccttgagagataaaaattagttttgtgaagagaaaactcaacacttagatttcaccaaaatgaatatatttttccaagaggtggaacttggaaaaatccttgacggatgaaatctagtcttgtgaagcgcaaactcaacacttagatttcaccgaaatgaatatatttttccaagaagtgcaatttggaaaaatccttcagggatgaaatctagtcttgtgaagagcgaactcaacacttccatttcaccgaaatgaatatattttttaaaaggtgtaacttggaaaaatccttgaaggatgaaatctagtcttgtgaagagcgagctcaacacttagatttcaccgaaatgaatatatttttccaaaaggcggaacttggaaaagtccttgagggatgaaatctagtcttgtgaagagcgaactcaacacttagatttcaccgaaatcaatatatttttccaagaggtggaacttggaaaaatcctagagggatgaattctagtcttgtgaagtgcgaactcaacacttaatattttacttaaatgaatatatttttccaagaaatgcaacttggaaaaatccttgagggatgaaatctagtcttgtgaagcgcgaactcaacacttagatttcactgaaatgaatatattttttcaagaaatgcaacttggaaaaatccttgacggatgaaatctagtcttgtgaagagcgagctcaacacttagatttcaccgaaatgaatatatttttccaagaggtggaacttggaaaaatccttgagggataaaatctagttttgtgaagcgcaaactcaacacttagatttcaccgaaatgaatatattttcgaagaagtgcaatttggaaaaatccttaagggatgaaatctagtcttgtgaagagcaaactcaacacttccatttcaccgaaatgaatatatttttccaaaaggcggaactcggaaaaatccttcagggatgaaatctagtcttgtgaagtgcgaactcaacacttaaaatttcaccgaaatgaatatatttttccgagaggtggaacttggaaaactttttgagggaagaaatttagttttgtgaatagcaaactaaacacttagatttcaccaaaatgaatatatttttccaagaggtggaacttggaaaattccttgagggatgaaatctattcttgtgaagagcgaactcaacacttcgatttcactgaaataaatatatttttccaaaaggtgtaacttggaaaaatccttgaaggatgcaatctagtcttgtgaagagcgagctcaacacttaaatgtcaccgaaatgaatatatttttccaagaggtggaacttgaaaaatcgttgagggatgaaatctagtcttgtgaagagcgaactcacatttagatttcaccgaaatgaatatatttttccaagaggtgttacttggaaaaatcattaagggattaaatctattcttgtgaagagcgaattcaacacttcgattttaccgaaatgaatatatttttccaaaaggtgtaacttggaaaaatccttgaaggatacaatctagtcttgtgaagagcgagctcaacacttagatttcaccgaaatgaatatattttccaagaggtggaacttggaaaaatccttgaggcatgaaatctagtcttgtacagagcaaactcaacacttagatttcaccgaaatgaatatatttttccaagaggtagaacttggaaaaatccttgagggatgaattctagtcttgtgaagtgcgaactcaacacttaaaatttcacttaaatgaatatatttttccgagaggtgcaacttagaaaaatccttgagagataaaatctagttttgtgaagagaaaactcaacacttagatttcaccaaaatgaatatatttttccaagaggtggaacttggaaatatccttgacggatgaaatctagtcttgtgaagcgcaaactcaacacttagatttcaccgaaatgaatatatttttccaagaagtgcaatttggaaaaatccttcagggatgaaatctagtcttgtgaagagcgaactcaacatttccatttcaccgaaatgaatatattttttaaaaggtgtaacttggaaaaatccttgaaggatgaaatctagtcttgtgaagagcgagctcaacacttagatttcaccgaaatgaatatatttttccaaaaggcggaacttggaaaagtccttgagggatgaaatctagtcttgtgaagagcgaactcaacacttagatttcaccgaaatgaatatatttttccaagaggtggaacttggaaaaatcctagagggatgaattctagtcttgtgaagtgcgaactcaacacttaatattttacttaaatgaatatatttttccaagaaatgcaacttggaaaaatccttgagggatgaaatctagtcttgtgaagcacgaactcaacacttagatttcactgaaatgaatatattttttcaagaaatgcaacttggaaaaatccttgacggatgaaatctagtcttgtgaagagcgagctcaacacttagatttcaccgaaatgaatatatttttccaagaggtggaacttggaaaaatccttgagggataaaatctagttttgtgaagcgcaaactcaacacttagatttcaccgaaatgaatatatttttcgaagaagtgcaatttggaaaaatccttcagggatgaaatctagtcttgtgaagagcaaactcaacacttccatttcaccgaaatgaatatatttttttaaaaggtgtaacttggaaaaatccttgaaggatgaaatctagtcttgtgaagagcgagctcaacacttagatttcaccgaaatgaatatatttttccaaaaggcggaacttggaaaagtccttgagggatgaaatctagtcttgtgaagagcgaactcaacacttagatttcaccgaaatgaatatatttttccaagaggtggaacttggaaaaatcctagagggatgaattctagtcttgtgaagtgcgaaatcaacacttaatattttacttaaatgaatatatttttccgagaggtggaacttggaaaaatccttgagagataaaatctagttttgtgaagagcannnnnnnnnnnnnnnnnnnnnnnnnnnnnnnnnnnnnnnnnnnnnnnnnngatgcaatctagtcttgtgaagagcgagttcaacacttaaatttcaccgaaatgaatatatttttccaagaggtggaacttggaaaaatcctagagggatgaattctagtcttgtgaagtgcgaaatcaacacttaatattttacttaaatgaatatatttttccgagaggtggaacttggaaaaatccttgagagataaaatctagttttgtgaagagcaaactcaacacttagatttcaccaaaataaatatattttttcaagaggtgaaacttggaaaaatccttgacggatgaaatctagtcttgtgaagcgcaaactcaacacttagatttcaccgaaatgaatatatttttccaagaagtgcaacttggaaaattccttgagggatgaaatctattcttgtgaagagcgaactcaacacttcgatttcaccgaaataaatatatttttccaaaaggtgtaacttggaaaaatccttgaaggatgcaatctagtcttgtgaagagcgagttcaacacttaaatttcaccgaaatgaatatatttttccaagaggtggaacttggaaaaatcctagagggatgaattctagtcttgtgaagtgcgaaatcaacacttaatattttacttaaatgaatatatttttccgagaggtggaacttggaaaaatccttgagagataaaatctagttttgtgaagagcaaactcaacacttagatttcaccaaaataaatatattttttcaagaggtgaaacttggaaaaatccttgacggataaaatctagtcttgtgaagcgcaaactcaacacttagatttcaccgaaatgaatatatttttccaagaaatgcaacttggaaaattccttgagggatgaaatctattcttgtgaagagcgaactcaacacttcgatttcaccgaaataaatatatttttccaaaaggtgtaacttggaaaaatccttgaaggatgcaatctagtcttgtgaagagcgagttcaacacttaaatttcaccgaaatgaatatatttttccaagaggtggaacttggaaaaatcctagagggatgaattctagtcttgtgaagtgcgaaatcaacacttaatattttacttaaatgaatatatttttccgagaggtggaacttggaaaaatccttgagagataaaatctagttttgtgaagagcaaactcaacacttagatttcaccaaaataaatatattttttcaagaggtgaaacttggaaaaatccttgacggatgaaatctagtcttgtgaagcgcaaactcaacacttagatttcaccgaaatgaatatatttttccaagaagtgcaacttggaaaaatccttgagggatgaaatctagtcttgtgaagagcgaactcaacacttccatttcaccaaaatgaatatattttcccaaaaggtgtaactgggaaaaatccttgagggatgaaatctagtcttgtgaagagcaagctcaacacttaaatttcaccgaaatgaatatatttttttccaagaggtggaacttggaaaaatttttgagtgatgaaatctagtcttgtgaagagcgaactcaacacttatatttcaccgaaatgaatatatttttccaagaggtggaacttggaaaaatccttgagggatgaattctagtcttgtaaaatgcgaactcaacacttaaaatttcacttaaatgaatatatttttccgagaggtggaacttggaaaaatccttgagagataaaatctagttttgtgaagggaaaactcaacacttagatttcaccaaaatgaatatatttttccaagaggtggaacttggaaaaatccttgacggatgaaatctagtcttgtgaagcgcaaactcaacacttagatttcaccaaaatgaatatatttttccaagaagtgcaatttggaaaaatccttgagggatgaaatctagtcttgtgaatagcgaactcaacacttccatttcaccgaaatgaatatatttttttaaaaggtgtaacttggaaaaatccttgaaggatgaaatctagtcttgtgaagagcgagctcaacacttagatttcaccgaaatgaatatatttttccaaacggtggaacttggaaaagtccttgagggatgcaatctagtcttgtgaagagcgagttcaacacttaaatttcaccgaaatgaatatatttttccaagaggtggaacttggaaaaatcctagagggatgaattctagtcttgtgaagtgcgaaatcaacacttaatattttacttaaatgaatatatttttccgagaggtggaacttggaaaaatccttgagagataaaatctagttttgtgaagag

SEQ ID NO: 187 - DNA, 59590 bp, Arabidopsis thaliana
  modified_base (2521)..(57768): N = A, C G, or T/U
cggtataaaagttctagagtcatacatttatgacaaaaaaaaagagaaaaaccgaaaaaaagagggatgcaacacgaggactttcctggaggtcacccatcctagtactactctcgcccaagcacgcttaactacagagttctgatgggatctggtgcattagtgctggtatgatcgcatccgttactacatgcaatgcaattgtatctatttttttttgaagactttatgatccatttgccgtgggtcccaccagctgtgtaggaataccctatcttgtttataagaagtttgatacatgcaaaatattcgaaaataatgtccgaacatataattttggccccgtaatataacaaagataacgaaaaggctctaaaaagtacattaaaatcaaaatttggagaaggaaaaaaaccaatagaagaattccattttccttcctcattcatcggagagctctctttgggctttccgaaaaggtatcacatgtcaagtttggcctcacggtcttaaagttatagagtcatacatttataacaaaacaaaaagagggatgacacacgaggactttcctggaggtcacccatcctagtactactctcacccaagcacgcttaactgtagagttctgatgggatatggtgcattagtgctggtatgatcgcatccgtaactacatgcaatgcaatcgtatctattcttttttgaagactttatgatcgatttgccgtgggtcccaccagctatgtaggaataccctatcttgtttataagggctttgatacatgcaaaatatacgaaaacaatgtccgtaaatataaattttgccccgtaatatagcaaagattacgaaaaggcctgaaaaagtacattaaggtcaaaatttggagtagaaaaaaaaactatagaagaattccattttccttcctaattcatcggggagctctctttgggctttccgaaaaggtatcacatgtaaagtttggcctcacggtcttaaagttatagagtcatacatgtttaacaaaacaaaaagagggatgacacacgaggactttcctggaggtcacccatcctagtactactcttgcccaagcacgcttaactgcagagttctgatgggatctggtgcattggtgctggtatgatcgcatccgtaactacatgtaatgcaatcgtatttattcttttttgaagacttaatgatcgatatgccgtgggtcccaccagctgtgtaggaataccctatcttgtttatgagaggtctgatacatgcaaaatattcgaaactaatgtccgaacatataattttcgccctgtaatatagcaaagataacgaaaaggctcgaaaaagtacattaaaatcaaaatttggagtaggaaaaaaaacaatagaaaaattccattttccttcctcattcatcggagagctctctttgggctttccgaaaaggtatcacatgtcaagtttggcctcacagtctgttatagagtcatacatttttaacaaaaaaaaagagaaaaaccaaaaaaaaagagggatgacacacgaggactttcctggaggtcacccaccctagtactactctcgcccaagcacgcttaactgcggagttctgatgggatctgatgcattagtgctggtatgatcgcatccgtaactacatgcaatgcaatcgtatctattcttttttgaaaactttatgatcgatttggcgtgggtcccaccagctatgtaggaataccctatcttgtttataagagctttgatacatgcaaaacattcgaatacaatgtccgaacatataattttcgccctgtaatatagcaaagattacaaaagacccgaaaaagtacattaaggtcaaactttggagtagaaaaaaaaaactatagaagaattccattttccttccttattcatcggagagctctctttgggctttccgaaaaggtatcacatgcctcagggtctaaaagttctagagtcatacatttttgaccaaaaaaaaagagaaaaaccgaaaaaaaagagggatgcaacacaaagactttccaggaggtcacccatcctagtactactctcgcccaagcacgcttaactgcggagttctgatgggatctggtgcattagtgctggtatgatcgtattcgttactacatgcaatgcaatcgtatcaattcttttttgaagactttatgatccatttgccgtgggtttcaccaactatgtaggaataccttatcttgtttataagagctttgatacatgcaaaatattcgaaaacaatgtccgaacatataattttcgcccgtaatatagcaaagatcacgaaaaggctcgaaaaagtacattaaaatcaaaatttggagtaagaaaaaaaaaccaataaaagaattccattttccttcctcattcatcggagagctctctttgggctttccgaaaaggtatcacatgtaaagtttggcctcacggtcttaaagttataaagtcatacatgtttaacaaaacaaaaannnnnnnnnnnnnnnnnnnnnnnnnnnnnnnnnnnnnnnnnnnnnnnnnntggtatgatcacatctgtaactacatgcaatgcaatcgtatctattcttttttgaagactttatgatcgatttgccgtgagtcccaccagctatgtaggaataccctatcttgtttataagagctttgatacatgcaaaatatacgaaaacaatgtccgtacatataattttcgccccgtaatatagcaaagattacgaaaaggcctgaaaaagtacattaaggtcaaactttggagtagaaaaaaaaactatagaagaattccattttccttcctaattcatcggagagctctctttgtcctttccgaaaaagtatcacatgccaagtttggcctcacggtctaaaagttctagagtcatacatttttgacataaaaaaaagagaaaaaccgaaaaaaagggataaaacacgaggactttccatgaggtcacccatcctagtactactctcgcccaagcacgcttaactacggagttctgatgggatctggtgcattagtgctggtatgatcacatccgttactacatgcaatgcaattgtatctatttttttttgaagactttatgatccatttaccgtgggtccgaccagctgtgtaggaataccctatcttgtttataagagctttgatacatgcaaaatattcgaaaataatgtccgaacatataattttggccccgtaatatagcaaatataacgaaaaggctcgaaaaattatattaaaatcaaaatttggagaaggaaaaaaaactatagaagaattctattttccttcctcattcatcggagagctctctttgggctttccgaaaaggtatcacatgtcaagtttggcctcacggtcttaaagttatagagtcatacatttttaacaaaacaaaaagagggatgacacacgaggactttcctggaggtcacccatcctagtactactctcgcccaagcacgcttaactgtagagttctgatgggacctggtgcattagtgctagtatgatcgcatccgtaactacatgcaatgcaatcgtatttattcttttttgaagactttatgatcgatttgccgtgggtcccaccagctatgtaggaataccctatcttgtttataagagctttgatacatgcaaaatatacgaaaataatgtccgtacatataattttcgccccgtaatataacaaagattacgaaaaggcccgaaaaagtacattaaggtcaaaatttggagtagaaaaaaaaactatagaagaattccattctccttcctaattcatcggagagctctctttgggctttccgaaaaggtatcacatgccaagtttggcctcacggtctaaaagttctagagtcatacatttttgacaaaacaaaaagagaaaaaccaaaaaaaaagagggatgcaacacgaggactttccaggaggttacccatcctagtactactctcgcccaagcacgcttaactacgtagttctgatgggatctggtggattagtgctggtatgatcgcatccgttactacatgcaatgcaattgtatctattcttttttgaagactttatgatccatttgccgtgggtcccaccacctgtgtaggaataccctatcttgtttataagagctttgatacatgcaaaatattcgaaaacaatgtccgaacatataattttggccccgtaatatagcaaagataatgaaaaggctcgaaaaagtacattacaatcaaaatttggagaaggaaaaaaacaaatagaagaattccattttccttactcattcatcggagagctctctttgggctttccgaaaaggtatcacatgtcaagtttagcctcacggtctaaaagttctagagtcatacatttttgacaaaacaaaaagagaaaaaccaaaaaaaaagagggatgcaacacgaggactttccaggtggtcacccatgctagtactactctcgccaaagcacgcttaagtgcggagttctgttgggatctggtgcattagtgctgctatgattgcattcgttactacatgcaatgcaatcgtatctattcttttttaaagactttatgatccatttgtcgtgggtttcaccaactatgtaggaataccttatcttgtttataagagctttgatacatgcaaaatattcgaaaacaatgtccgaacatataattttcgcccgtaatatagcaaaaatcacgaaaaggctcgaaaaagtacattaaaatcaaaatttggagtaagaaaaaaaaccaatagaagaattccattttccttcctcattcatcggagagctctctttgggctttccgaaaaggtatcacatgtcaagtttggcctcacggtcttaaagttatagagtcatacatgtttaacaaaacaaaaagagggatgacacacgaggactttcctggaggtcacccatcctagtactactctcgtccaagcacgcttaattgcagagttctgatgggatctgatgcattagtgctggtatgatcacatctgtaactacatgcaatgcaatcgtatctattcttttttgaagactttatgatcgatttgccgtgagtcccaccagctatgtaggaataccctatcttgtttataagagctttgatacatgcaaaatatacgaaaacaatgtccgtacatataatttttgccccgtaatatagcaaagattacgaaaannnnnnnnnnnnnnnnnnnnnnnnnnnnnnnnnnnnnnnnnnnnnnnnnntatacgaaaacaatgtccgtaaatataaattttgccccgtaatatagcaaagattacgaaaaggcctgaaaaagtacattaaggtcaaaatttggagtagaaaaaaaaactatagaagaattccattttccttcctaattcatcggggagctctctttgggctttccgaaaaggtatcacatgtaaagtttggcctcacggtcttaaagttatagagtcatacatgtttaacaaaacaaaaagagggatgacacacgaggactttcctggaggtcacccatcctagtactactcttgcccaagcacgcttaactgcagagttctgatgggatctggtgcattggtgctggtatgatcgcatccgtaactacatgtaatgcaatcgtatttattcttttttgaagacttaatgatcgatatgccgtgggtcccaccagctgtgtaggaataccctatcttgtttatgagaggtctgatacatgcaaaatatttgaaactaatgtccgaacatataattttcgccctgtaatatagcaaagataacgaaaaggctcgaaaaagtacattaaaatcaaaatttggagtaggaaaaaaaacaatagaaaaattccattttccttcctcattcatcggagagctctctttgggctttccgaaaaggtatcacatgtcaagtttggcctcacagtctgttatagagtcatacatttttaacaaaaaaaaagagaaaaaccaaaaaaaaagagggatgacacacgaggactttcctggaggtcacccaccctagtactactctcgcccaagcacgcttaactgcggagttctgatgggatctgatgcattagtgctggtatgatcgcatccgtaactacatgcaatgcaatcgtatctattcttttttgaaaactttatgatcgatttggcgtgggtcccaccagctatgtaggaataccctatcttgtttataagagctttgatacatgcaaaacattcgaatacaatgtccgaacatataattttcgccctgtaatatagcaaagattacaaaagacccgaaaaagtacattaaggtcaaactttggagtagaaaaaaaaaactatagaagaattccattttccttccttattcatcggagagctctctttgggctttccgaaaaggtatcacatgcctcagggtctaaaagttctagagtcatacatttttgaccaaaaaaaaagagaaaaaccgaaaaaaaagagggatgcaacacaaagactttccaggaggtcacccatcctagtactactctcgcccaagcacgcttaactgcggagttctgatgggatctggtgcattagtgctggtatgatcgtattcgttactacatgcaatgcaatcgtatcaattcttttttgaagactttatgatccatttgccgtgggtttcaccaactatgtaggaataccttatcttgtttataagagctttgatacatgcaaaatattcgaaaacaatgtccgaacatataattttcgcccgtaatatagcaaagatcacgaaaaggctcgaaaaagtacattaaaatcaaaatttggagtaagaaaaaaaaaccaataaaagaataccattttccttcctcattcatcggagagctctctttgggctttccgaaaaggtatcacatgtaaagtttggcctcacggtcttaaagttataaagtcatacatgtttaacaaaacaaaaagagggatgacacacgaggactttcctggaggtcacccatcctagtaatactctcacccaagcacgcttaactgtagagttctgatgggatatggtgcattagtgctggtatgatcgcatctgtaactacatgcaatgcaatcgtatctattcttttttgaagactttatgatcgatttgccgtgggtcccaccagctatgtaggaataccctatcttgtttataagagctttgatacatgcaaaatatacgaaaacaatgtccgtacatatatattttgccccgtaatatagcaaagattacgaaaaggcccgaaaaagtacattaaggtcaaaatttggagtagaaaaaaaaactatagaagaattccattttccttcctaattcatcggagagctctctttgggttttccgaaaaggtatcacatgccaagtttggcctcacggtctaaaagttctagagtcatacaattttgacaaaaaaaaaaagagaaaaaccgaaaaaaagagggatgcaacacgagaactttccaggaggtcacccatcctagtactactctcccccaagcacgcttaactacagagttctgatgggatctagtgcattagtgctggtatgatcgcatccgttactacatgcaatgcaattgtatatattcttttttgaagactttatgatccatttgccgtgggtcccaccagctatgtaggaataccctatcttgtttataagagttttgatacatgcaaaatattcgaaaataatgtccgaacatataattttggccccgtaatatagcaaagatcacgaaaaggctcaaaaaagtacattaaaatcaaaatttggagaagaaaaaaaaccaatagaagaattccattttccttcctcattcatcggagagctctctttgggctttccgaaaaggtatcacatgttaagtttggcctcacggtgttaaagttatagagtcatacatttttaacaaaacaaaaagagggatgacacacgaggactttcttggagatcacccatcctagtactactctaccccaagcacgcttaactatagagttctgatgggatctggtgcattagtgctggtatgatcgcatccgtaactacatgcaatgcaattgtatctattcttttttgaagactttatgatcgatttgacgcgggtcccttcagctatgtaggaataccctatcttgtttataagagctttgatacatacaaaatatacgaaaacaatgtccgtacatataatttttgccccgtaatatagcaaagattacgaaaaggcccgaaaaagtacattaaggtcaaaatttggagtagaaaacaaaactatagaagaattccattttccttcctaattcatcggagagctctctttgggctttccgtaaaggtatcacatgccaagtttggcctcacggtataaaagttctagagtcatacatttatgacaaaaaaaaagagaaaaaccgaaaaaaagagggatgcaacacgaggactttcctggaggtcacccatcctagtactactctcgcccaagcacgcttaactacagagttctgatgggatctggtgcattagtgctggtatgatcgcatccgttactacatgcaatgcaattgtatctatttttttttgaagactttatgatccatttgccgtgggtcccaccagctgtgtaggaataccctatcttgtttataagaagtttgatacatgcaaaatattcgaaaataatgtccgaacatataattttggccccgtaatataacaaagataacgaaaaggctcgaaaaagtacattaaaatcaaaatttggagaaggaaaaaaaccaatagaagaattccattttccttcctcattcatcggagagctctctttgggctttccgaaannnnnnnnnnnnnnnnnnnnnnnnnnnnnnnnnnnnnnnnnnnnnnnnnnccaaagagagctctccgatgaattaggaaggaaaatggaattcttctatagtttttttttctactccaaattttgaccttaatgtacttttttgggccttttcgtaatctttgctatattacggggcgaaatttatatgtacggacattgttttcgtatattttgcatgtataaagcacttataaacaagagagggtattcctacatagctggtgggacccacggcaaatcgatcataaagtcttcaaaaaagaatagatacgattgcattgcatgtagttacggatgcgatcataccagcactaatgcaccagattccatcagaactctacagttaagcgtgcttgggtgagagtagtactaggatgggtgacctccaggaaagctcataagttagagttttactatgtgtgatgttcaattctatagtgtgttgacttgtgaggatattgatatgtgtttgcatgaagagaaattgggaagaccggtccctcttggtgaggtgttaatctagacacacactaagtcggatggaacatatgttaatcggaaggcggagaagattgctctaacttatgagcagtatgtgagagataggctgtctgaactagaggcggctgcttctactgtctctcatgactcttcacgacctcaggagctcacaatagatgagtatacaaccatctttcttcaggtaagatgttgtagtctaattcagagtcttagagtccagttactattcagtcactaattatcttcttctctatttcttgcagtccacacaaagggattcaaggggcaatcattatggacttagatgtctgaaagacgctctaggcagtgccaactgccaactccccggagactcatcatcctttcaagccttagaagaactgctataggaagctcaacggaaaattgaagagcaagttgcatataatgagaagcgagatgctgagattgctgctcgagaagctgagtcagcccgagtcacagctgagcaaaaggacaagctcgagcacttgttcttggacttcatggccactcactcttccacatccaaagagcgtctcccaagtactccaccacctaatgatccatagattttatttttccaaacactacttgaacttatgtttatttgaataagttttttgtttatgaacaacataattttctgtgtatttgaacttgatttttaatatatgtatgtcttttcatattttaatagcatttccaataacaaacaagaacaaatcataactttaaacaacaaacaagaaacccaacaatcaatgaccaaattcttattctgacaaaacaagtagtcgcaaaatagtagtaaataagtagcaacgtagacgtaaaacagtcgtaaaataggcacaaaacttatcgactattaccagactaaccaaattagtcataacctaatcgtcatagagacgtataatagtcgtataaatttatacaactatgatatgactaagagaatcatatcctttgtacagtacaatttatcgtccaatagtcgtaagattgtcgtaaaacgttttacgactattttacgacaacgtgaaacatacccagggttcagtgtatttaattgtaaagtagtcgtaatttcgtcgtaaacaattaccgactatggaacgagtacaagtttcacacgctctgtacaatactattaatcgttaaatggtcgccagataatacgattattaaacgacgaatttatactgtatgggcttatgtcgtaacatagtcgtaaatcgatgactaattgacgactacattacttagcaactatgtactaacgactttagtcattaatcgcggattagttgtattattaacattgacaactactaagcaactacttatgtagtcgtttatcgcctgttttcttgtagtgtggttatttatgaaaaactatgagtttcatcgattgggtcgcatttcggttctctggagacctacagtgtgagtcactccagttatcaaaagtgatcaaatcataaaatgttctgttttgatggaaggaaagatggaggaattgttttgttcttttgtctatgcaaggaatactgtagaggagaggaaaagtttatgggaggacttgagaagccattaagactcgccgctatttaaaaaaaaaacttggataattatgggtgattataatgagatccttgatgggagggagcattgtgaatttacacattcacctttcataccattaggtatgcaggatttccaaaatgttgtgagacactgtactttgacggatatgggttctctagaaccgttattcacctggtgtaacaagcggggggaaggcttaatttgtaaaatattggaccgtgtccttatgaatgatatttggcttcatcgatactgatataggtcaaattgccctaaatttactccctcaaataagagatcgtggttagtacttaaaggtcgaattccacaaagctattttgttcacacaataggccaaagtgtcaaaattaagctagatgaatataaaaaataaaaagaaagtaaaataagcaaataacagattgattggttgtaagacaagataataaaacgtcaggtttagggtattcttaggaaacacatgattagtagttctagaaatacctaggttgttatcgaaccgttcttaaactcaaactctaattatagaataatcagtgatgttccgtgaaactcactatgcccagagctaaaaattttggtgatgtgccttgaagattaaaagtaattaagttttgaagattcaagaacaaaaagaaaaactaagagataaaagctagatccttcggacaaatcccaaagtgatctatttatactaaaatgttgaaaactctagattcactagaagacaagagacttgaggcggtttggacgattgctcgatcttggggatcgagtaaacagggtgctgcaaagtctgcgcctttgcctgcatgctctgagtgatcaattggtcgagtagatgcttcttcctctcctatctgtatgcttagatgtcttgttgattggggaatgaggaggatccgaagaggctttgatagatcaacaaatcttgtagagtaggtcgcccttggtcgagtaaatgggtcgagtagaggataaagtaagaggggcgagtaaactgatctgctgcttcctctgtggctgcctggatcgagtaaactgctcgagtgaattactgcctcctctgtagctgcctggatcgagtaaactggtcgagtagattgctatgttgcttccctcctggttggatagagtagagggtcgagtagaatccttgtaagctctttctgcacctgaaaacacaccaaaacatgcaatatgtatgcaagatgatcctaaatgcttaagtgtgcaaaataagctaaatgtgatgcaaaatgatatgatacaatgagtgatcactaagctaaatgatgataaatacatgcctaaaatgagtaaaatacaatgttatcacttgccctcaaagaaaacataaaagccgaacccgtggaagaggttttgaaaaacaaaggaactcccaacattctttagtcttttgccatgattattgtaaccaaatccatatgcctagcaagtctaatcaaattctaaccaacatgtacttctccgcaagcttacacaacattctagattccatacctaagtttctcaactatatccacgagatcgcccatcccacttcttaaatcaaagataaagaatacctccgttttgaagagaagaatctcacaaagaatggaatgaatgaagattcaaacctcagacaattagaattttagcgtatctttgaaccgtctaagtattgtataaaaggactctagaaataacaaaaagacacaaaaacctatatttaaaacatagctaaaaacagtaaaaatagcagtacctatcacagggatttgaattaggtgtgggctgtgaaggaggtgcagaatcatcagtctctcaagcgcaatggtgtcgatcgatagggggtgtggtgtcgagcgacactagttctttgcagctttcatctgcgagcttggaggtgaaatctgagcagccatagaagatgtgtctttgttggtggcaatactcctgataggcactataaattttgaaccatccatgccgaactccatctccacatcgcatatgttaagggagatcctatctttcttcacatcaatcctagcaccaggtgtagctagaaaagctataccaaggatgagaggatccttgggttcttcatcatatgctaggaccacaaaatcagcagggatgaggcatttaccaagttttagaggaacatcatcgaggataccttgagggattcgattggaacgatccgcaaagaggagagtgatccttgttggcatgtagttagacatgcctagcttccctgcaacagacttgggcatgagattgattcttgttccaagatgacagaaggagtggctgaatcttctagtagatatcaagccgtcaagaacaaagctacctggatcagagagtatctcagtgctttgccctttggcagtggagctaacatgttcagaaagcactactctcttggacctgtcattcttgaccttcttcaacagtatggaactcatatctcttgtaagcagattggcttcctcggtgtgaagtccattgttgaccaagcgcttgacatatctcagaagttgagcagaagagttctctgaagcatcctttggaatgatagtcaagatcttctccattattgccttgcactttgcatcatgaatctcctgcttagaacaacgttttctcggatatggacatgaggagtgtaaataggtttgggctgcatagggatacgaacctcataagatgttgtgcggaccaagtgtagatcgacgctaggagtgtgtcaattgatactcttgttcataaatagttttggaaaactgttgaccatatggtgtcgatcgacattggtaggtgtcggtcgacaccagccctgcagctgcaagctccaacttgtcctctgtatccaatttctcctatatattgtctccatctctaaccaagatagcattgtaggtctttcgaggattagtgtctagagtgccaaaaagaaaccttcttgtctcttgatagactaagaagtttgagctacttgaacatctagcttcttcatgtaagagctcagattgtcgatcttcccattaagatctgtgtagatagcgtcaaacttgctattgaagtccacaactaacttggactgaccctcaagaatctgctcaagcattgattcgttcttactctcagcagtgggtggaggaggggtttggtaataagaattaccataagtcctagtaaagttgctatgaggatatgccttttggaaggcagattttgaggtgaaacttgaagaactctgttctctgtaaacttgttgccactaaataattaagttaattaggaggttagttaattatgcttagcataggtaactggatcctcggttatacgttaagtcgtataatcgatttatcgttgttattagatcttgtgttgcttaatttattatgattgataataggtttttagtcaattatcctaaaacaccaatcatgtcattgtagtattttaggttgtcaatccaaatgggtgtgatgttagcaatcaagatgcaatcagagttcacagagtcaagccaaacaataacaggtttggggtgttctaggagtcctaagtgaacatgcaggaaacagaaattcaaggagtaaaaacactcgaccaacccaacttgttgccaagcactgggtgtggtcgagtaacagacaaaagatgtaacagggttactcgaaagcacagtatgttgccaaataaccgagtggtcgagtatcaggtcgagtaacatgagagaaatgcaaaaactaagcaataggtaacaagatgaagtaatcaacagcagagtaaacaaaaaaatcaatcagataaagaattcatgcggatggggtaattgagtagtttcgtttcctcagtttacaggtgattgacatactcaataaattatcgatagaaaacaagttcgataaccaaatctaagtgccaccgcaacagagaccctcaagttaaaccagtcctagactcaataaccattgacgagagctaacttaacaggcattaacgaatcaacaagttaaagccaaaacgttccatgtaaccaataccttggtaaagagccacgaatctctggaattagtgattcagacatctcatcgaacacctttcgggtgcggatttgtctggggttaaattccagttgatcaaaaaagcaataggcattaagaataactaatccagagaagggaactataaatcaaactcaaccacctaacatactgagaattctgaagtactccaacccatcctcagaaacctagtcactactcaaacatcattgcagagaacataaacgatgataagaatgaaaccatgatagcaacaaagtaatagaaggatgataacaggatgaacaacttagtaaacgaaatcaaaagcaaatactgaatactgaatagattaagagaaatccagattacgaaaacatcaagaacacagtgtcgacggaaaataaaacttaggtaaacgaaaaggtaaaatacatgctacttatagcaaaatattccgaaaccctaatacccaaaacgacccagtattgggacggattaagaacagtactcgacccaggtggtcgagtgattggtcgagtgataagctggagtcttcttctcttccttgtgcttgagtgtctcgttgaatgcggaatggagaagactcggaagctggtagtcgagtatgaagtcgagttatggagatggtggtactcggcttggtggtagagtgatctgtagcgttcgcgatcctcgataggatcgccggataggacttggtctgagggagaaggtggactctcgggcaagtccagaattgggctgtaatacagctcaatacaagctcgaccagctccagagtagctcggccagctccagagtagctcggccagctcaaggttaggtcggccagctcgaggggaagctcggccaactcgagggagtgtcagtcagctccgccagctcgaccaagctaggaagggagtgaggcggttgggccaacggttggccaggcggttggaaggttgagcggttggacagttggcggttgggcggtcgaacggttacccctctttgtctaaagtcgccttggaacctttataggccaaaaggtgccttttcgggtgagaatagttaccgcccgaatccctataaatagaagggtcttggatgcgatttgggacacagaaaaacacggggaaactcactaaaactctctagggcgtcttggagaggaaattacttaaaagagatcgccggttttcagaggaaactcgttggcaggagagattggcaagggaaaggtgaggattccatggtcaaccatcggaatgttagttctaatagggcaatcggttaataggtcgatatagacttgtttgagcgggttataatatgttttgcatgatcaggcataagcatgtttatactcggcatgattcggcaggttaaacagatgggctgaatagggcatgcggctcggcaaggaatcggagggcgtgatcgatccgacgcttctaggccgaactgatgcgcttacttcctttctcccaatttgtttttccgaatgagtcatcaccgaaacaaagcaagattgcatggtttgattgtatgcgctaagtgaaccgatattgtgtaccttgttggcttttcagggaaagaaggggatcgtgggaaggaattggcttaggcgcgagactcaagggcgggaagatgagtggtgatggaagtcgggtagctgggatcgattatatgacttgtaatagcttatatgcaaaactcattagttgtatcgaatacttttacttatataaataaagccccgattcttgtttattctaatcttttgtgcatatgactctagtaatgaatctcagaatatgatagaaatagaatgtgttaaagaatggaccctaaaatcggattaaggattggattagtgattcgtccatgggaaacctcaccggattggaaatctgggaatgggaccctacaagttggtataagagcgattacggtcctaggatctttagtatgggttgggggtcattactcgtccgcttaatgagatctcgcggtagacgttttcttataccctaacgattacttttaagtttatgtggctaacttttgagttttcgcagatgggtaagagggaaaaggctgggaggagtaagaaagacaagggtgttgtcgaagagacagtggttttcgatgagacgcaagtcattgaggaaacaagggtcgagacaacaaaggatgggactaatccggctggaaccgtggttgggcaagactctccgattcgtcaagatctagagaatagcgatgcatcggatgggaaggagaatccggatgcaacatcatcggcccaagagcagtgggacatgataaaagcgatgatggcacaattggccacattgactaaatcccttgtgccagtcatgtggcacaagcggttgaaaatccgagggatggtgattgggagttgtggaagtcattccaccatctcattcttcgaggaagagggaagactatttgaacttacttgagcacgtctcgaagttgggaacaaggcatttcatgggaagttctgattcgatcgttaccgatgaatggaggagaaactcatgaatcaggaaaagattcgaaccgctcaaacttggcaagcaagtccactgacaagaaaaggaagtgagacaaggtagataacaccaagtccaattctaagcgcgaggaatgtccgacttgtggaaagaatcatagcggaacttgctggaaggccataggtgcatgtggccggtgtggaagcaaggaccatgcgattcaaagttgcccaaggatggatcacgggaaaccaaaggctcccggctatgaaccaaggacttgttatcattgcgggcaagaagggcactttaagagagaagaaggatggtagttttagactatgcatcgattatcggggattgaatagagttacggtgaaaaacaagtatcttctaccccggatagatgagctattggatcaattaaaaggggcgaagtggttttctaaactcgacttagcctcgagataccatcaaatccctatagatccaagggatgttcggaaaacggccttccggacacattatggccacaatgagtttgtggtgatgccgttcggactgaccaatgcgccagcagccttgatgaagatgatgaatggtgttttccgagaattcctagatgagtttgtgatcatctttattgatgacatactagtttattcaaaggatgaaggaacccatcaaaatcatctaagggcggttttggagagactaagaggacataagctatttgcaaaactaagcaaatgttccttttggcaaaggcgagttggatttctcgggcacattgtctccgatcaaggagtctccgtggatcctgagaaagtcaagtccataaaggaatggcctcggataaagagtgcgaccgagattaggagtttccttggtttggccgggtactatcagagatttgtgaaagggtttgcgagcatggctcaacccttgactagactcaccggaaaagacactaagttacaatggtcggatgagtgcgaaaagagcttcgccgacttgaagttgatgctaacaagtgctctggtgctaaccttgccagaagcagatgagccgtacattgtgtacacggacgcatcaataacgggattagggtgtgtccttatgcaaaagggtagtgtgatcgcttatgcctcacggcaattacgcaagcacgggggtaattaccctacgcatgatttggaaatgtttgccgtaatgttcgccttgaagatttggcgatcttacctctatagtgccaaggtccaaatcttcaccgatcacaagagccttaagtacatattcacccagccagaattaaatctacggcaaagaaggtggatggagttggtggcggattatgacttagatatcgcttatcatcccggaaatgtaaaccaagtggcggacgcctcaagtcgaagacgatgtgaggtagaagcagagaagaatcatgaagcgttggtgaacatgatggggacattgcatttgaatgtgttatcaaaagagttggagccattaggcttggatgcggccgatcaggcgaacctacttagtagaatccgattggctcaagggcaggacaaggatttgatgaaattggaggagaataataaaacggagtatgaaacttcaaacaatggaaccattgtggtgaacgggcgagtgtgtgtcccggccgataaggggctaagggaggaaatacttagagaagcacatcaatctaagttctccatttacccgggattacaaaggatgtaccatgatctgaaaaggtattatcattgggtgggaatgaagaaggatgtggcaagctgggttgcccggtgctcaacatgccaactagtcaaggcagaaagccaagctcctagcagactagttcaaaccttaccaatgccggaatggaaataggaacacatgacgatagacttcgtaacgggattgccaacaagtccattaaaacatgatgcggtatgggtagtggtcgataggttgaccaagtcggcacactttctagcgatcgcagaaaccgatggagctgaacggattgaagaaaggtacataaaagacatcgttcgactatacatggggtacccgtgagtatagtctctgaccgggatactcgattcaattcaaatttttgaagggctttccaaaaagccctaggaacaagagtgaatatgagcacgacgtaccatcatcaaaccgatgggcaatccgagcgaaccattcggactctagaagatatgcaaagggcatgtgttttagattggggtggaaactgtgagaagcatttgacgttgatagagtttgcatacaataacagttaccaaagaagtattggtaggtcgccttatgaggcactgtatagaagggcatgccggatgcccttatgttggatgcccgtgggcgaatgaatgctattcggtccagggattgtggacgagacgaatgaaaagatgaactttcttaaggttaagttaaaggtatctcagaaccgacagaagagttatacggataaacgttagaaagagttagaattcaaagtgggagatctagtgtatctaaaggcggtgacttacaaagggaaaggacgcttttccaagaggaaaaaacttagtccgagatacgtggggccatacaaggtgctcgaacggattggagtagtggcctacaagctcgatctaccaccaaagttaaaggcatttcataaggtttttcacttatcgcaacttaagaagtgcctaagcgaacaagatgaccctgtggaagatgtttccgccgaattagaaggaaacttgatgatgaaagcaaaacctatttgaatagtggatagattagagaaagggactcggaagaaaatcgtgaaaatggtgagggttgtgtggaattgcggagataaagaagaagatacttaggaaactgaaaacaagatgaaggcagatttcccggagtggttcaaagagatggacaaaaaggaacttgggtcggattcagggccgactacagctcaatacaagctaggccagctccagagtagctcggccagctcaaggttagcttggctagctcgaggagaagctctgccagctcgagggagtgttagtcagctccgccagctcgaccaagctaggaagggagtgaggcggttgggccaacggttggccaggcggttggacggttgagcggttcgactgttaggcggttgggcggttgggtggtcgaacagttacccctcttcgtcaaaagtcgcccaggaacggttatgggccaaaaggtgccttttcgggtgagaacggttaccgcccgaatccctgtaaatagaagggtcttggatttgatttgggacacagaaaaacacggggaaactcactaaagctctccagggcgtcttggagaggaaattacttaaaagagatcaccggttttcagagcaaactcgtttgcttgagagattggcgagggaaaggtgaggattccatggtcaaccatcggaatgttaatcctgatagggcgattggttaataggtcgatatagacttgttttggcgggttataatctgttttgcatgatcaagcataagcgtgttcatactcggcatgattcagcctgttaaacggatgggctgaatatgggatgcggctcggcaaggaatcggaggatcgtgatcaatccgacgcttctaggccaaactgatgcgcttacttcctttctcccaatttgtttttccgaatgagtcatcaccgaaacttagcaagattgcatggtttgattgtatacgctaagtgaaccgatgttgtgtgccttgctatcttttcagggaaagaaagggatcctgggaaggaattggcttaggcgcgagactcaaggccgggataatgagtggtgatagaagtcgggtatctaggattgattatatgacttgtaatagcttattggcaaaactcatgagttgtatcgaatccttttacttctataaataaagccatgattcttgtttattctactcttttgtgcatatgactctagtaatgaatatcagaatatgatagaaacggaatgtgttaaggaatggaccctaaaatcggattaaggatcggatcacttagtgatccgtccatgggaaacctcaccagattggaaatccgggaatgggaccctacatgatcggtcgagtgtgtgatgatggtgggactcgtccgtgtaatcgagtgagtgatcgagtgattgtgatgggggtgcttgacgaggaggtcgagtgatgtaatagagtgattgtcaggtggtggagataatgatactcgaccatggggtcgagtaatggtgtgaagtgatgaggccatctactcgactaggtggtcgagtggtgtgttgaagtcgtgaagccatcatctacttgactaggatgggtcgagtggtttgatatgatcaggtccgcttcttccaattagctcgccaacagctccaaatcacttgaaaacaacacaaatatgcaacatgcatgcaaaactatcctaaacatgcaaagtgatgacaaatgatgagaaatggtataaaacagttgtgatatgatgcaatagtgataacaaatggatgctcaaaaacatgtaaaatgtacacttatcaatgattgttgcttgatagtataaagtcgtggtcgtataacttttatgccggaaggatgttggtattgacgtcatgctgcccgactgttatactttgattgttagataactaggattagccaaatcatgaggattccatccgtatgttgtgtgtcgcatgtaactccgttctgttatggcatacaaaggctcgggctgtttcgctaccgacaaggcactacatgacgatgtaatataagaaaatgttaatcttctttacactttgtgtctaggagtgtgcaggccattgcctcggggtatcatgtgttcatagaaggccttacttaagtagttaggagcatgtttaggcatagtagtttcgctacatatagttgcttattgcattgcatttgattgcctctttgcttgttgtttgggggttgggttgggttttatttttatagatcccgcacttactgagtaatactagattactcaaatgctactttttttaaaaggcaacctttagtagggagaccttaaggggcaaaggacgttaggccaaccagtgtagatttgctttgcctttgtaagatatagttttgcgtatagtatgtaagactcgatatttttataaagatctgattttattaaaaccccatgtctcccaatgatgtatttagtcttgtctgactatcacaactcgcgtccgcggtacgagttacaaagccttaggccgtgtttgtgaggaacgacactcacggtcggacggcttgggtgaatggattcattccgggaacctgggttggctgactacgggcgtccacatgacgcttctattcgctcctggtcctaggacggggtaggagtgttacaaggtggtatcagagcatggttcatgatgctctcatggacgtgggatgatttttcgaatgttttatggagtcaaaagagtcacaaaggtaaattaggaaactggtcacgtccttggcaattatgttagataggataggatttacccttggatgtttgatgtaggtgtcttgccagaggatggagtgatgatgacaatgaggacgaatctatttttaaatagttttgtttccccattggttcgttctactataaggaaactggcaagacataaggtaaagcgatcgagaagataaacaaacaggcaattattattcttactaggtgatcacccgcgctacgccgcggtcttttcggattttttttatttttaatttaaatataatttttatttatctaatcattcactcatgcaataagcaacattaaaatatcaactgaaggagtttggagataatataagtcttagaatgacgactttatataaacttaaagactctcccagacactaacatcgaggagactaccctagcttcgccttccggcgccggtgatgcttttgctcaccggcgtcgggatttctcttcttcgtttcacttctttcgttatctcttcatatttttaattttgctctggctattatctcaatcatcccaacccaaccgtcaatcgtttaacttcctcggtcgttcattgaccatcgacagagggcagaggaaatgctcggtgatctttccttcgattcagcttttgtccgcatccatctttttgaagtttccaccaacagaacagccccaatttttccaatctaaaaccgctatgatctctacatgcaaaaccatccttacctccgacctgttttatgtgggtatctgataataggttttttaatcaattaaacctaaagcattatcatgtcgttgtagtactgaaggttgtcaatccaaatgggtgtgatgctaacaattaagatgtgatcagaagtcactaagtcaagccaagcaataacaggttgtggtgtgttctagcagttctaagtgaacatgcagaaaatagaaattcaagcagaaacagtaaaacactcgaccaacacagctctttgtagagcactgggtgaggtcgagtgacaggtcgagtaacagacagaaaataaaacacagatactcgactgcacagtctgttgctagacaactgggtggtcgagtatgaggtcgagtaacaagaaagaaccgcagaaattaagcgacagataacaagatgcagtaaacaacagtagagtaaacaaataattcaatcagataaagaattcctgaggatggggtaattgagtagttttgtttccttagtttacaggtgattgacatgctcaataaattaaccctagacaacaagttcattaaccaaatctaagtgccaccgcaatagagactctccagttaacctagtcccagactcaatcaccattgacgagagctaacctaacaggcattacgaatcaacaagttaaagccaaaacgctccctacaaccaataccttggtatagggccacgaatctctggaattagtggttcagacatttcgtcgaacaccttttgggcgcggaaatgtctgggctcaaattccagttgatcggaaagcaataggcattaagaacaactaatccagaagggatctatcaatcaatactcaattacctagcatactgagaattctacactactctaacccatcctcagaaacctattcactactcagacatcataacagaaagcataaacgttgaacaagctgaaaacatgataacaacagtgtaacagcaagaccaaaagctcaatactgaattctgaatagataaagagaaatccggattacaaaaggtctagaacacaaggtctggagaataaaactagataaaaaacttgtttgcaaaaatgtgaagtacatgctacttatagccaaatattctgaaaccctaatacttaaaacgacacagtattgggacggattaagaactgtactcgaatcatgtggtcaagtgggaggtcgagtgaatagttggagtcgtcttttcttccttgtgctcgagtgtctggttgagtgcggaatgaagaagaatctgaagcttgccatcgagtgtgtagtcgagtggtggtgatggtgatactcgacttccaggtagagtgatggggtcgagtgatgatcaggtaatggtggtaaagagactcgacctcggggtcgagtgatgtggtcgagtgatggtcaggtgatggagatgaggacactcgacctcgtggccgagtggtgaggtgaagtggtgatgtcttctacaagacctgggggtcgagtggtctcttgagatcttgaagctcctactcgccctctaggtcgagtggtttgtcatgatcaggtccactttttccagttagctcgtcaacagctccaaatcacctgaaatcaatacaaatatgcaacatgcatgcaaacctatcctaaacatgtaaagtgatgataaatgatgagaaatggtataaaacagtgatgatatgatgctaaaatgatgacaaatggatgctcaaaacatgtaaaatacacacttatcaactcccccaaacttagtctttgcttgccctcaagcaaacaatcaagcggggactcagagccaaagcaccaaataaaccagatgaaatcaatgtccaagttgaaaatttctaagctgcaagatcgaattctacttaaaaacgttagccatgcctcattatcaatcaatccgactcatatgctcgacctacacatgttttcaaatctaccaatccctttaacattcattagttctagaacgtgaatcaagcaatgcatcatcaatgaactcatttggctaaggtaataggtcaagagacaaagatggtcccttacagaataggcttcagtaacaggggatctctaaaaaaatgattaagctttagtagaatggtaaaggtaagtcccaagctatgcataaagagataagatcccatctacccagagtacatcaaatgaagctctaatggtaatcccatctccaatcccaatataagaacttaactctaccctttgcattcatgaatcttttaagcccctttttttctaatcattcttttcttttctcttaactctaggagaagctttctcaacactttgatacatctagcggattttgatttctttaacaactaagattcctgttttttataattctaaaaccaagggcttttgcccatcttcaacagctaacaagaactctttcttttctttacaaatcccaaaaccttttctagactttttctgcttctttagcttacttcacctagagtcttttaccttttcttatcaatgaatcgacccctttttttcttttaaacacatcccaacccaaagtataagcgcccacctagtcctatctagtccgaaaaatgcgaactagaactacatgagacactatctctgtcgttacgaacctaacactttctaccaagcttaatcggaataagacctcacaaacactcacaagtgatatagggcttgaaagaaagtctaagtttgggtttgggttaactgctctaataaggagagtcagctacttggattaacaagagtgatcaaaatgaataagaaaatccaagtattttagggtatccatgagttcaaatttgatgcagacatgataattaaagatcagatttaggttcaaattgatagggaatggtatcagatcatgacagtgtggtcgagtagagcaatctaggcatggttcagttttatttcaaattcattgactacgcaacagacaactagcaacgagggcactgagtttatccggtgaatcaaaattcttacaaggctatctcatcatcatcccctatgcatatgcaacaatcctaaatgaaacactctagactcgatcctaaatgtaatgcaactacatgaacactccttttttgtgaaatcattttctgaaatttttcaaatctttttgttttttttatgccttagatgaatgcagactcaagaatatatacaatgcaacacacacttcctgagccctcccccaaacttaaatcacacagtccactgtgcgaataaacttggaaaagagtactcaggacaaatccaatcacataaacaaaatgaagaaacaaatcacaacagatgatataatacaatggtgaagtgaggcgcttacctcagtcgaagaatgaacgtagttgctcgtcaatgactgcctgtgattgctcccaggccatagacaaaccgccttgttttgtatcagctccagcaggtgggtactcgacctcatcaggtctgtagcggtcagcaccgctctgaggatactcgacctctctccttttgctgcggccagcaccgcggtcgagtgacctcctcgagtgaatgaggcgtgatttgctgctagatcaagtgagtgtagccttccttcttctcttgtgttcccgggactcgaatgacgaatgcctagccgggacagtgagactctctgctcgctaagctcacgcctgtgctcaggatcatcaaatctcctcgatggcatctccagaggaggctgtccctgtggaatagaagtggactgttactgaaacttgagagtcttgaaacacttggcgagcagcttgttctgcttcttgcaccacttctacagtttactgttgttcttatgagcttcactcaagctctgttcaccaaagtgatacatgctagtgtcgaactccactgctctgtcttcatccatcccatccaaagcagcttcttctagaagatcatcctcatccaatggcggagcgttttcatagtagaggtgtccaacctcaggctgaaaatcaatgttatctccctctattatccgtgtaaccttagggctagggagaaggatgctagctctcttgtctgtagagttctcaaacctgaacctgtgcaagtcgtcaaccattgcaaactccaggaattctcagtgacgtaggtgctcgatatccattgctcgcggctcgagtccatcagaaatgattgggactccacaagctatcagaatcggtgtcataacaccacctatgcacaaagcgcctcgcgctctcttgtggttattgctgacagcccagctcttgtatccacacagatggatcagaagaagtacagagagaggtgtgtcattgacttcaccttggagagacatgccattcttagtttggcgaagagttcccttgagagccattgcgatcatctccatatcagagttagtaacagtccatgtgatctctcgggagtagagtacattggctatagaacgctagaagtacctgatgacagggctgcgtatctgattgctctttgacctggaagaattcaacggtacagagctgccaatggtgatccacaagtctttcaactcttctctgtcatacttgggcttagttcccgttccactggggaagccaaacaatccttccaaacgcttgattgataacctatactcatgaccatacacacagaaccgcaagagtcccaatccttcacaatccaactcatcagaggtcataccttggtagagctccacttgtagcgtggagagaaattgaattatctcatcttcatatgctacatacggataagccatcagagtgtccagatgataactctggtacaggtgctgaacatcctccaacaatccgagttgtgcaagtgtggtcgagcaaggatacctcgtgctacagaactcattcagcttgaagagcctaatatattcctcagcaggcaatacgtcgggcttgtgcacaagtttggtagctgtgcgagtatgctctggcatgtactcgtcttccagatcttcgtctagaagctcatacctctctgtcatcgctctcttccctcgggctatctcagcttttcttctgaagctttcatattctctttgttctctctcaggccttgaagatgacgactctgtctcatccatgttgtagtcaggatcaacagaagaactgccactataattgctcatgattcccctgtaaaaatttagaactaaaagctcaaatgtcaataggttagtctcaaagatagcaatgaaaccaaaattgttatcaatatgcaatgaaatagaccctattgatcgagtacaattctgtactcgagtagactaagctgttcttgagttccccttagacgaattggatcgagtatcttctccgaattcgagttggaatgctttagtaggtcgagtgaatcgtgaagcctagaggtcgagtaacttctctgaagttgaaaagctccgttgaattcaagaacaagaagccgagttgcttttgcaggggtcgagtgctttatggtggtcgaggcggcatcggtcgagtgcggctacgagattgggaaacgaggtcgagtagcttcttttgaaagagacggcggttgatgtggatgaattggtctagtatagctaaggaattgattgaagtggtctggtcgagggacggagggaatgaaatggtgacggcggcggggaggtcgagtgacattgcggaggtcgagtgatttattctagatcgagtagttatttgggcggcgattcgtggtgtagagaaattggagtgtcggtggtgagatgaaaagaggtagctcgagtggatatggttaagtcgagtgaagtttcaaaaagagtggttgagtttgagttttagattctctctccagcttatcctcagcgcgtggcccacaatctgttgactgagaaaatttgtagaaaacttactgtaaactgcaggaaatccctgcaagtctctgtagcttctgttggtcgagtaagatgatgatttaaaagtttttggttttaaaacatcacacatactcgaccaatgtactcgagtgcaaggtctccaggtgtaacagaagattttcaaaattttgtactccaacgggctatacactcgatctccaagtcttctgtagagtaaaagttttgaatttttactctatctccacattgttcctttgttcttgagaaccacaaacacaaccaagacaaatcaaaaataacaagaaaataaaaatttatttacagagatagtcatgggaattccccccaagtgagcttgtttaaagtcattagcttgactcctttactcctttaatcatcaagaagttcctggagatgaaccgatgttacctctggaaggatttgatctgctaagtatttcttgagcctttgaccatttaccgtgaagtctccactcttaccagctagagtgactgctccataaggacggaccttagtgatacagaaggggccagaccatctggatttaagttttcctgggaagagtttcaagcgagagttgaacagcggcacctgatcaccaacctggaaatccttagtgatgatcttcttgtcacggaaaagcttggttctctccttgtagattttccatagagaagattgaaaggagttgtaccaatgggggtcttgaaggctgttctgtaagcccataacgcatcatctagctttgcagaccaatttttccttgtaatcccaacagtcttttccagaattgtttttatctccctgttggagatctcaacctgcccccttgtttgtggatgatagggagtggcgaccttgtgctttactccatgcttcttcaagaggttctcaaaacccttgttgatgaaatgctttccgccatcactgattactaccctgggaactccaaatcttgggaagattatggtcttgaacagctttagcaaaacttttgcatcgttggtaggactagcaatagcttcgacccagttggatacgtagtctacgacgaccagtatatatttgttaccgtatgaagatgggaatggacccataaaatcaatcccccatacatcaaagatctcaacttccaagattggattctaaggcatctcatttcttctgctgatgttgccttttctctggcatgaatcacactttgaaacaaactcctgagcacccttaaacattgttggccaccaaaagcccgcttgaagaatcttggacactgtcttgaacgtcgcgaagtgaccaccatatgctgagccatggcaatgcagcaggataccttccacttcatcttctgagacacatctcctgtagatcttatctttacagagagtgtaaagataaggctcatccaagtagtaatggtgtatgtctctgaaaaacttcttcctttcataacttgtcaggttgggagactctactccgcatgctaagtaattgacgtgatcagcataccatggagattctccttcaacaacattcagttggtggaactctttcccactgtagctccttccgaagaactctacaaccatgagctgctcttctggcattgaatcgtctatcggaaggggttcttcaattctcatccttgaaagatggtcagctgcaccattttcaaagcctttcttatctactatctccatgtcaaactcttgcaataaaagtatccatctcaccagtcttggtttagtatccttcttggcatacagatgcctcaaagctgcatggtctgtatagacagtgacctttgatccaaccaaattgcttctgaacttctcaaatgcgaatacaacagctagaacctccttctcagttgttgcatatcttccctaagcttcatccaacgttcggctggcgtaatatatgacatgaagcttcttatctattttctggcctaaaatagctcctactatgtaatctgatgcatcacacatgatttcaaatgggtagtcccaattaggcgctcgaacaacgggagcagataccaaagcatctttgatggtgtgaaatgatttgaggcagtcctcatcgaattcaaatttggtttccttgcacaatagtctggttaacggcctggctatcttggagaagtctttaataaatcttctgtagaacccagcatgaccaaggaaacttctgatgtccttcaccgtttttggtggctgcaactgcatcatcacttcaatttttcctttgtcaacctctatacccttctctgatatcttgtgacccaacactatgccttccttcaccatgaaatgacacttttcccaattgagaacaagattcgtctcttcgcacctggtcagtaccctgccaagattcaacaaacatgaggagaaagaggggccatagaccgaaaaatcgtccatgaaaacctccaccatctcctcgattaaatctgaaaatatagaggtcatacacctctgaaatgttgcaggagcattacataaaccaaatgacattctcttataagcaaaagttccgtagggacatgtgaaagtggttttttcttgatcattagggtgaattggtatttgaaagaaaccactatatccatcaagaaagcaatagtatggatgattagctaaacgttcaagcatttggtcaatgaatggtaaaggaaaatgatctttcctagatgcagcatttaacttcctataatcaatgcacattctatgaccagttatagttctagtagggattagttcatctttttcatttttgacaacagtcattccaccctttttagggacgcaatgcactggagaaacccaaggactatcagagataggatagatgacaccagcctcaagcagtttcaaaatttcttttttcactacttctttcaaattgggatttgacctcctctatggttcaatgctagaataggattcgttttcaaggtggatcctatggttgcataaactaggtgaaattcctttaatgtcggataatgaataaccaattgctctcctatactttctaagctcagataatagtaggttcacttcatcatcatttaactcagcattaatgatcacagggtaagtagattttgaaccaaggaatgcgtaccttagacctttaggaagtggttctagatcaacttaggccccttgagttcagaccagtcatctgaagttgggatgatcggctccctaaattcattggcagacaaggtcgagtggctggtcgagtatgtcctcgagtgtgcaggttgaactcgtgttgacccttcttcgctcattaccattacctctgttgctggtccattcaattcctcaaagggttctgattcttccattgctttatgggagtctaacagcttctggtatcctaatgtttccaaatgcagaaacccatcttcaccacttttagttaaagcactattaagatgatcttcttctgccagctcttccagtaactcatcagctaactgatccatttcttcgatccaaaagagttgcccttctatggtaggcttcttcatcgcgtctttgacatcaaaggtcatccgaaagtctttgccaaggtttagataaatcttccctttcttgacatcaatcatagctcctgcagttgctaagaaaggtctccctagaatcaacgggtccttgcgctcttcatccatctccaggactacaaagtcagttggtatctccacagctctgatcctgattggaaggttttcgagcaaaccatgagggatccttactgatctgtcagctaggatgagggatatattgcaggatttgtattgagtgaaccccaatcttttggcaacagagagcggcatgagactgactgatgctcctaaatcgcataggcatctattgaaagccaatggatctaaagagcatggtagagtgaatgaaccaggatcactaagcttcttaggaatgatcttcttttgtatgatagcactgcattcatgactcaataccaccataccttgcacttcttgaattctctccacgatcaagtctttcagaaacttgtgagagtctgggattagcgctagagcgtcaacaagaggtatccgcaactcaacctccttaatattcttggcaaacatagctctatatttatctgccaacgctttcttgtgacggccaggaaatggaagctgtggtttgtagggaggagggacaaagaccttttctttgtttttaacagcaactggttttggagcagttggtgatgctgctgggaagataggtcgagttgttggtcgagtaacgttgtcaagtggcagatcgagtggttgctcgagtgactggtcgagtgactggtcgagtggttgctcgagtgactggttgagtggttgctcgagtgactggtcgagtgatccgcgctttgatctccttcctgtgtttgtcatcagagtcagctgtgcctctgacggtcctatcacagtcctcgttgtaattgccatctgattgagcaaggttctctaccaaatcctagccttcttcaacatccttgttctggaaattttcattgctggcggtatccagaagcattctgatgcgtggtaggactcctctataaagagtgctgagcagagaggctttagtaaagccatgatgagggcattggttggtgtaatccttgaaacgctcccatgcttcacagaagctttcagcagtcttctgtgagaaaccagagatctcatttctgagtcttgcagttctggcattggagaagaactttgatagaaaagccttcttgcaatcatcccaggtggtgattgaatcatggggcagattcttctcccagatgtgtgctttgtcgcccaaggagaatgggaacagacggagcttgaatccgtcttcactgacaccattgatctttgtcaggttgtagagccaatcgaattcatcaaggtggtcgagtggatcctccattggcagaccatggaatttgttcccctgaatcatggagatgagaccactcttaatctcgaagttgttgttctggatagcaggaggtgcaattcctttcctctgacgatgatcacgtggtgcatctccagcaccaatgttggcagggccattttgttgattctgttcgtcagccatttcgagtggttgctgaggtacagggttgactgtgtttcacctttctctaagctcgcgagctatgcggtcaatgttgtcgttgaaaaggaggttctgattgcctgttgatcgagttcgcatacagtagaggtgtacctggatcaagaagacaacaagaaagacacaaagttagtaaccgaaaagaaaatttgaaaaagaacttgatctaagcaagtctgaaatgtcaaatgtaaaaaacagacacccaattggcaacggcgccaaattgataatagatttttcagtcaattaaacctaaagcactatcatgtcgttgtagtactgaaggttgtcaatccaaatgggtgtgatgctaacaattaagatgtgatcaaaagtccctaagtcaagccaagcaataacaggttgtggtgtgttctagcaattctaagtgaacatgcagaaaatagaaattcaagcagaaacagtaaaacactcgaccaacacagctctttgcagagcactaggtgaggagtaacacacagaaaataaaacacagatacttgactgcacagtctgttgccagacaacttggtggtcgagtatgaggttgagtaacaagaaagaaccgcagaaattaagcgacagataacaagatgcagtaaacaacagtagagtaaacaaaaaattcaatcagataaagaattcccgaggatggggtaattgagtagtttcgtttcctcagtttacaggtgattgacatgctcaataaattaaccctagacaacaagttcattaaccaaatctaagtgccaccgcaatagagactctcaagttaacctagtcccagactcaatcaccattgacgagagctaacctaacaggcattacgaatcaacaagttaaagccaaaacgctccctgcaaccaataccttggtacagggccacaagtctctagaattagtggttcagacatttcatcgaacaccttttgggcgcggaaatgtctgggctcaaattccagttgatcagaaagcaataggcattaagaacaactaatccataagggatctatcaatcaatactcaatcacctagcatactgagaattctacactattctaacccatcctcagaaacctattcactactcagacatcagaacagaaagcataaacgttgaacaagctaaaaacatgataacaacagtgtaatagaagggtgataacagaatgaacaacagtaaacgaaagcaagaccaaaagctgaatactgaatactgaatactgaatattgaatagataaagagaaatccggattacaaaaggtctagaacacaaggtctgcggaataaaactaaataaaaaacttgtttgcgaaaatgtgaagtacatgctacttatagccaaatattccgaaaccctaatacttaaaacgatgcagtattgggacggattaagaattgtactcgactcatgtggtcgagtggggatcgagtgaatagctggagtcttcttttcttccttgtgctcgagtgtctggttgagtgcggaatgaagaagactctgaagcttgccatcgagtgtgtagtcgagtggtggtgatggtgatactcgacttccaggtagagtgatggggtcgagtgatgattaggtaatggtggtaaagacactcgacctcagggtcgagtgatgtggtcgagtgatggtcaggtgatggagatgaggacactcgaccttgtggccgagtggtgaggtgaagtggtgatgtcttctactcgacctgggggtcgagtggtctgttgagatcttgaagctcctactcgacctctgggtcgagtggtttgtcatgatcaggtccgcttcttccagttagctcgtcaacagctccaaatcacctgaaatcaacacaaatatgcaacatgcatgcaaacctatcctaaacatgtaaagtgatgataaatgatgagaaatgatataaaacagtgatgatatgatgctaaaatgatgacaaatggatgctcaaaacatgcaaaatacacacttatcagtatctcatctacgttgaccttattcccaccagcatcatttagcgtttatcggagttcttatctgccgcctcagatccgccgcaccatcaccatcctctgccacactgttgccttgttagggttcctcttaatgggccactgttcttcgagcccattaaccaaatttaggcccatcccccaaaacaattgcccatctccactaatggattggcccagcccctccaaacggtctccgcaaaatcataggtttgacccaaactcctttttgtcttctcttagcttttatttgcgtcgattcatgataccaattgctaatggacatcaattgaatcataatcgaacattgctgctatgttggtacaaaaatcctttgagaaccttgccattagaatctataggtgtactattcatgttgctaattccttgaagaagatcggcatgatgatcccgtctccaaggagcagtgattaccgtagtttcttcaagttttcatctccgattcattttattattgatttcatacttgatatatttagctacatcatgggtactattcttgaaagtaaaagtttgatgaataatggcattatgatcccgtctccttggatatgaattagtgctttaggtttaattgatcttaaaaaacctattatcatctccgttcctcattggcttatcaaacctatctttttttccttattgttagctttcgttattcggagttttttgtaaccctttgtatgcttgaagatcttgtaaactttacctttaggagatgcattgaatgaaatacaaggcttgtttgacaaaaaaataagaataaataaaaagtatcaactgaaaaaagcattcgtttatgcaatataacaacgtattcgatgattcaattttaattaaaaaaaattctaacaacattctcaacaatgcatcatacacataattcagaaacaacattgatcttaaaccaatttaacagagggtagtgttggattctaaaaacctaagaatttgatgatggagctctttacgtattcttcacactcagtggtttattatataaatatcaatttaagagaatataaatatcaatttaagagaataacttactcaaatcattaagtaatccacaactattatacactcatactttgagtttggattacaagaaaaaaacaaacttcgggtataagaaaactattaaaatggttttattgaaaaatcatgtaatattaaaataaatttagtaataatacaattaaatatgtaaaataaaataataaatatatcattaacctataaattagaagttgaagagcttacattaattatttaatagacacatggcaaatggtaaagtgatgatgtgtcaatcatatggagagagttggccaactttcatatatatgatttataaaccatgtgaggttcaaaccccttggtttatatttgcttaatagtataaagtcgtggtcgtataacttttatgccggcaggatgttggtattgacgttatgctgcccgactattatactttgattgttagataactaggattagccaaatcatgaggatcccatccgtatgttgtgcatcgcgtgtaactccgttccattatggcatacgaaggcaggggctggttcaataccgaccggatgcttcatgacgatgtagtataaggaatggcaatcttctttagactttgtgtctaggagtgtgcaggccattgcctcgggttatcatgtgttcgtaaaaggccttacttaagtagttaggagcatgtttaggcatagtagtttcgctgcatatagttgctagttgcattgcatttgattgcctgtttgctttttgtttgggggttgggttgggttttatttttagagatcccagatttattgagtaatactagattactcagacactactttttttttacaggcaacctttagtaggaagaccttagggggcgaaggatgttagactaaccggtgtagatttgctttgcctttgtaatatatagttttgcgtatagtatgtaagactcgatatttttataaagctctgattttattaaaaccccatatctcccaatgatatatttagtcttgtctagactatcacaacttgcgtccgcggttcgggttgcaaagccttaggccatgttcgtgagaaacgggactcgcggtcggacggctcgggcgaacggatttgttctgggaatatgnnnnnnnnnnnnnnnnnnnnnnnnnnnnnnnnnnnnnnnnnnnnnnnnnntcgagaaaagtttaccgggtccgagggtttgtcgaccaggacgaggaatcgtcgaccgggtccgaggatttgtcgaccaggggttgaaatcgtcgaccaggtccgagacttcatcgaccgggtccgaggaatcgtcgaccaggacgatgaatggtcgatgaaaatctatcgggttcgaggaatggtcgaccaggggttgaaatcgtcgaccaggtccgagacttcatcgaccgtgtccgaggagtggtcgagggtttgtcgaccaggacgaggaatcgtcgaccgggtccgaggatttgtcgaccaggggttgaaatcgtcgaccaggtccgagacttcatcgaccgggtccgaggattcgtcgaccaggacgatgaatggtcgatgaaaatctatcgggttcgaggaatggtcgaccaggggttgaaatcgtcgaccaggtccgagacttcatcgaccgtgtccgaggagtggtcgaggatttgtcgaccaggagttgaaatcgtcgaccgggaccgagaattcgtcgaccaggacggcggaatgctcgaccaggacgatgaatgggcgatgaaaatctatcgggatagaggaatggtcgaccagaagttggaatcgtcgaccgggtccgagaattcgtcgaccaggacgaggagtggtcgaggatttgtcgaccaggagttgaaatcgtcgaccgggtccgagaattcgtcgaccaggacggcggaaccctcgaccaggacgatgaatgggcgatgaaaatctatcgggttcgaggaatggtcgaccagaagttgaaatcgtcgaccgggtccgagaattcgtcgaccaggccgaggagtggtcgaggatttgtcgaccaggagttgaaatcgtcgaccgggaccgagaattcgtcgaccaggacggcggatccctcgaccaggacgatgaatgggcgatgaaaatctatcgggttcgaggaatggtcgaccaggggttgaaatcgtcgaccaggtccgagacttcatcgaccgggtccgaggattcgtcgaccaggacggccggatgtccgagaaaaaaaaatgttgccgaataactttcgaaaatcattggatatgatgcaatgttttgtgatcgaatctcttaaaatacatcaataaagagtttaggatgtcaagtttgcatcaaatatgcccacggagccccaactagaccatgaaaatccgatgttgtatcaggtcaaatgacctagctagaggtgtcagaaaattatgtaaatttaccagaaaataggatttagtatccttatgatgcatgccaaaaagaattttcaaattccaagtatttctttttttttggcaccggtgtctcctcagacatttcaatgtctgttggtgccaagagggaaaagggctattaagctatataggggggtgggtgttgagggagtctgggcagtccgtgggaaccccctttatcggttcggacttgggtagcgatcgagggatggtatcggatatcgacacgaggaatgaccgaccgtccggccgccgggattttcgccggaaaacttttccggcgacttttccggcgatcggttttgttgcctttttccgagttttctcagcagttctcggacaaaaactgctgaatcgtcgaggagaatgggcttgccttgcgtgggctgccattagttcttcgaggcgttagggtggcggcggtataaaagtgtcggagttttttcagcagttctcggacaaaaattgctgagtggccgagaagaatgggcgtgtcatgcgtgggctgacatggattcttcgaggcctaggggtggcggtatataacttgttcgcatgatattaccgagatgtccccacgggcatcttttcacctcgtcgccgaagagaatgggcgtgtcatgcatgggctgacatggattctcctaggccgtttgggtggcggtatagtcgtcctgcgcacgaaataccgagatgtccccatgggcatcgattccacccgcctaggttggatgggcgtgcttcgttggaaagcatggatccgcctaggctgtcccgagtgtgagcgaggtgtgagtgtcgcccatgggcatcgacaccttgcggctaggaactggaacgagacgggtggcaaagatttcgagtagcacttcatactaccgtgggttttttaaaccttcccctagttttgtcgatgttattccgagaattagcaaaccgtaacgaagatgttcttggcaaccatcttttgatgggagtccggctgttcgatagccggccaagggtgatgaacgaaatgtgaacccttgtctcgcctaggttggatgggcgtgcttcgttggaaagcatggatccgcctaggctgtcccgagtgtgagcgaggtgtgagtgtcgcccatgggcatcgacaccttgcggctaggaactggaacgagacgggtagcaaagatttcgagtagcacttcatactaccgtgggttttttaaaccttcccctagttttgttgatgttattccgagaattagcaaaccgtaacgaagatgttcttggcaaccatcttttgatgggagtccggctgttcgaaagccggccaagggtgatgaacgaaatgtgaacccttgtctcgcctaggttggatgggcgtgcttcgttggaaagcatggatccgcctaggctgtcccgaaggtatctcgcgcttgtacggctttggctcggattcgtccgtcttctttcttcttagccgagtacttcggtagattagttggaacgattgatgattttgagttaattgaacgttcggcgtatgagtggtgatcggatagctagtgttcgtaggctccatgctcgcgcatcgaactacctaccacctatccttctcagttaattcacgggcgatgttacgctcgatgatgagttccggggcctgtgtttcgtacctaatttgaaggaattgttgagttcggtttacacccatgcccgcggcttctccttcgtggggaagtcgtgggcacaaacatcggcgcttgttcacctctcgtcatcgcatttgttgccttgctcgcattggtgaatgagttgcgggttgatatctcggatgcggaaaagttgtcgacggtgactcgaagtgattcagtcccgccaaagctcatccgtccttcgggcaaaagatgacggtcaagacctcgtcctttctctctttccattgcgtttgagaggatgtggcggggaattgccgtgatcgatgaatgctacctggttgatcctgccagtagtcatatgcttgtctcaaagattaagccatgcatgtgtaagtatgaacgaattcagactgtgaaactgcgaatggctcattaaatcagttatagtttgtttgatggtaactactactcggataaccgtagtaattctagagctaatacgtgcaacaaaccccgacttatggaagggacgcatttattagataaaaggtcgacgcgggctctgcccgttgctctgatgattcatgataactcgacggatcgcatggcctctgtgctggcgacgcatcattcaaatttctgccctatcaactttcgatggtaggatagtggcctaccatggtggtaacgggtgacggagaattagggttcgattccggagagggagcctgagaaacggctaccacatccaaggaaggcagcaggcgcgcaaattacccaatcctgacacggggaggtagtgacaataaataacaataccgggctctttcgagtctggtaattggaatgagtacaatctaaatcccttaacgaggatccattggagggcaagtctggtgccagcagccgcggtaattccagctccaatagcgtatatttaagttgttgcagttaaaaagctcgtagttgaaccttgggatgggtcggccggtccgcctttggtgtgcattggtcggcttgtcccttcggtcggcgatacgctcctggtcttaattggccgggtcgtgcctccggcgctgttactttgaagaaattagagtgctcaaagcaagcctacgctctggatacattagcatgggataacatcataggatttcgatcctattgtgttggccttcgggatcggagtaatgattaacagggacagtcgggggcattcgtatttcatagtcagaggtgaaattcttggatttatgaaagacgaacaactgcgaaagcatttgccaaggatgttttcattaatcaagaacgaaagttgggggctcgaagacgatcagataccgtcctagtctcaaccataaacgatgccgaccagggatcagcggatgttgcttataggactccgctggcaccttatgagaaatcaaagtttttgggttccggggggagtatggtcgcaaggctgaaacttaaaggaattgacggaagggcaccaccaggagtggagcctgcggcttaatttgactcaacacggggaaacttaccaggtccagacatagtaaggattgacagactgagagctctttcttgattctatgggtggtggtgcatggccgttcttagttggtggagcgatttgtctggttaattccgttaacgaacgagacctcagcctgctaactagctacgtggaggcatcccttcacggccggcttcttagagggactatggccgtttaggccaaggaagtttgaggcaataacaggtctgtgatgcccttagatgttctgggccgcacgcgcgctacactgatgtattcaacgagttcacaccttggccgacaggcccgggtaatctttgaaatttcatcgtgatggggatagatcattgcaattgttggtcttcaacgaggaattcctagtaagcgcgagtcatcagctcgcgttgactacgtccctgccctttgtacacaccgcccgtcgctcctaccgattgaatgatccggtgaagtgttcggatcgcggcgacgtgggtggttcgccgcccgcgacgtcgcgagaagtccactaaaccttatcatttagaggaaggagaagtcgtaacaaggtttccgtaggtgaacctgcggaaggatcattgtcgatacctgtccaaaacagaacgacccgcgaaccaaagatcaccactctcggtgggccggtttcttagccgattccttgcccgccggatccgtggtttcgcgtatcggcatgatcgggagcttttatctcggtcttgtcgtgcgcgttgcttccggatatcacaaaaccccggcacgaaaagtgtcaaggaacatgcaaacgaacggctggcattcgcctccccggagacggagtgtgggcggatgctgtgccgcgaactgaagtctaaaacgactctcggcaacggatatctcggctctcgcatcgatgaagaacgtagcgaaatgcgatacttggtgtgaattgcagaatcccgtgaaccatcgagtctttgaacgcaagttgcgccccaagccttctggccgagggcacgtctgcctgggtgtcacaaatcgtcgtccctcaccatcctttgctgatgcgggacggaagctggtctcccgtgtgttaccgcacgcggttggcctaaatccgagccaaggacgcctggagcgtaccgacatgcggtggtgaacttgatccattacattttatcggtcgctcttgtccgaaagctgtagatgacccaaagtccatatagcgaccccaggtcaggcgggattacccgctgagtttaagcatatcaataagcggaggaaaagaaactaacaaggattcccttagtaacggcgagcgaaccgggaagagcccagcttgaaaatcggacgtcttcggcgttcgaattgtagtctggagaagcgtcctcagcgacggaccgggcctaagttccctggaaaggggcgccagagagggtgagagccccgtcgtgcccggaccctgtcgcaccacgaggcgctgtctacgagtcgggttgtttgggaatgcagccccaatcgggcggtaaattccgtccaaggctaaatacgggcgagagaccgatagcgaacaagtaccgcgaggtaaagatgaaaaggactttgaaaagagagtcaaagagtgcttgaaattgtcgggagggaagcggatgggggccggcgatgcgtcctggtcggatgcggaacggagcaatccggtccgccgatcgattcggggcgtggaccgacgcggattacggtggcggcctaagcccgggcttttgatacgcttgtggagacgtcgctgccgtgatcgtggtctgcagcacgcgcctaacggcgtgcctcggcatcagcgtgctccgggcgtcggcctgtgggctccccattcgacccgtcttgaaacacggaccaaggagtctgacatgtgtgcgagtcaacgggtgagtaaacccgtaaggcgcaaggaagctgattggcgggatccctcgcgggtgcaccgccgaccgaccttgatcttctgagaagggttcgagtgtgagcatgcctgtcgggacccgaaagatggtgaactatgcctgagcggggtaaagccagaggaaactctggtggaagcccgcagcgatactgacgtgcaaatcgttcgtctgacttgggtataggggcgaaagactaatcgaaccatctagtagctggttccctccgaagtttccctcaggatagctggagctcggacgcgagttctatcgggtaaagccaatgattagaggcattgggggcgcaacgccctcgacctattctcaaactttaaataggtaggacgtgtcggctgctttgttgagacgtcacacggaatcgagagctccaagtgggccatttttggtaagcagaactggcgatgcgggatgaaccggaagccgggttacggtgcccaactgcgcgctaacctagaacccacaaagggtgttggtcgattaagacagcaggacggtggtcatggaagtcgaaatccgctaaggagtgtgtaacaactcacctgccgaatcaactagccccgaaaatggatggcgcttaagcgcgcgacctatacccggccgtcggggcaagagccaggcctcgatgagtaggagggcgcggcggtcgctgcaaaacctagggcgcgagcccgggcggagcggccgtcggtgcagatcttggtggtagtagcaaatattcaaatgagaactttgaaggccgaagaggggaaaggttccatgtgaacggcacttgcacatgggttagtcgatcctaagagtcgggggaaacccgtctgatagcgcttaagcgcgaacttcgaaaggggatccggttaaaattccggaaccgggacgtggcggttgacggcaacgttagggagtccggagacgtcggcgggggcctcgggaagagttatcttttctgtttaacagcctgcccaccctggaaacggctcagccggaggtagggtccagcggctggaagagcaccgcacgtcgcgtggtgtccggtgcgcccccggcggcccttgaaaatccggaggaccgagtgccgctcacgcccggtcgtactcataaccgcatcaggtctccaaggtgaacagcctctggtcgatggaacaatgtaggcaagggaagtcggcaaaatggatccgtaacttcgggaaaaggattggctctgagggctgggctcgggggtcccagttccgaacccgtcggctgtcagcggactgctcgagctgcttccgcggcgagagcgggtcgccgcgtgccggccgggggacggactgggaacggctctctcgggagctttccccgggcgtcgaacagtcagctcagaactggtacggacaaggggaatccgactgtttaattaaaacaaagcattgcgatggtccctgcggatgctaacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcagaatcagcggggaaagaagaccctgttgagcttgactctagtccgactttgtgaaatgacttgagaggtgtaggataagtgggagcttcggcgcaagtgaaataccactacttttaacgttattttacttactccgtgaatcggaggcggggtacaacccctgtttttggtcccaaggctcgcttcggcgggtcgatccgggcggaggacattgtcaggtggggagtttggctggggcggcacatctgttaaaagataacgcaggtgtcctaagatgagctcaacgagaacagaaatctcgtgtggaacaaaagggtaaaagctcgtttgattctgattttcagtacgaatacgaaccgtgaaagcgtggcctatcgatcctttagaccttcggaatttgaagctagaggtgtcaaaaaagttaccacagggataactggcttgtggcagccaagcgttcatagcgacgttgctttttgatccttcgatgtcggctcttcctatcattgtgaagcagaattcaccaagtgttggattgttcacccaccaatagggaacgtgagctgggtttagaccgtcgtgagacaggttagttttaccctactgatgcccgcgtcgcgatagtaattcaacctagtacgagaggaaccgttgattcgcacaattggtcatcgcgcttggttgaaaagccagtggcgcgaagctaccgtgcgctggattatgactgaacgcctctaagtcagaatccgggctagaagcgacgcatgcgcccgccgcccgattgccgaccctcagtaggagcttaggctcccaaaggcacgtgtcgttggctaagtccgttcggcggaagcgtcgttcggaccgccttgaattataattaccaccgagcggcgggtagaatcctttgcagacgacttaaatacgcgacggggtattgtaagtggcagagtggccttgctgccacgatccactgagattcagccctttgtcgctaagattcgaccctcccctaaatcactccaaaaaaaacaatccccaattctacacaagtgtttctacactaacaaagcaacagctccttaacgaattcccaactttacacgagctcgtctctcgaggttaaatgttattacttggtaagattccggacctcgccaagtgttttgaaaacccgcaacgctcgcaaaggtgcatagtgagaataataagtgaagagacagacttgtccaaaacgcccaccacgaaggtgcatagtgagaagagtaagtcaagagatagacttgtccaaaaagaaacggaagagaaagcttggggagacgctcacgaaggtgcatagtgagaagagtaagtcaagagatagacttgttcaaaaagaaacagaagagaatgcttggggttacactcacgaaggtgcatagtgagaagagtaagtcaagagatagacttgttcaaaaagaaacagaagagaatgcttggggttacactcacgaaggtgcatagtgagaagagtaagtcaagagacagacttgttcaaaaagaaacaaaagagaatgcttggggagatagaagtgtgagatagttctcaagctaagaaagttgtaaaagctaagaactagcaagtaatcgtccaggattcctccaccaggacttgaaatcgtcgagggaaaaaaatcggttccgaggaatcgtcgatccggacttggaatcgtcgagaaaagtttaccgggtccgaggatttgtcgaccaggagtggaaatcgtcgagaaaaatctatcgggtccgaggaatcgtcgaccaggacgaggaatcgtcgacagggtccgaggatttgtcgaccaggggttgaaatcgtcgaccaggtccgagacttcatcgaccgggtccgaggatttgtcgaccaggagtggaaatcgtcgagaaaaatctatcgggtccgaggaatcgtcgaccaggacgaggaatcgtcgaccgggtccgaggatttgtcgaccaggggttgaaatcgtcgaccaggtccgagacttcatcgaccgggtccgaggattcgtcgaccaggtccgagacttcatcgaccgggtccaagtatttgatttttttttggaaccggtgtctcctcagacatttcaatgtatgttggtgccaagagggaaaagggctataaagctatataggggtgggtgtgtgtagcgggaattttgcccgcacgcgcgcgcgcgaataagaataagaataagtaataagaataagaataagaaaaagaaaaaaaaaaaaaaaaaaaaaaaaaaaaaactccatagagttgttttctcaatcgggtccgaggaatcgtcgatctggacttggaatcgtcgagaaaagtttaccgggtccgagggtttgtcgaccaggacgaggaatcgtcgaccgggtccgaggatttgtcgaccaggggttgaaatcgtcgaccaggtccgagacttcatcgaccgggtccgaggaatcgtcgaccaggacgatgaatggtcgatgaaaatctatcgggttcgaggaatggtcgaccaggggttgaaatcgtcgaccaggtccgagacttcatcgaccgtgtccgaggagtggtcgagggtttgtcgaccaggacgaggaatcgtcgaccgggtccgaggatttgtcgaccaggggttgaaatcgtcgaccaggtccgagacttcatcgaccgggtccgaggattcgtcgaccaggacgatgaatggtcgatgaaaatctatcgggttcgaggaatggtcgaccaggggttgaaatcgtcgaccaggtccgagacttcatcgaccgtgtccgaggagtggtcgaggatttgtcgaccaggagttgaaatcgtcgaccgggaccgagaattcgtcgaccaggacggcggaatgctcgaccaggacgatgaatgggcgatgaaaatctatcgggatagaggaatggtcgaccagaagttggaatcgtcgaccgggtccgagaattcgtcgaccaggacgaggagtggtcgaggatttgtcgaccaggagttgaaatcgtcgaccgggtccgagaattcgtcgaccaggacggcggaaccctcgaccaggacgatgaatgggcgatgaaaatctatcgggttcgaggaatggtcgaccagaagttgaaatcgtcgaccgggtccgagaattcgtcgaccaggccgaggagtggtcgaggatttgtcgaccaggagttgaaatcgtcgaccgggaccgagaattcgtcgaccaggacggcggatccctcgaccaggacgatgaatgggcgatgaaaatctatcgggttcgaggaatggtcgaccaggggttgaaatcgtcgaccaggtccgagacttcatcgaccgggtccgaggattcgtcgaccaggacggccggatgtccgagaaaaaaaaatgttgccgaataactttcgaaaatcattggatatgatgcaatgttttgtgatcgaatctcttaaaatacatcaataaagagtttaggatgtcaagtttgcatcaaatatgcccacggagccccaactagaccatgaaaatccgatgttgtatcaggtcaaatgacctagctagaggtgtcagaaaattatgtaaatttaccagaaaataggatttagtatccttatgatgcatgccaaaaagaattttcaaattccaagtatttctttttttttggcaccggtgtctcctcagacatttcaatgtctgttggtgccaagagggaaaagggctattaagctatataggggggtgggtgttgagggagtctgggcagtccgtgggaaccccctttatcggttcggacttgggtagcgatcgagggatggtatcggatatcgacacgaggaatgaccgaccgtccggccgccgggattttcgccggaaaagttttccggcgacttttccggcgatcggttttgttgcctttttccgagttttctcagcagttctcggacaaaaactgctgaatcgtcgaggagaatgggcttgccttgcgtgggctgccattagttcttcgaggcgttagggtggcggcggtataaaagtgtcggagttttttcagcagttctcggacaaaaattgctgagtggccgagaagaatgggcgtgtcatgcgtgggctgacatggattcttcgaggcctaggggtggcggtatataacttgttcgcatgatattaccgagatgtccccacgggcatcttttcacctcgtcgccgaagagaatgggcgtgtcatgcatgggctgacatggattctcctaggccgtttgggtggcggtatagtcgtcctgcgcacgaaataccgagatgtccccatgggcatcgattccacccgcctaggttggatgggcgtgcttcgttggaaagcatggatccgcctaggctgtcccgagtgtgagcgaggtgtgagtgtcgcccatgggcatcgacaccttgcggctaggaactggaacgagacgggtggcaaagatttcgagtagcacttcatactaccgtgggttttttaaaccttcccctagttttgtcgatgttattccgagaattagcaaaccgtaacgaagatgttcttggcaaccatcttttgatgggagtccggctgttcgatagccggccaagggtgatgaacgaaatgtgaacccttgtctcgcctaggttggatgggcgtgcttcgttggaaagcatggatccgcctaggctgtcccgagtgtgagcgaggtgtgagtgtcgcccatgggcatcgacaccttgcggctaggaactggaacgagacgggtagcaaagatttcgagtagcacttcatactaccgtgggttttttaaaccttcccctagttttgttgatgttattccgagaattagcaaaccgtaacgaagatgttcttggcaaccatcttttgatgggagtccggctgttcgaaagccggccaagggtgatgnnnnnnnnnnnnnnnnnnnnnnnnnnnnnnnnnnnnnnnnnnnnnnnnnntatgatcgcatccgtaactacatgcaatgcaatcgtatttattcttttttgaagactttatgatcgatttgccgtgggtcccaccagctatgtaggaataccctatcttgtttataagagctttgatacatgcaaaatatacgaaaacaatgtccgtacatataattttcgccccgtaatataacaaagattacgaaaaggcccgaaaaagtacattaaggtcaaaatttggagtagaaaaaaaaactatagaagaattccattctccttcctaattcatcggagagctctctttgggctttccgaaaaggtatcacatgccaagtttggcctcacggtctaaaagttctagagtcatacatttttgacaaaacaaaaagagaaaaaccaaaaaaaaagagggatgcaacacgaggactttccaggaggttacccatcctagtactactctcgcccaagcacgcttaactacgtagttctgatgggatctggtggattagtgctggtatgatcgcatccgttactacatgcaatgcaattgtatctattcttttttgaagactttatgatccatttgccgtgggtcccaccacctgtgtaggaataccctatcttgtttataagagctttgatacatgcaaaatattcgaaaacaatgtccgaacatataattttggccccgtaatatagcaaagataatgaaaaggctcgaaaaagtacattacaatcaaaatttggagaaggaaaaaaacaaatagaagaattccattttccttactcattcatcggagagctctctttgggctttccgaaaaggtatcacatgtcaagtttagcctcacggtctanaagttctagagtcatacatttttgacaaaacaaaaagagaaaaaccaaaaaaaaagagggatgcaacacgaggactttccaggtggtcacccatgctagtactactctcgccaaagcacgcttaagtgcggagttctgttgggatctggtgcattagtgctgctatgattgcattcattactacatgcaatgcaatcgtatctattcttttttaaagactttatgatccatttgtcgtgggtttcaccaactatgtaggaataccttatcttgtttataagagctttgatacatgcaaaatattcgaaaacaatgtccgaacatataattttcgcccgtaatatagcaaaaatcacgaaaaggctcgaaaaagtacattaaaatcaaaatttggagtaagaaaaaaaaccaatagaagaattccattttccttcctcattcatcggagagctctctttgggctttccgaaaaggtatcacatgtcaagtttggcctcacggtcttaaagttatagagtcatacatgtttaacaaaacaaaaagagggatgacacacgaggactttcctggaggtcacccatcctagtactactctcgtccaagcacgcttaattgcagagttctgatgggatctgatgcattagtgctggtatgatcacatctgtaactacatgcaatgcaatcgtatctattcttttttgaagactttatgatcgatttgccgtgagtcccaccagctatgtaggaataccctatcttgtttataagagctttgatacatgcaaaatatacgaaaacaatgtccgtacatataattttcgccccgtaatatagcaaagattacgaaaaggcctgaaaaagtacattaaggtcaaactttggagtagaaaaaaaaactatagaagaattccattttccttcctaattcatcggagagctctctttgtcctttccgaaaaagtatcacatgccaagtttggcctcacggtctaaaagttctagagtcatacatttttgacataaaaaaaagagaaaaaccgaaaaaaagggataaaacacgaggactttccatgaggtcacccatcctagtactactctcgcccaagcacgcttaactacggagttctgatgggatctggtgcattagtgctggtatgatcacatccgttactacatgcaatgcaattgtatctatttttttttgaagactttatgatccatttaccgtgggtccgaccagctgtgtaggaataccctatcttgtttataagagctttgatacatgcaaaatattcgaaaataatgtccgaacatataattttggccccgtaatatagcaaatataacgaaaaggctcgaaaaattatattaaaatcaaaatttggagaaggaaaaaaaactatagaagaattctattttccttcctcattcatcggagagctctctttgggctttccgaaaaggtatcacatgtcaagtttggcctcacggtcttaaagttatagagtcatacatttttaacaaaacaaaaagagggatgacacacgaggactttcctggaggtcacccatcctagtactactctcgcccaagcacgcttaactgtagagttctgatgggacctggtgcattagtgctagtatgatcgcatccgtaactacatgcaatgcaatcgtatttattcttttttgaagactttatgatcgatttgccgtgggtcccaccagctatgtaggaataccctatcttgtttataagagctttgatacatgcaaaatatacgaaaacaatgtccgtacatataattttcgccccgtaatatagcaaagattacgaaaaggcccgaaaaagtacattaaggtcaaactttggagtagaaaaaaaaactatagaagaattccattttccttcctaattcatcggagagctctctttgtgctttccgaaaaagtatcacatgccaagtttggcctcacggtctaaaagttctagagtcatacatttttgacaaaaaaaaaagagaaaaaccgaaaaaaagagggataaaacacgaggactttccatgaggtcacccatcctagtactactctcgcccaagcacgcttaactacggagttctgatgggatttagtgcattagtgatggtatgatcgcatccattactacatgcaatgcaattgtatctatttttttttgaagactttatgatccatttgccgtgggtcccaccagctgtgtaggaataccctatcttgtttataagagctttgatacatgtacaatattcgaaaataatgtccgaacatataattttggccccgtaatatagcaaatataacgaaaaggctcgaaaaattatattaaaatcaaaatttggagaaggaaaaaaaacaatagaagaattccattttccttcctcattcatcggagagctctctttgggctttccgaaaaggtatcacatgtcaagtttggcctcacggtcttaaagttatagagtcatacatttttaacaaaacaaaaagagggatgacacacgaggactttcctggaggtcacccatcctagtactactctcgcccaagcacgcttaactgtaaagttctgatgggacctggtgcattagtgctagtatgatcgcatctgtaactacatgcaatgcaatcgtatttattcttttttgaagactttatgatcgatttgccgtgggtcccaccagctatgtaggagtaccctatcttgtttataagagctttgatacatgcaaaatatacgaaaacaatgtccgtacatataattttcgccccgtaatataacaaagattacgaaaaggcccgaaaaagtacattaaggtcaaaatttggagtagaaaaaaaaactatagaagaattccattctccttcctaattcatcggagagctctctttgggctttccgaaaaggtatcacatgccaagtttggcctcacggtctaaaagttctagagtcatacatttttgacaaaacaaaaagagaaaaaccaaaaaaaaagagggatgcaacacgaggactttccaggaggttacccatcctagtactactctcgcccaagcacgcttaactacgtagttctgatgggatctggtggattagtgctggtatgatcgcatccgttactacatgcaatgcaattgtatctattcttttttgaagactttatgatccatttgccgtgggtcccaccacctgtgtaggaataccctatcttgtttataagagctttgatacatgcaaaatattcgaaaacaatgtccgaacatataattttggccccgtaatatagcaaagataatgaaaaggctcgaaaaagtacattacaatcaaaatttggagaaggaaaaaaacaaatagaagaattccattttccttactcattcatcggagagctctctttgggctttccgaaaaggtatcacatgtcaagtttagcctcacggtctaaaagttctagagtcatacatttttgacaaaacaaaaagagaaaaaccaaaaaaaaagagggatgcaacacgaggactttccaggtggtcacccatgctagtactactctcgccaaagcacgcttaagtgcggagttctgttgggatctggtgcattagtgctgctatgattgcattcgttactacatgcaatgcaatcttatctattcttttttaaagactttatgatccatttgtcgtgggtttcaccaactatgtaggaataccttatcttgtttataagagctttgatacatgcaaaatattcgaaaacaatgtccgaacatataattttcgcccgtaatatagcaaagataacgaaaaggctcgaaaaagtacattaaaatcaaaatttggagtaggaaaaaaacagtagaaaaacaccattttccttcctcattcatcggagagctctctttgggctttccgaaaaggtatcacatgtcaagtttggcctcacggtcttaaagttatagagtcatacatttttaacaaaaaaaaagagaaaaaccaaaaaaaaagagggatgacacacgaggactttcctggaggtcacccatgctagtactactctcgcccaagcacgcttaactgcggagttctgatgggatctggtgcattactgctggtatgatcgcattcgttactacatgcaatgcaaacgtatcaattcttttttaaagactttatgatccatttgccgtgggtcccaccatctatgtaggaataccctatcttgtttataagagctttgatacatgcaaaatattcgaaaacaatgtccgaacatataattttcgccccgtaatatagcaaagatcacgaaaaggctcgaaaaagtacattanaatcaaaatttggagtaggaaaaaaacattagaaaaacaccattttccttcctcattcatcggagagctctctttgggctttccgaaaaggtatcacatgtcaagtttggcctcacggtcttaaagttatagagtcatacatttttaacaaaaaaaaagagaaaaaccaaaaaaaaagagggatgacacacgaggactttcctggaggtcacccatgctagtactactctcgcccaagcacgcttaactgcggagttctgatgggatctggtgcattactgctggtatgatcgcattcgttactacatgcaatgcaaacgtatcaattcttttttaaagactttatgatccatttgccgtgggtcccaccatctatgtaggaataccctatcttgtttataagagctttgatacatgcaaaatattcgaaaacaatgtccgaacatataattttcgccccgtaatatagcaaagatcacgaaaaggctcgaaaagtacattaaaatcaaaatttggagtaggaaaaaaaaccaatagaagaattccattttccttcctcattcatcggagaggtctctttgggctttccgaaaaggtatcacatgtcaagtttggcctcacggtcttaaagttataaagtcatacatttttaacaaaaaaaaagagaaaaaccaaaaaaaaagagggatgacacacgaggactttcctggaggtcacccaccctagtactactctcgcccaagcacgcttaactgcggagttctgatgggatctgatgcattaatgctggtatgatagcgtccgttactacatgcaatacaatcgtatctattcttttttgaagactttatgatcgatttgccgtgggtcccaccagctatgtaggaataccctatcttgtttataagagctttgatacatgcaaaatatacgaaaaagatgtccgaacatgtaattttcgccgcgtaatatagcaaagatcacgaaaaggcccgaaaaagtacattaaggtcaaaattttgagtagaaaacaaaaccaatagaaaaattccattttccttcctcattcatcggagagctctctttgggctttccgaaaaggtatcacatgtcaagtttggcctcactgtcttaaatttataaagtcatacatttttaacaaaaaaaaaagagaaaaaccaaaaaaaaagagcgatgcaacacgaggactttcctggaggtcacccatcctagtactactctcgcccaagcacgcttaactgcggagttctgatgggatcttgtgcattagtgctggtatgatcgcatccattactacatgcaatgcaattgtatctatttttttttaaagactttatgatccatttgccgtgggtcccaccagctgtgtaggaataccctatcttgtttataagagctctgatacatgcaaaatattcaaaaataatgtccgaacatataattttggccccgtaatatagcaaagataacgaaaaggctcgaaaaaatactttaaaatcaaaatttggagaaggaaaaaaaccaatagaagaattccattttccttcctcattcatcggagagctctctttgggctttccgaaaaggtatcacatgtcaagtttggcctcacggtcttaaagttatagagtcatacatttttaacaaaacaaaaagagggatgacacacgaggactttcctagaggtcacccatgctagtcctactctcgcccaaccacgcttaactgcagagttctaatgggatctggtgcattagtgctggtatgatcgcatccgtaactacatgcaatgcaatcgtat

SEQ ID NO: 188 - DNA, 95223 bp, Arabidopsis thaliana
  modified_base (2720)..(72695): N = A, C G, or T/U
attgctatataaaaaaagacataacatttttccattcaatgggttcggaaaaaagtgaaagtgttgagattaaggaaccgttattttatccgtgtttaataaattttgtgtaactaactttttcgtataacttttgaaaagaatcaagaaaatgtggataagtttcgatttatgtaagaatgtgaattaatttattcgtgagagattaatataaagaaattcacaagcgaataacattatcttcgtgcggtattgtggcggcggtaaattaaaacgcaacaatttgagtttgataattattacgaaagacttaattagctaaatctgtaaaataacattatcttcgtgccgatgtcatcaaaacactctagaatagaaaaggaagaaagcatatcttttgagaagattctgactgttatgtgatctatatatattctgttgcatatttgcttttgtgttaaatggtccaatggtataatccaataatatcaccatattccggatgacatggtccttggttctttttgtaaagatttgggcttgttgggctgacttgacattatgaaaaacacgagagcccaggctaatgggcctaacaaagaaagcgtcctccgttctaaagcgaaacgtgaagcatattcgcaattggatccaagaagaaacctcaaagttagctttcgtactctttctcatcttcatctccacaatatccttagcttgtcactagttttggaataatcggtaggtttgggatacataacattgtttttgtagatgatagactcatcattgcttctttatgtttggtaatttgatgatgaatatactttcgattacagggcagccgagactaagacaccaaagcagatggattcaaaggtcccataaagacaaagataaggattagtatttttgagatatgtgagttgctgctagtttaaaagtaaaggtctgatggtgtgagcccaacgtttttgggaaagtaaatattacaatccaattcctctaatcattccttcaagcaaaagggagggaagatgtgcatttgtgtcaagatgtggtggaaattatcagagggtttatcaacggcatgtgtatgaacaccttggtatgtcgtcaccaccactccttcgtctccccattgcctctgcacttgcttcttcactctgcatccttcttctgtgcacttataatagctcctatatatatatatattcatattttacatgtatgtatatgagtctcttatttgatcaccatagcaagcatacagtatcattcattgatgattaagtacgtacctggggaatggattgttcttgactgctttttggccgtacttcctccacctgtatccatcatccagtatatcaacctggcttcttgtctggaacgcgtacctcgcttctctctctttcttcttcttcttactccttggcttctcttcggatgatgttgtcggctgagcagagttgtcgaccccatgaaactctgtcaagcgaggatcaaccgatgatgaacatggaaacaacacatcacacctcctatcctccatttcttaactccctctgcgtttatggtgggaacttgaaaaaagccaaggaggggagggagagaaagagagacgtacacggtagcgaagatgccagagaaagtgatatatattgaaaatatggctacattagcggatccatcacagaaaaagagttttgtggaaacaaaaaggtgtggcggctacatcattctgatttatattattatatatgcaactccttcaaattttggttcaatggattcaaatttcaaacatatttcttggtcaagaatcaatatgcatctagatctctgaggtaatcattcttttcttatttgatttacaatttggattagcaaggtttccaagataatatccaatatcacgtgtatttgaggttcacctaccaaacttgattgaattcaataaacaatgagctcgaatgatgttgagattgttgactattttggctctttgctttcttctatacttgtcaaaagtatataatcattgattccatggattattcatccctccatagttattcaaacttgattcatattcactttttacacacaacatagaattataataatactaggcattgatcacatgtaggatttgagacggggtcgcgtaagggactgcgctccatccaccaagacagtggtgcctgtcatgaagcgtgagccatcgctgatcaagtagataacagtggagtagaggtctgtgtccgggttgagccactggccgaggggtgcagcgtccttgaccagcttctgcgctcggtctcttcccacagaagctgtatactcatcatccagatgcagccctctagagatcatgttgacccgtatcttgtgcttcccgagactcatggctgatgcctgaaacccaatcatcaacaaacatattcaagttacgaacgcgatgtgtctaattaggagctaggatgcatacccggacgagctggtgaatagcggcagaagttgaagcgtaggcatcagcgccagggtaaagcgccctctctccgctggcgatagtggccatgaagacaatggagcctcctgatccatggtccttcatccttgtggctacagccttcaagagaaaccatggagcggtgagattgatctttgtgattctgtggaactcatcttgagagacttgaagaatgtcctgcacnnnnnnnnnnnnnnnnnnnnnnnnnnnnnnnnnnnnnnnnnnnnnnnnnnagattcatccgngaccaaatctgaaccaagtaacttggctactcttgctcacaaagatattgcgatacctgagcctgtggctaagaagagaaagatgaatgctgtgaaacgtaacagcctcttagagcctgctaagcgggttatgacagatgaggatagagtaaagcttggcagagatttggggtccttgacagaattccctgtacagataataaatttcctgagagatcacagctccaaggaagagagatctggagatgatgagatagagattgacatcaatgatctcagtcatgatgccttgttccagttgcgggatctctttgatgagtttctgcgagaaaatcaaaagaaagattcaaacggtgaaccctgtgtgttagaggtaatcacctttctatatctcattcttgatccatttgttaacatgactgataaacagcgaaaactttcttgatgtagcttttacatgggtcagggccaggaaattcattgacgcaacactgtgatggttagcatacactggttttgttgtttgagctaattcgcatgtcctactctatgattaagctgtcatttcctcctcgttacttgcagggagtgaattggaggacgaggatgttgacattggtaattatgagcaccctatatctcacatctcaactgtcagaacagaaaaaggtatggcgttagagaactacagtggtttgtttaatcttgctacattgtatttgtctttttctctatggagcttttgcagacgtttgatgtttgcaattcttatatgtacttaaccctcggaaccattttacttccctcttgtcagaagtggccgtccatctagaatactcaatgttacttctgtagtttttttggagtgaaacttactgaccttactgatagcaactcatattacacacctagtatgatagtgatagacctgttacattttctgcttgttttactcccaggtcgctgtttgctattttctatagtgatcatattatctctaatcagtgattactcctcttttggtgcaaaagatgttaagttttgttgatattaattaataaaccttggttttcttattccctttctaaaagcagattccgtcggtggattgaatcagatggaagatgcatccagagggaagctaagtcttattgagggggcagatggtcatcaagatggtaagctcagaagtgtagcagaaaaatatctgtgctctaatatctgagggtggcatctcactcttgacccattaataatttaggaaatagtgctccaaaagagaaggaactacctccagaaaagcgttacagggctgctctattgaaaaatcgatttgcggatataatcttgaaggctcaagagataactcttaatcaggttagctgtgtttgtggaggtgtgagctgttatatctggttagccctccctctttgactttcaaaattatatttgtgagatcagaatgagaaacgagacccagagacactgcaacgtgagaaggaagaactggaattgcaaaagaagaaaggtattcttgatttgctagtttcgattttttgattgatgatatataccaagtagtatatacgtacataaacttgtcctcttattgktttgtgcaccagaaaaagcacggttacaagcagaagccaaggaagctgaagaagctcgtagaaaagctgaggcacaagaggctaagaggaaactggaacttgaaagagaagcagcccggcaggcattgcttgaggtaaatcaaaattgctgccttgtaccagtttggttttataaactgcaatacatgtatattgatcattgccatgactgaatggtacaccagatggagaagtcggttgaaataaatgagaacacaaggtttctcaaggacctagaactgctcaaaacggttaacacggaccagttacgaaatctaagagatgttggctctgagtctgatgggttggctgtatttgggtttggaggaagtaatcctctagagcagctggggctannnnnnnnnnnnnnnnnnnnnnnnnnnnnnnnnnnnnnnnnnnnnnnnnnaagctgtttattagtgtcttgaagaacctttggctctaagcaggaaggtgtcatcctctacggccaatctgtaggcagcggacctacgttagatcttgcttcccggttgcctcaacttagagccgtcgtccttcacagccccattctctccggtttaagagttatgtattccgtcaagaaaacctactggttcgacatctacaaggtagaccacgtaccaattctttctattaatcctacacattctccaaattgtaatgtaagaagcttgttgtgtgtgagtgtgtgtttttccgcagaatatcgacaaaatcccatatgtcgattgcccggttctcatcattcatgtaagtcaggtttcagatagatacattttcgtttgaatttttgataagctttttggatccaaacagtttcaaatatgtgcagggaacttcggatgaggtagtggattgttctcatgggaaacaactatgggaactctgcaaagacaagtacgagccgctctgggtgaaaggagggaaccactgtgatcttgaacactaccctgaatacattagacacctcaagaagttcatagcaacagtagagagattaccatgtccgaggatgagcagcgaccaatcagagagagtgagagatgcgcccccgaggagaagtatggacaggagagtgaagccgaggcagagcacagagcgtagagagaaagagaagccaccaaagagtcagtcgaagatgagtagcagcagcagcaagctcaagatctcgtttgatcaacttgatcgctcgcggaggagcgttgactgccatgaaaagactcggaagagcgttgaccagattgagagggggaggaagagtgtggataggttggatagagttcgctccgagtaaaaaccacacactcacactcacacacgtataatacgtatgtagatgaaaagagtacataactgtttctatttaccgaacaaaataacatgtggatgtcgctcctcatattattgatttgtaatcttttatgcaatttgggatctctctcgccatctccttttgaatcaacaaccttttgtggtgggcttgaatatccatcctctgtttttagatgagtttttagtgtttgtggtaagtaggaaagttccaaaacaaagatcacacatctcatgtgggcctgaactaaattcatggcccaatcgtttgttcttaatagaaatccaatttttaggatctcgctatcttttgctacgtacaaaaattaatatatacaaaaagtagctcacttctaaaataaggctaatggatgcccattttcttctcaaatccatcgattttcctaaaatttctcaaatttcaaaacatataaatccatctcattgtcctcttgttttccttcatctgaagcttctgcagtattcaaacaaataaaatatactgctttagctttggacacctcctcttactaatctctataactatatttaaaaagtagaaaataatggcacgtctatttgtcgtagttgcccttttggctttggccgtgggcaccgtattcgccgccgatgcaccttcagctgcacccaccgcctcaccaaccaaatccccaaccaaggctcctgccgctgcacccaaatcctccgccgccgcaccgaaagcatcatcccctgttgctgaggaacccacccctgaagacgactactctgcagccagccccagtgactccgccgaggcacccaccgtctnctccccacccgctcctacccccgaagccgatggtccctcctccgacggaccctcatctgatggacccgccgccgccgagtcacccaaaagtggcgccacgactaatgtgaagctctccatcgccggcactgtcgccgccgccggattcttcatcttctctctctaagttttgttttttaattaaacttgagacggaatcataagattcacattatgagatgaggccgtatctctntaactaactaactatactatatacagtgatttatattaatcaagagattgaatggagttattattattacnnnnnnnnnnnnnnnnnnnnnnnnnnnnnnnnnnnnnnnnnnnnnnnnnntttctgttagaatctgagcaatgtgtagatacaaacaactaaaccaaaaaaaggtgagacattttgcttcccccaaagtcatataggtttgtttgtattcttttaaacattattttttgtcaagagttataaagtcggattgtaattttcaaaaacacacgaaggaaccaaaatctcaatctctgttacacataataattaacaggcaaagttgatcgatcaacttgctatagacggtttttgaactttatgctttgtggttcgtgccaacttataactgctttttattttttttctgacatcactggtttttcactataggtaatccaactaaaaaaaacactttagaaaagtatagtttatttctacaaaaattccatacacagttttttggcggaccactttctctctcatgtggtgtgagtctgagaggatactttaatagtaaaactaataaaatctcataaagcaacggaaaagaagaaacagacagagaaacctgcattttgttttttttgaattcaaattttaaacagtaaaaagcctttttgtacaacggatacatcttccttctactttcttttctttcattttacccacttatatttcttcttaactttaaaacttaacaaatacatttttggaattgaactacaattgttccaaaagaatgggagaatctgcttgtctcatgcagccattctcttatgcagctccacaggtttgttagttgctttctcttctatttcagttacatattcttttaaaaaatcatatgttttcttagaaattaagctctctctgttctttctttagggagattctcttggtgctttaggacagtctgtgtccttcggaagattcatgtcggagaaacttgactgggagaaatggtctgctttctccacacagaacccttacgtggctgaggcagagagatactctaagcccggatctgttgctcagaagaaagctttctttgaagctcactacaagaaagtcgctgctgctagaaaagctgctgctgaagaggcactcttgcttcagcagcaaatccctaaaccccaaccagagaagtctccagttcaagaagaagatatcaatgaaggagaaaagaaagattggatggtctcaaaaccggatcttgagattccaagaggatctttagatgtttctgctcattgaattacttgcagagaaagaaggccgatttagtaatagacaatctgatgagaaagagaactgtggcatggctgagtcagagatcaatggccgcacagctgaagaacaagtagatgaggagaaacctatactaaaggtatatatttatacatgtgtatttattaagagatggtgattaagagttttctttctctctgacttttttttctattgttcttgatctgtaacagtctgtgaagaagaaatccaaagattcacaaccaaagagtagtactaaaccaagagtctctaagtacaattcatcggagaggactccaagtaaaaagtctaataacaagagcagctcgtacactttcacgcctgcaaaagagttcaatagattggtgtccatcataaggaagattgatgggtcaagagcttcttctaaaccaaccaaagactgcaaaactcctctccggacaccatcaaacaaggtgactgcattctttaaactgtgtttcactcaaccaagtgcttatgctcttgtgatgattgcaggtgtctgcaaagggaatggttgaagactccttgtccacacctttatcgagtaacacaaggtaaaaactgaattaactcttagaaaacttctttttacttccttcattcacgagtggttagagaagtaatcaggtgttacagtaagtgcagagggaagatagctcctaattcttctgccaagacaggtcgaggaagatggaatttcctccctgcggagtaagaagaactgatcttcataagagtttactcaattcaaaaatgtataatgtgtacgtacctttttaaccaagttattggaaaacaaaagcaggacaccgagctgttttacaccgtttggcttaagaacagaggagagagcagagagaagaaaaaaggcaagaatagagatatttttggtttctacgcttttgtcttgtcacttaccatcatttaactggttcttgtgtttcagaagctagaggggaaattcaaggaaatggagacacagaaccagaaggcggaggagaggagtgtggagaaggaagagagtaaactaaggcaaaggctatgcttcaaagcgaagccacttccaaatttctacaaacagagaccaaaatcaacagaccaaactaagaaagtaagcttactttcactaatcgccaaatgtatgtgtgaagtactaaaagaaaaagatagtagccatcgtttctgtgtctgagagttctctgtgtggtctttgtaggctctgttacagtagcagagaggtcttacagaaactccctatcatcatctttcagagagatattgcgctgacttagcgcctgtggctgtggggagaactatcaaaaccggattgcctcaaaaaaggattagtttggaattgttgacatactgtatttggttttattccaagaaggaatattgaattttactagattgcattgtatgaatatttgtaaactttgtttatatatgatttgaaaacacaaaataagaaagaaagggggcattccgagaattgaactcgggacctctcgcaccctaagcgagaatcataccactagaccaaatgccctctntgaaaaatntggtnttcatttaatttctaaataaacattaataagttcacaatcatcaaaaattacnnnnnnnnnnnnnnnnnnnnnnnnnnnnnnnnnnnnnnnnnnnnnnnnnngtattcttttttgtgtcatcttttttttctttcttttctttatggcatcataattttttttagtcgtaatctatagaggagactaaagattcttcattctgtgtcagtggctcacatcctctgattaactaaaacgcacacaaacaagaaaaaaagctatgaaaacaggaaaaaaaataggaaatatcagtcttgtctaaaacgacgaagaagaagaggaagaatcgagacaaacatttcacattcccagagattgtggtgtcgttgggtattcattctctctctctctcacattactttgacgagttcttagtgtgttggttctccaaatgctctgcatattacattaaatctctctctgcttttttttgggctataatatatgttgggttttcttcaacttgcttggatctgttgtaataagcgagttagctcaaaatctctttcttaatgaatgagctttcaaagttagctgttttttcctcttcttcttctttatcttggatcttgatcaatcgaatcagtaatgtgtttggaatagaattagttacatacatttacctttctggttcatgcattgtcttagcatttgacggtttcgctgtttcagattaaaagttgaattcttagggtttagacaaagctttccctgttttgttacttaaatgtttgctttgcattcggatgatgcttgtgcaggtacttacttcttagggtgattcaggacttgctaattataggcaaaaaatggttttgggtttaagctcaaagaacagaagatgctcatcggtacaagttgattacctgatccacattcatgacatcaagccttggcctccttctcagtcccttcgatctcttcgctctgttgttatccaatgggagaatggtgaccgcaattctggtaccacttctgttgttgctccttctcttggttctgtcattggcgaaggcaaaatcgagttcaacgaatcatttaagcttcccctcaccttgttgaaagatgtctctgctcggggcaaaggtggtgatgtcttcttcaagaacgtcttagagctcaacttatacgagcctcgcagagagaaaacacatcagcttttggctactgccaccattgatttggctgtgtacggtgttgtcaaagaaagtttcagcttgactgctcaaatgaacagtaaacgaagctaccggaatgccactcagcctgttctgtacctcactattcaacccgttagtagacgccgggccagttcttcatctatgaacagcttgaaggatgaagccaagaatgggggtgaatctgtttctgccttgatgaatgaggaatactataaggaagctgagattgcttccatcacagacgacgacatttcctcccactcctccttgacagtctcatcttcaactttagagtctaatggtggtttttctgtgcgaaccgaagaggtaagagatggcaatagctcgacattcttctgataagttatgaaaatgaaatgtttctcaatgctttgatgtcttatttgcaggaagaacatgagcgaataaacaagaatcccagagggaatggccacgagagatcaaaatcagtgtcagagagcagacaaagacaaattgctgaccagattccgtcacgttcctcgtcagtagatctatcttctgtgtttcatctcccggagggcatttctgattctgcacccaacacttctttgtctgggctggagcactgtgctaatgtgtttataactgataccaatgagagctcgaagctggcaagtaacggtcagcacaataatggaraggccaagtctgtgcctttacaaattgacaatctttcggaaaatgcttcgcctcgagcctctgtgaatagtcaagatttgaccagtgatcaggaaccagagagtatagttgagaaatcaagaaaggtgaagtctgttcgatcatccttggatattaaccggagcaatagccggttgagtttattcagtgaaagaaaagagctaaggtgtatccaaattctacacacgacacannnnnnnnnnnnnnnnnnnnnnnnnnnnnnnnnnnnnnnnnnnnnnnnnnctgagccactgctatagcaaccggtcttgggtacgcatagtccctgcaaatcatttcgaaccacaatcaattccacagccaaatgtcattgtcattcttctgggacagtatcatacctgacgatgagttcggagaaataaccgcctccaatgcgtccaaggaagttccaaatgctaatcatggacacaaagacgtgagtgttatcgtaaccgagagactgactcatctgcccaaggttatctatgaccgttagacccgaaccagatccgagcaagagggagaagaagatgagccagaaatcggctttaacgagtgcttgagttaaagtaaaatcctcgcctctgtgagggcccctccgtctcttgacccgaacagcaccctctgcagctgcttgcatcagctttgcttgcaactgagcaattctcttatgtctctccactgcaggaagcaaatctacttcttttggtttctcgtcttccacttcactaaatataagctcaggaccatggtcaggggtggtggactgtcccggatcctgaccttgctgatcgccaaggagaggttcttcgagcgtgtcacaggggtcggttgatgctgtgaagcaactcgttgcgattggtatgaagatgggtacaagaagaatggcaaacaagacaacggtgaaagcaatgatgattgaatggctaagatcaatgaaatcttcaacaagcatcactgccatgagataggcagcaagtagaatgcagacggcatagatgacggtgaagctggtggcatcagaagaacggatctgtctgtgaccaccgacgggtctgatgaagaacatgagaggaacaacaacaactgaaggggcaacagcaaccatgaagatgagggatgcacggtcagaggagtggatcattgtgtatacctgggagaggatggcaccgccgaggccagcaaaccccttgaggataccgacgacaggaccacggctcttgggaaagttctgaacaccagaaactaatgcagcggtgttgaagtaggtctccccgttgttcccaacaaaaatgaggatacacatctgaaagatgacaaagagattcagattaagttgatgaattgcttgtaaaaggaacgtcgagcaaagaccaaaaaggatcccaggagatattccaattgcactttcacaatcttgaccagaaagattaatagtcaactggttttcttatagaaacagtgaaggaattcaatttccaagctacagaaggatcactctctctcacacagatttgacagccatttcataggaaccaccaaacaacaaccttaaaaacgcaaactttgggagattcgattctccaaacagacatcattaaaagaaggaagagaaaaaagcaaactttagtccaaaatagaaacagaaagctggagaaaaagaaaggaaacaactcacagcccataaaggaagaatgggagcacgaccggtgacgataagccaaacccagccatagccgacaaggttctggacagagccgacgagaagagcggcccagagaggcaagatctcggagagagtaccagcgaggaagccgacactatcgccgagatctttggcgacaccgagcctggagagctgtttctggttgtagttgagggagctcttgatgacaggagagatgctgccgaacaagtaaccgatgccagcgcaagactgaatccacatggccgcaacaaacactagccatctattgtttatgaacgatttcactctttctcgcgtcgtcctcgccattttttcgatttctttgtacgatcaaccttgtatttctttcttggtctcttgatgaattgatgatgatctttagatccctttaatctttctttcacaagaaattaactaggactgttgttaatcagttgttgttttttaataaaaaaatgtattagtcgaacttagagtaataattagacaaaacattaaacgaaatatttcccattatgttactagtattttattcggcggcgatgcatgccctgtcatacttacattttgggaccacattcaaaatcatttttccaggtctcatttagtaacttaccattcaaagtttaacttaaatctgatannnnnnnnnnnnnnnnnnnnnnnnnnnnnnnnnnnnnnnnnnnnnnnnnncaactctgtcgcaaagattttgcccatcttttacgggaaaggtttgcgaaaactcatcaacaaaattcctttagaaatgcggggtcaagatggtccaactggtcccaaagttaaggtgacttggaccggtgatgaacaatattcttagtgttttattgtgaattattgcattatgttatatatcaataaggtttacatttgtcgaaaataatcattgtaatttctaattagtaacaataatactatagaatctgttaagaattaagatgtagatgtgctaattaaaaattttagagttatttgggaaaaaaaaaggttgtcatgatcttagttttagagttaaaaaatagtatttatctggaaataaattggtgtagattattaagagtttttttaaaaataatttggattagatttaatttgattttttacctatagtcatggaattagatttattgccgagaagcaatattgatccatctaaatatggacccacgaaccatggccgttgggcctttaactaatggttgggttttgacccggttgaagaattcaggtgggcattgataggtccgccgtgtctttttttwtttttttttttcgaagaagaatcatcttcatcttcttcttccagagggaattgaatttgttttctttctcctggagttgagattatacgctttctgctgtattgaagaagaagaagttgtgtcctatatcttactatttagatttggggggaaattgattagggctctatcctcgcgcagcactaaattagggttacgttcggcttagaaagggcaaaattcgatagagtgtgtgtgttgtgattttgatgaggttcttctagccaaaattactgagtaactactgtcgacaccaatttgggattgtattcaattttttgtgatcagcaatgtctgggaataacgagttgaacgcactaaaagggcctcaaagctctctgccttggccatttggaatggcctctgcatcgtttgctccctcccacatggcccctcctaactttcaacctcagtttcagctctctcaagaccaagggattagtgctcctggaagaaggttcccacataaacctcccattggaggacctcctgctgttcctcctagtatggagttgactccagcttccaggaaaaagaaacataagcttccagacaagtcctccttgcaggagcgcgttgctgccgtcttgcccgagtctgctctctacacacagcttcttgagtttgagtctcgggttgatgccgctctcttcagaaagaaagttgacatccaagactcccttaagaaccctccttccattcagaagacccttaggatctacgttttcaacaccttttccaaccagatccctggtcctgaccctcccacatggactcttaggattttcggcagggtcctggatcctgaccacactggtggattagttcagaattcaaacccactttatcccaagttctcgtctttcttcaaaacgttaaagatatccctggaccagagcctgtatcctgagaaccatctgatcgaatggaaaagggatcgatcgcctgctcctctggaagggtttgagataaagaggatagggtgtcaggagtttgcagctactatactgttggagatgaattacgtccctgagaagttcaagacttctcctgctttgatgcaagttttgggcattgaggttgacactcgcccaagaatcattgcggcaatctggcattacgtgaaagtcaggaaactgcaaaacccaaacgacccttctttcttcaactgtgatgctgctctccacagtgtttttggggaagagaagatgaaattcactatgctctctcataagatatctcagcacctatcacctccgcctcccattcagcttgtacacaagatcaagctttcggggaacaatccagccatctcagcatgttacgatgtgcttgtggacataccagcaccggtccaaacggagctttccaatctgctcgctaatccagagaagaacaaagagattgaggcatgtgatgaagccatatgcggagccataaggaaaatccacgagcacagaaggagacgggcgtttttcttagggtttagccagtcaccggtggaattcaccaatgccttgatggaatctcagaccaaagatctgaagcttgttgcaggagaagcaagtcgaaacgctgagaaagaaggccgatcagagttcttcaatcagccatggtaataatctctactgttctgcttttcatcacttgtcttacaatcactgagaattctcttgcagggtggaggatgctgcaatacgttacttgaaccggaagccagcaggcgggtaagatgcagatgggccaagaagttcatgagttcactacttttacctagaagtcacttaggtccaggacacttgatcagtgtcgttccttataggttttttttctaagtgaaacattgttactcaagtttcaagagtttttactttggtttgtagctcgtgcatcatatgcgmcaaaatataagaaagataaatacttgactttttcactttcttttgtagattccacgtactgacttccaattggctcgatctagtcttgtagaataataataacgtacgtattattatggatagaaaaagaccaaggcattgtgctctcacgttgaacttttaatatagtcatcatcccaagatgataacaaatgcaaaatgggtcattttcaaacaaaaatataataactgagctaatattggttgaattttcttcaaaactcaaaaatttagtagagactttatgacttggattgaaaaaaaaaaaaaaaaagttgagttgtttacccaaaggagaaaataattttgggtatgaatgatcatagagacgttttacataaaataaaaagccatgataattgactttgtttgtatattcaaggggaaagagaaggatctctccgatgaacgcggacttgcatcccaccagccatgtgagccgtgagcattggcacaaaatccggtttatccgtagggatcggttcaatctcaaaccggtcaagtatggaagccacaatatacttcatctgcacgtacgccatctcttccccaagacaaacccttgggccggcttggaaaaccggaaacttgaacggattcacctttttcaaaactctgcagcaggttttatcataagactcagcccaccggtttggtttaaactcatcccaatcttccccccatagctcttccattctccccataccatatggaaaatacgttacccggtctccggcacgcaccaacgtaccgtctggtaaccggtcatcggttaaggcgtgtttggagtcccacggcaccggaggatacaatcgcatcacttcacacaaacacgctttcaacaaactcagtttcttcaatgattcgtaatcaaaaccccccgttatctcctcctkgaccgatcggatttcactaaccagatcgtgctcggtttcctcgtgaccggtgatcaaccaaaacagccgtgtggctaccgccgacgtggtgtccctccccgccattatgatacttattaccatatctctcaccgtctcgtcgctttctcsggcgacgatcaaccgcgagagaaagtcttggtkggcaggcttcctcttcttatcccgaatgatctcatcgacgcagttakggacttctccgacggcttttctgagctctttctcagatccaaaaccgaccagtctcttaaacttccacacaaaagacagcggtgcggaaccgcgtccagcgctgaccgcagaagctgtctgaaaggctctgtcgaactcagaaacggggraggaagggtttaaagtgcaacgatcgatcccgaggaaaccaatgcaaccaatattgaaagtgaatctacggagaagctcctgaagatcgaagggttgtgaatcttccgcagctgcgtttagaaacgctaagagctccttctccacctcgtttctcaaaacggtgacgtattctctcagcgactttggggtgaagtcgtgtgtagcaagtctcctctgctttaaccagaggtttccgtcaacgttgaagatcccgttgccgagaaaatctccgaggatctccgtaaaaggtttgcctttgggatagttgtcgaagtttgttttgaggatatactccacgttcgaggggttcgccgtcactacggttctccgtgcagctaagcggcgaatgactaccgtccgactcggggattcggttaggagctctgtataccaatccagtaaccggtttcggttggtatagaatgaaattaagcatccgataaccgggtatgttttcggtgtagagttgcggcaagaatatatcacatgttttcccgcagagacaagcaacagcacaaggacaagaagaagaataaaagttgaagcttccattgttgatgagcttcaaaacgacaaaaggaggcaggaggaaataatggtcaatactcaatagagatttgacgcacgagcttgaattcatcatcttcatggatcccattcatataatattttagtatatgctttgatatctatgtataaactactcctattttcaaagactttcctcaataatctctagttactttccattattttttaccacccaaacttcatctcatttgtttttttttcttaaataatcctcttgcttcttcaatcttctacacactaaagtatattatttcatcgaatgataaaagtaattgaggttgtaacattacgttcgatattcgacaagtgtatgaatttaaatcattcttcaagatcatattctactaaattagtttttttaattttattttataaattggatagattaacgcgaaaattgcggtgacacatgcaaatatctactctaataaaatatgagaggaggaggagaagcataaaaatagatgtcgcatattcgagaaaagagaatggacaatgaacaaaataggcaggtaacacgagatgtatataacaagttaatattgtcttctcgacgttctcgtgatgcaataactcggattaaaataaaatgtaaaacgtttttccgtcaaatatgatttaaaaaaaaaaaaaaattgttactaacggctagtttacccccaaaaaaaaatgattttactaacggaggagaagtgtttcgaaaattcgacaatgattaagaagaaagttagatcaaacgaacaggatcacaggaagaaggtacaacgtgaagcaatcaatgaggctaaaataaaatattgagaaatttgctcaaccatatgatttcattaatatataataatgaataacagttctatcatataaataaataatttataatccaccacatgacaacagatgggttttcccattttatttaactataaacagtattttgctctcacagatccacaaggacaagcatattcaaggatgttttagttcttaaagaaaagataaagagagaccagacgcatagtggtaacttggtctacaagttagagtggccaagccggagaaggacacggtgccacgaagtgttgagaacccctcttaggttccacaccgactccacattttccggttgaacattcgccgccgaatcaacctgcacatttccacagttttctattaactcttgtcagaagccatttatattagctgagcaagatgttgaggctttaccgctttggcgatgacctctgtagtctgtgaaacatcaatggtggcttcaaacaacacccatgcccatttgtcactggagctgtgttctgagatgtactgctttcctggttcctgcgttctagaagcttccacccagtttttgcctccatccagggatatgtccactctttctatcccgcgtccacctcctgaaaccgcatatcctttgatacttacctgcaattttttttttttaattgaattagctcttgctttcctacattggtcagatcagattaggnnnnnnnnnnnnnnnnnnnnnnnnnnnnnnnnnnnnnnnnnnnnnnnnnnaaaaaagtatgactctataaattttagaccgtgaggccaaacttggcatgtgataccttttcggaaagcccaaagagagctctccgatgaatgaggaagcacaatggaattcttctatttgtttttttgtactccaaattttgaccttaatgtactttttcaggccttatgtgatctttgctatattacgaggcaaaaattatatgttcggacattgtttttaaatattttgcgtttatcaaagctcatataaacaagatagggtattcctacatagctggtaggacccacggaaaatggatcataaagtcttcaaaaaagaataaatacgattgcattgcatgtagtaacggatgcgatcataccagcattaatgcacgggatcccatcagaactctgcagttaagcgtgcttgggcgagagttgtactaggatgggtgacctccaggaaagtcctcgtgttgcatccctctttttttctcggtttttctcttttttgttttgttaaaagtatatgactctataacttttagaccgtgaggccaaacttggcatgtgataccttttcggaaagcccaaagagagctctccatttaatgaggaaggaaaatggaattcttctattgtttttttttctaatccaaattttgaccttaatgtactttttcgtgccttttcgtgatctttgctatattacggggcaaaaattatgtattcggacattgtttttgaatattttgcatgtatcaaaactcttataaacaagatagggtgtttctacatagctagtggtacccacggcaaatggatcataaagtcttcaaaaaagaatagatacgattacattgcatgtagtaacggatgcgatcataccagcattaatgcaccggatcccatcagaactctacagttaagcgtgcttgggtgagagtagtactaggatggatgacctctcggaaagtcctcgtgttgcatccctctttttttttcgagttttctctttttttttgttaaaaatgtatgactctataaattttagaccgtgaggccaaacttggcatgtgataccttttcggaaagcccaaagagagctctccgatgaatgaggaagcacaatggaattmttctatttktttttttgtactccaaattttgaccttaatgtactttttcaggccttatgtgatctttgctatattacgaggcaaaaattatatgttcggacattgtttttaaatattttgcgtttatcaaagctcatataaacaagatagggtattcctacatagctggtaggacccacggaaaatggatcataaagtcttcaaaaaagaataaatacgattgcattgcatgtagtaacggatgcgatcataccagcattaatgcacgggatcccatcagaactctgcagttaagcgtgcttgggcgagagttgtactaggatgggtgaccttcaggaaagtcctcgtgttgcatccctctttttttctcggtttttctcttttttgttttgttaaaagtatatgactctataaattttagaccgtgaggccaaacttggcatgtgataccttttcggaaagcccaaagagagctctccgatgaatgaggaagcacaatggaattattctatttttttttttgtactccaaattttgaccttaatgtactttttcaggccttatgtgatctttgctatattacgaggcaaaaattatatgttcggacattgtttttaaatattttgcgtttatcaaagctcatataaacaagatagggtattcctacatagctggtaggacccacggaaaatggatcataaagtcttcaaaaaagaataaatacgattgcattgcatgtagtaacggatgcgatcataccagcattaatgcacgggatcccatcagaactctgcagttaagcgtgcttgggcgagagttgtactaggatgggtgaccttcaggaaagtcctcgtgttgcatccctctttttttctcggtttttctcttttttgttttgttaaaagtatatgactctataaattttannnnnnnnnnnnnnnnnnnnnnnnnnnnnnnnnnnnnnnnnnnnnnnnnngatatgtttggactctgttttcgaatattttgcatgtatcaaagctcttataaacaagatagggtattcctacatagctggtgggacccacgacaaatagatcataaagtattcaaaaaagaatagatacgattgcaatgcatgtagtaacggatgctatcatactagcactaatgcaccggatcccatcagaactccgcagttaagcgtgcttgggcgagagtagtatgaggatgggtgacctcccggaaagtcctcatgttgcatccctctttttttcggtttttctctattttgtattgttaaagatgtatgactctatacctttaagaccgtgaggccaaacttgacatgtsataccatttcggaaatcccaaagagagctctccgatgaaagaggaaggaaaatggaattcttcttttgtttttttttctacaccaaattttgaccttaatgtactttttcgagccttttcgtgatctttgctatattacggggcgaaaattatatgttcggacattgttttcggatattttgtatctatcaaagctcttataaacaagatagggtattcctacatagctagtgggatccacgacaaatggatcataaagtcttcaaaaaagaatagatacgattgcattccatgtagtaacatatgcgattgcattccatgtagtaacatatgcgatcataccagcactaatgcactggatcccatcagaactccgcagttaagcgtgcttgggcgagagtagtacgaggatgggtgacctcgaggaatgtcctcgtgttgcatccctctttttttccggtttttctcttttttgttttgttaaaaatgtatgactctataacttttataccgtgaggccaaacttggcatgccataccttttcggaaagcccaaagagagctctccaatgaatgaggaaggaaaatggaattcttctattgtttttttttctactcaaaattttgaccttaatgtacattttcgggccttttcttgatctttgcaatattacgaggcaaaaattatatgtttggacattgtttttgaatattttgcatgtctcaaagctcttataaacaagatagattgcaatgcatgtagtaacggatgctatcatactagcactaatgcaccagatcccatcagaactccgcagttaagcgtgcttgaaaaagagttgtactagtatgggtgacctcccggaaagtcctcgtgttgcatccctcttttttttttttttggtttttctctttttttttgttaaaaatgtatgactttataactttaataccgtgaggccaaacttgacatgtgatacattttcggaaggcccaaagagaactctccgatgaatgaggaaggaaaatggtattcttctattggtttaactcctactcaaaattttgaccttaatgtactttttcgagacttttcgtaatctttgctttaatacggggcgaaaattatatgttcggacattgttttcgaatattttacatttatcaaagctcttataaacaagattgggtattcctacatagctggtgggacccacggcgaatggatcataaagttttcaaaacagaatagatacgattgcattgcatgtagtaacagatgcgatcataccaacattaatgcactcgatcccagcagaactccgcagttaagggtgcttgtgagagagtagtactaggatgggtgacctcccggaaagtcctcgtgttgcatccctcttttgttttcggtttttctctttttgttttgttaaaaatatatgactctataaagtttagaccgtgaggccaaaattggcatgtgataccttttcggaaaacccaaagagagctctccgatgaatgaggaagcacaatggaattcttctatttgttttttttctactcctaattttgaccttaatgtacttttcaggcctttttgtgatctttgttatattacgaggcgaaaatttcatgttcggacattgtttttgaactaggatatgacccgcggtataccgcgggttaaatattttaattaattttcgatttttgtaacatgaagaatttgttgtgatatttgttattgtttgtgttgattaataattttcgataaggttgtgtacgcgtattagtaagtcgtatgtttacaatattaataagtctaatattactttttctcttaagatttgacccgtggtacactacatgataattttttatttttagtcagaaaacttttatattaaaattacaaaattaaatctttatttggttttagatttaactcgtaaaacatatggaatatagtaactgtgtattacagttacacatttagatgtgtcagcgaagattaacacttattttgatatagtataatgttgattttcattgggatgtctcatattaatatcgagccaaaccgttccattcaaactcgtcccatccaaatccgtctcatccaaactcattccattatataaactcttctcatttacactcattcggcaatataaacccgtcccgtgataactaaacataattttgttttttttgtttaaataataatttacatctaacttattaaaatttgactcaattcaaattttaaatctacctaacaaaaatttagtgaaagaaaaataaatattacactttgaagaaagtgtaagacaatatcaagttgttgattccgtccattcttggatcagtctcaaactcaggatcaatgtagaagaagacttgcaaaaccaagtaataaaaggttttaatggactcttgacttcatctgaggagaatatagccaagaacaaaagcgtagttaccggcatgtcatctgctctccaggaaggagtcgctgctcctcaaagcaaaaacattgtatcttgttgaaataaactcctgtctgaagaaaccaatataagaatttgagaatcgaccaatattgttctacggataggatcgcactaccaaggctaatatatatacaccttgatgggagtaacattgtatgtcgagacgccggttattggagctgaacttttgttttcagcagtgtaaaatgcgagtgcactttctcctggcgttactctaacctataagaacgaacaaaaaccaaaaaaacatatcagttaaaaaaacactaactcgtcacaacactcttcttgagatataaagtctaaacctctctctgtgatgaagtgaacttccattgcatctcatctgcaacatcggcattgaactgcaccacaatctacctaacaaaccggcggcggcgagttctagatttgcgccgaaacagacgttagtgagagcttgaggaggataaagatcagagactacgatggcggcggttgaagaatcgaagaaagataaggtggaagtggagatggatatgtgaagagcattagcgagtaaatcactgtcgtgaaagaaggaaccaaaggttagccatgaatcgatgttgaattttggcagaatgaccaagggtcaacactcgttaatccctccgatgatgtcattatgatttagtaaggaatgaggtaagtgcttgatgagttagaaagtctaatgaaactctatatttatagagatgtttagtttaggtgtttaggtttgccgatcaaataaattcttggagatcaaagactcatcaaacattaaatctaagatacgtcaaaaaaaaatcatggtaaaatcaccataaattaataccacgattttagaaaagattagtatattgtgaagttncaatataagtaggattgaaaattaggtttaggcaaaattttaagattcgaatatgtagagaatatgcataatgctagtaccaaatttaagtttccaatatagaaattggcttgaataccttgttgtagaatttgaaattattaaatagtggttgcaatccacgtaatattttttaagattccgaatcttaacttaatgattgacatttacatgatttaatatatggttagttgtttaatatcgaatatcccatttaattctcgtcaaatttactaattaatttttgttctttttttttctttttttttgaatttgatttcataatttaatgttagcattaatttcgtaattgtttatgttaacattatttaggcatattcgttaccataattatgaaaaatcttacctaattttgtttaattgttttgtagatattcaaactactgataatgggtcagttaatgggccaaagatccagcaaaaaatgcggataaaaccccaaaaaaaccagacccaataaattctttattttgtatttcaaaaatgttaagtagatattttgcatgtaccaaagctcttataaacaagatagggtattcctacagaactggtgggacccacgtcaaatggatcataaagtcttcaaaaaataatagatacgattgcattgcatgtagtcacggatgcgatcataccagcattaatgcactggatcccatcagaactctgcagttaagcgtgcttgggcgagagtagtactaggatgggagatctctcggaaagttctcgtgttgcatccctctttttgtttttcggttttctctattttttttgttaaaaatgtatgactctataaattttagaccgtgaggccaaacttggcatgtgataccttttcggaaagcccaaagagagctctccgatgaatgaggacgcacaatggaattcttttatttgtttttttctactctaaattttgaccttaatgtattttttcaggccttttttgtgatctttgctatattacggggcaaaaattaaatgttcggacattatttttgaatattttgcgtttatcaaagctcatatagacaagatagggtattcctacatagctggtgggccccacggcaaatagatcataaagtcttcaaaaaagaatagatacgattcaattgcatgtagtaaaggatgcgatcataccagcattaatgcaacggatcccatcagaaatctgcagttaaacgtgtttgggcgagagttgtactacgatggtttacctccaggaaagtcctcgtgttgcatccctctttttttctcggtttttctcttttttgttttgttaaaagtatatgactctataaattttagaccgtgaggccaaacttggcatgtgataccttttcgaaaagcccaaagagagctctccgatgaatgaggaagcacaatggaattcttttctttgtttttttctactctaaattttgaccttaatgtattttttcaagcctttttcgtgatctttgctatattacggggcaaaaattaaatgttcggacattatttttgaatactttgcgtttatcaaagctcatatagacaagatagggtattcctacatagctggtggtacccacggcaaatagatcataaagtcttcaaaaaagaatagataaaattgcattgcatgtattaacagctgcgatcataccagcactaatgaaccggatcccatcagaactccacagttaagcgtgcttgggcgagagttgttctaggatggatgacctctaggaaagtcctcgtgttccatccctcttttgtttcggtttttctctttttttttgttaaaaataaatgactctataacttttagaccgtgaggccaaacttggcatgtgataccttttcggaaagcccaaagagnnnnnnnnnnnnnnnnnnnnnnnnnnnnnnnnnnnnnnnnnnnnnnnnnncaacatccgctgacgcgaaccccttgcgnccgcatcgaatataacttcgtataatgtatgctatacgaagttattagcgatgagctcggacttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccgagctcgcgagctcgtcgacagcgacacacttgcatcggatgcagcccggttaacgtgccggcacggcctgggtaaccaggtattttgtccacataaccgtgcgcaaaatgttgtggataagcaggacacagcagcaatccacagcaggcatacaaccgcacaccgaggttactccgttctacaggttacgacgacatgtcaatacttgcccttgacaggcattgatggaatcgtagtctcacgctgatagtctgatcgacaatacaagtgggaccgtggtcccagaccgataatcagaccgacaacacgagtgggatcgtggtcccagactaataatcagaccgacgatacgagtgggaccgtggtcccagactaataatcagaccgacgatacgagtgggaccgtggttccagactaataatcagaccgacgatacgagtgggaccgtggtcccagactaataatcagaccgacgatacgagtgggaccatggtcccagactaataatcagaccgacgatacgagtgggaccgtggtcccagtctgattatcagaccgacgatacgagtgggaccgtggtcccagactaataatcagaccgacgatacgagtgggaccgtggtcccagactaataatcagaccgacgatacgagtgggaccgtggtcccagtctgattatcagaccgacgatacaagtggaacagtgggcccagagagaatattcaggccagttatgctttctggcctgtaacaaaggacattaagtaaagacagataaacgtagactaaaacgtggtcgcatcagggtgctggcttttcaagttccttaagaatggcctcaattttctctatacactcagttggaacacgagacctgtccaggttaagcaccattttatcgcccttatacaatactgtcgctccaggagcaaactgatgtcgtgagcttaaactagttcttgatgcagatgacgttttaagcacagaagttaaaagagtgataacttcttcagcttcaaatatcaccccagcttttttctgctcatgaaggttagatgcctgctgcttaagtaattcctctttatctgtaaaggctttttgaagtgcatcacctgaccgggcagatagttcaccggggtgagaaaaaagagcaacaactgatttaggcaatttggcggtgttgatacagcgggtaataatcttacgtgaaatattttccgcatcagccagcgcagaaatatttccagcaaattcattctgcaatcggcttgcataacgctgaccacgttcataagcacttgttgggcgataatcgttacccaatctggataatgcagccatctgctcatcatccagctcgccaaccagaacacgataatcactttcggtaagtgcagcagctttacgacggcgactcccatcggcaatttctatgacaccagatactcttcgaccgaacgccggtgtctgttgaccagtcagtagaaaagaagggatgagatcatccagtgcgtcctcagtaagcagctcctggtcacgttcattacctgaccatacccgagaggtcttctcaacactatcaccccggagcacttcaagagtaaacttcacatcccgaccacatacaggcaaagtaatggcattaccgcgagccattactcctacgcgcgcaattaacgaatccaccatcggggcagctggtgtcgataacgaagtatcttcaccggttgagtattgagcgtatgttttggaataacaggcgcacgcttcattatctaatctcccagcgtggtttaatcagacgatcgaaaatttcattgcagacaggttcccaaatagaaagagcatttctccaggcaccagttgaagagcgttgatcaatggcctgttcaaaaacagttctcatccggatctgacctttaccaacttcatccgtttcacgtacaacattttttagaaccatgcttccccaggcatcccgaatttgctcctccatccacggggactgagagccattactattgctgtatttggtaagcaaaatacgtacatcaggctcgaaccctttaagatcaacgttcttgagcagatcacgaagcatatcgaaaaactgcagtgcggaggtgtagtcaaacaactcagcaggcgtgggaacaatcagcacatcagcagcacatacgacattaatcgtgccgatacccaggttaggcgcgctgtcaataactatgacatcatagtcatgagcaacagtttcaatggccagtcggagcatcaggtgtggatcggtgggcagtttaccttcatcaaatttgcccattaactcagtttcaatacggtgcagagccagacaggaaggaataatgtcaagccccggccagcaagtgggctttattgcataagtgacatcgtccttttccccaagatagaaaggcaggagagtgtcttctgcatgaatatgaagatctggtacccatccgtgatacattgaggctgttccctgggggtcgttaccttccacgagcaaaacacgtagccccttcagagccagatcctgagcaagatgaacagaaactgaggttttgtaaacgccacctttatgggcagcaaccccgatcaccggtggaaatacgtcttcagcacgtcgcaatcgcgtaccaaacacatcacgcatatgattaatttgttcaattgtataaccaacacgttgctcaacccgtcctcgaatttccatatccgggtgcggtagtcgccctgctttctcggcatctctgatagcctgagaagaaaccccaactaaataccgctgcttcnnnnnnnnnnnnnnnnnnnnnnnnnnnnnnnnnnnnnnnnnnnnnnnnnngctatagtacaaggcgaaaattatatgttcggacattgttttcgaatattttgtatctatcaaagctcttataaacaagatagggtattcctacatagctggtgggacccacggcaaatggatcataaagtcttaaaaaaagaatagatacgattgcattgcatgtagtaacagatgcgatcataccagcactaatgcaccggatcccattagaactccgcagttaagcgtgcttgggcgagagtagtactaggatgggtgacctcgaagaatgtcctcgtgttgcatccctcttttttttcggtttttctctttttttgttttgttaaaaatgtatgactttataacttttagaccgtgaggccaaacttggcatgccataccttttcggaaagcccaaagagagctctccaattaatgaggaaggaaaatggaattcttctattgttttttttttctactccaaattttgaccttaatgtactttttcgtgccttttcgtgatctttgctatagtacggggtgaaaattatatgttcggacattgttttcgaatattttgcatgtatcaaagctctaataaacaagatagggtattcctacatagctagtgagacccacgacaaatggatcataaagtcttaaaaaagaatagatacgattgcattgcatgtattaacggatgcgattataccagcattaatgcaccggatcccatcagaaatctgcagttaagcgtgcttgggcgagagttgtactaggatgggtgacctccaggaaagtcctcgtgttgcattcctcttttttttctcggtttttctcttttctgttttgttaaaagtatatgactctataacttttagaccgtgaggccaaacttggcatgtgatacctcttcggaaagcccaaagagagctctccaactaatgaggaaggaaaatggaattctcctattaatttttttttctactccaaattttgaccttaatgtactttttcgggccttttaatgatctttgctatagtacggggcgaaaattatatgttcggacattgttttcgaatattttgcatgtatcaaagctcttattaacaagatagggtgttcctacatagctaatgggacccacggcaaatggatcataaagtcttcaaaaaagaatagatataattgcattgcatgtagtaacagctacgatcataccagcactaatgaacyggatcccatcagaactctacagttaagcgtgcttgggcgagagttgtactaggatgagtgagctccaggaaagtcctcgtgttgcatccctctttttttcggtttttctctttttttatgttaaaaataaatgactctataacttttggaccgtgaggccaaacttggcatgtgatacctttttggaaagcccaaagagagctctccaattaatgaggaaggaaaatgaaattcttctattgtttttttttctacgccaaattttgaccttaatgtaattttttgggcctttycgtgttttttgctttattacggggcamaaattatatgttcggccattgttttcgaatattttacatgtatcaaagctcttataaacaagatagggtattcctacatatctggtgggacccacagcaaatggatcataaagtcttcaaaaaagaatagatacgattgcattgcatatagtaacagatgcgatcataccagcactaatgcaccggatcccatcaaaactccacagttaagcgtgcttgggcgagagtagtatgaggatgggtgacctcccggaaagtcctactgttgcagccctcttttttcggtttttctctattttgttttgttaaaaatgtataactctataactttaagaccgtgaggccaaccttgacatgtgataccttttcggaaagcctaaagagagctctccgatgaaagaggaaggaaaatggaattcttctattttttttttttcttctccaaattttgaccttaatgtactttttcgagccttttcgtgatctttgctatattacggggcaaaattatatgttcgaacattgttttcgaatattttgtatctatcaaagctcttataaacaagatagggtattcctacatagctggtgggacccatggcaaatgaatcataaagtcttcaaaaaggaatagatacgattgcattgcatgtagtaacagatgggatcataccagcactaatgcaccggatcccatcagaactccgcagttaagcgtgcttgggcgagagtagtactaggatgggtgacctcgaggaatgtcctcgtgttgcatccctctttttttttcggtttttctctttttttgttttgttaaaaatgtatgactttataacttttagaccgtgaggccaaacttggcatgccataccttttcggaaagcccaaagagagttctccaatgaatgaggaaggaaaatggaattcttctattgttttttttctactccaaattttgaccttaatgtcttttttcgggccttttcttgatctttgctatattacgaggcgaaaaattatatgtttggacattgttttcgaatattttgcatgtatcaaagctcttataaacaagatagggtattcctacatagctggtgggacccacgacaaatagatcataaagtattcaaaaaagaatagatacgattgcaatgcatgtagtaacggatgctatcatactagcactaatgcaccggatcccatcagaactccgcagttaagcgtgcttgggcgagagtagtatgaggatgggtgacctcccggaaagtcctcatgttgcatccctctttttttcggtttttctctattttgtattgttaaagatgtatgactctatacctttaagaccgtgaggccaaacttgacatgtgataccatttcggaaatcccaaagagagctctnnnnnnnnnnnnnnnnnnnnnnnnnnnnnnnnnnnnnnnnnnnnnnnnnnctgtgcaatggcgatagcattcgtcatttcatgaccagcgtttatgcactggttaagtgtttccatgagtttcattctgaacatcctttaatcattgctttgcgtttttttattaaatcttgcaatttactgcaaagcaacaacaaaatcgcaaagtcatcaaaaaaccgcaaagttgtttaaaataagagcaacactacaaaaggagataagaagagcacatacctcagtcacttattatcactagcgctcgccgcagccgtgtaaccgagcatagcgagcgaactggcgaggaagcaaagaagaactgttctgtcagatagctcttacgctcagcgcaagaagaaatatccaccgtgggaaaaactccaggtagaggtacacacgcggatagccaattcagagtaataaactgtgataatcaaccctcatcaatgatgacgaactaacccccgatatcaggtcacatgacgaagggaaagagaaggaaatcaactgtgacaaactgccctcaaatttggcttccttaaaaattacagttcaaaaagtatgagaaaatccatgcaggctgaaggaaacagcaaaactgtgacaaattaccctcagtaggtcagaacaaatgtgacgaaccaccctcaaatctgtgacagataaccctcagactatcctgtcgtcatggaagtgatatcgcggaaggaaaatacgatatgagtcgtctggcggcctttctttttctcaatgtatgagaggcgcattggagttctgctgttgatctcattaacacagacctgcaggaagcggcggcggaagtcaggcatacgctggtaactttgaggcagctggtaacgctctatgatccagtcgattttcagagagacgatgcctgagccatccggcttacgatactgacacagggattcgtataaacgcatggcatacggattggtgatttcttttgtttcactaagccgaaactgcgtaaaccggttctgtaacccgataaagaagggaatgagatatgggttgatatgtacactgtaaagccctctggatggactgtgcgcacgtttgataaaccaaggaaaagattcatagcctttttcatcgccggcatcctcttcagggcgataaaaaaccacttccttccccgcgaaactcttcaatgcctgccgtatatccttactggcttccgcagaggtcaatccgaatatttcagcatatttagcaacatggatctcgcagataccgtcatgttcctgtagggtgccatcagattttctgatctggtcaacgaacagatacagcatacgtttttgatcccgggagagactatatgccgcctcagtgaggtcgtttgactggacgattcgcgggctatttttacgtttcttgtgattgataaccgctgtttccgccatgacagatccatgtgaagtgtgacaagtttttagattgtcacactaaataaaaaagagtcaataagcagggataactttgtgaaaaaacagcttcttctgagggcaatttgtcacagggttaagggcaatttgtcacagacaggactgtcatttgagggtgatttgtcacactgaaagggcaatttgtcacaacaccttctctagaaccagcatggataaaggcctacaaggcgctctaaaaaagaagatctaaaaactataaaaaaaataattataaaaatatccccgtggataagtggataaccccaagggaagttttttcaggcatcgtgtgtaagcagaatatataagtgctgttccctggtgcttcctcgctcactcgagggcttcgccctgtcgctcgactgcggcgagcactactggctgtaaaaggacagaccacatcatggttctgtgttcattaggttgttctgtccattgctgacataatccgctccacttcaacgtaacaccgcacgaagatttctattgttcctgaaggcatattcaaatcgttttcgttaccgcttgcaggcatcatgacagaacactacttcctataaacgctacacaggctcctgagattaataatgcggatctctacgataatgggagattttcccgactgtttcgttcgcttctcagtggataacagccagcttctctgtttaacagacaaaaacagcatatccactcagttccacatttccatataaaggccaaggcatttattctcaggataattgtttcagcatcgcaaccgcatcagactccggcatcgcaaactgcacccggtgccgggcagccacatccagcgcaaaaaccttcgtgtagacttccgttgaactgatggacttatgtcccatcaggctttgcagaactttcagcggtataccggcatacagcatgtgcatcgcataggaatggcggaacgtatgtggtgtgaccggaacagagaacgtcacaccgtcagcagcagcggcggcaaccgcctccccaatccaggtcctgaccgttctgtccgtcacttcccagatccgcgctttctctgtccttcctgtgcgacggttacgccgctccatgagcttatcgcgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacatgagaattggtcgacggcccgggcggccgcaaggggttcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagcttttataaacaagatagggttttcctacatagctagtaggacccacggcaaatggatcataaagtcttcaaaaaataatagatacgattgcattgcatgtagtaacagatgcgatcataccagcattaatgtaccggatcccatcacaactctgcagttaagagtgcttgggcgatagtagtactaggatgggggacctctcgggaagtctcgtgttgcaaccctctttttttcgggttttctttatttgtttcgttaaaaatgtatgactctataaattttagaccgtgaggccaaacttgacatgtgataccttttcggaaagcccaaagagagctcttcaatgaatgaggaaagacaatggaaatcttctattagttttttttctacccgaaattttgaccttaatgtactttttcgggccttttcgtgatctttgctatattacgaggcgaaaattatatgttcggacattgtttttcaatattttgcatataacaaagctcttataaacaagatagggtattcctacatagctggtgggacccacggcaaatggatcataaagtcttcaaaaaagaatagatacgattgcattgcatgtagtaacagatgctaccataccagcactaatgcaccggatcccatcagaactccgcagttaagcgtgcttgggagagagtagtactaggatgggtgacctctcggaatgtcctcgttttgtaaccctctttttcggtttttctctatttttttgttaaaaatgtatgactctataaattttagaccgtgaggccaaacttagcatgtgataccttctcgggaatcccatagagagttctccaatgaatgagcaaagacaatggaattcttttattggtttttttctactctaaattttgaccttaatgtactttttcaggccttttcgtgatctttgctatattacggggcgaaaattatatgttcggacattgttttcgaatattttgcatgtatcaaaactcttataaacaagatagggtattcgaacatagctggtgggacccacggcaaatggatcataaagtcttcaaaaaagaatagatacgattgcattggatgtagcaacagatgcattcataccagcattaatgcaccggatcccatcagaaatctgcagttaagcgtgcttgggcgagagtagtactacgataggtgacctctcgaaaagttctcgtgtttcatccctctttttttttttttggattttgtctattttttttgttaaaaatgaatgactttataacttttagaccgtgatgccaaacttggcatgtgatacatttttggaaagcccaaagagagctttccgatgaatgaggaagcacaatggaattctaccagtgtttttttttctactccaaattttgaccttaatgtactttttcgagccttttcgtgatcttcgctatattacggttcgaaaattatatgttcggacattttttcgaatattttgtatctatcaaagctcttataaacaagataggatattcctacatagttggtgggacccacggccaatggataataaagtcttcaaaaaaaaatagatacgattgcattgcatgtagtaacatatgcgatcatatcagcattaatgcaccgtatcccatcagaactctaaagttaagcgttcttgggcgagagtagtactaggatgggtgacctcccggaatgtccacgtgttgcatccctctttttccagtttttctctttttttttgttaaaaatgtatgactctataacttttagaccgtgaggccaaacttagcatgccataccttttcggaaagcccaaagagagcactccgatgaatgaggaaggaaaatgaattcttctattgtttttttttctaccccaaattttgaccttaatgtactttttcgggccttttcgtgatctttgctatattacagggcraaaattatatgttcggacattgttttcaaawattttgcatgtatcaaagctcttataaagaagatagggtattcctacatagctggtgggacccacggcaaatggatcataaagtcttcaaaaaakaatagatacgattgcaatgcatgtagtaacagatgctttcatactagcactaatgcaccggatcccatcagaactacgtagttaagcgtgcttgggcgagagtagtacgaggatgggtgacctcgaggaatgtcctcgtattgcatctctctttttttcggtttttctcttttttgttttgctaaaaatgtatgactctataacttttagaccgtgaggccaaacttagcatgccataccttttcggaatgcccaaagagagcactccgatgaatgaggaaggaaaatggaattcttctattattttttttttctactcgaaattttgacctcaatgtactttttcgggccttttcgtgatctttgctatagtactgggcggaaactatatgttcagacactgttttcgaatatttaggatatatcaaagctcttctaaacaagatagggtattcctacatagctggtgggacccacagcaaatggatcataaagtctacaaaaaagaatagatacgattgcattgcatgtagtaacggatgcgatcataccatcattaatgcaccggatcccatcagaactctaaagttaagcgtgtttgggcgagagtagtactaggatgggtgaccactcggaatgtcctcgtgttgcatccctctttttcggtttttctctttttttttgttaaaaatgtatgactctataaattctagaccgtgaggccaaacttagcatgtgatacctttccggaaagctcaaagatagctctccgatgaaagaggaaggaaaatggaattcttctattgtttttttttctactccaaattttgaccttagtgtactttttcgagccttttcgtgatctttgctatattacggggcgaaaattttatgttcggacattgttttcaaatattttgtatcaatcaaagctcttataaacaagatagggtattcctacatagctggtgggacacacgacaaatggatcataaagtcttcaaaaaagaatagatacgattgcattgcatgtagtaacagatgcgatcatactagcattaatgcaccggatcccatcagaactctaaaggtaagcgttcttgggcgagagtagtactaggatgggtgacctcccggaacgtccacgtgttgcatccctatttttccggtttttctctttttttttttgttacaaatgtatgactctataacttttagaccgtgaggccaaacttagcatgccataccttttcggaaagcccaaagagagcactccgatgaatgaggaaggaaaatgaattcttctattgtttttttttctactccaaattttgaccttaatgtacttttcgggccttttcgtgatctttgctatattacagggcaaaaattatatgttcggacattgttttcaaatattttgcatgtatcaaagctcttataaacaagatagggtattcctacatagctggtgggacccacgacaaatggatcataaagtcttcaaaaaagaatagatacgattgcaatgcatgtagtaacatatgctttcatactagcactaatgcaccggatcccatcagaactccgcagttaagcgtgcttgggcgagagtagtacgaggatgggtgaccttgaggaatgtcctcgtattgcatccctctttttttcggtttttcacttttttgttttgctaaaaatgtatgactctataacttttagaccgtggagccaaacttagcatgccataccttttcggaatgcccaaagagagtaatctgatgaatgaggaaggaaaatggaattcttctattgttttttttttctactccaaattttgacctcaatgtactttttcgggccttttcgtgatctttgctatagtacagggcggaaattatatgttcggacattgttttcgaatattttgcatatatcaaagctcttctaaacaagatagggtattcctacatagctggtgggacccacggcaaatggatcataaagtcttcaaaaaagaatagatacgattgcattgcatgtagtaacggatgcgatcataccagcattaatgcaccggatcccatcagaactccgcagttaagcgtgcttgggcgagagtagtactaggatgggtgacctcgaggaatgtcctcgtattgcatccctcttttttttcggtttttctcttttttgttttgctaaaaatgtatgactctataaattttagaccgtgaggccaaacttggcatgccataccttttcggaaagcctaatgagagctctccgatgaatgaagaaggaaaatggaattcttctattgtttttttttctactcccaattttgaccttaatgtattttttcgggcctttttgtgatctttgctatattacgaggggaaaattatatgttcggacattgttttccaatattttgcatgtatcaaagctcttataaacaagataaggtattcctacaaaggtggtaggacccacggcaaatggatcataaagtcttcaaaaaagaatagatacgattgcattggatgtagtaatagatgcgatcataccagcactaatgcatcggatcccatcagaactctgcagttaagcgtgcttggacaagagtagtactaggatgggtgacctccaggaatgtcctcgtgttgcatccctcttttttttcggtttttctcttcttctttttttgttaaaaatgtatgactctttaacttttagaccttgaggccaaacttggcatgtgataccttttaggnnnnnnnnnnnnnnnnnnnnnnnnnnnnnnnnnnnnnnnnnnnnnnnnnnttgttttccaatattttgcatgtatcaaagctcttataaacaagataaggtattcctacaaaggtggtaggacccacggcaaatggatcataaagtcttcaaaaaagaatagatacgattgcattggatgtagtaatagatgcgatcataccagcactaatgcatcggatcccatcagaactctgcagttaagcgtgcttggacaagagtagtactaggatgggtgacctccaggaatgtcctcgtgttgcatccctcttttttttcggtttttctcttcttctttttttgttaaaaatgtatgactctttaacttttagaccttgaggccaaacttggcatgtgataccttttaggaaagcccaaagagagctctccgatgaatgaggaaggaaaatggaattcttctattgtttttttttctactccaaattttgaccttaatgtactctttcgagccttttcgtgatctttgctatattacggggcgaaaattatatgttcggacattgttttcgaatatttagcatgtatcaaagctcttataaacaagatagggtattcctacatgataacagaaatgatgaaagacctagacgaaaactgaatatcaaatacttgaaaagtgcaaaaatacaaagtcgcaagagaaacatcgtggctatcaaagttgcgaaatgtaaaagcgagataaataacagatgccctcgggaaaaccctaagaggcagtttatataagcgagaaatgaaacaaataaggaaactaaatatatagtgaatcttcacgtcatgatcctgcgaccgaatgtgtcattagcatctaacgggctgaaatgagctttccagtgatcgagtatgtcattgatcaaactgggcttcaggggcttcgtcttgcgatcgagcgagatgtagtgatgtcgagattgaatggtccagcgaccctttgatcgagtgcgatcgagtggatgtcatgaggtggtgatcgagtggtttcttcggcttctcttctcttctttgttctcagcttgtctggttgagagcagaacgagcaggtaggcttcctggtggtcgagtggtgatcgagtggttctgatggggtgattcctccgccttcgcgattgagtgaaactgagctgcttgcttctccggggttgcgatagagtgatttgccctggcagggctccaaggctgcgatagagtacttttgctgaaggcgtcattgggcattctgacttcatgttctgtttttcctctgtttgaactccaaaagcatccaaagtacctgaaaacaaccaaatatgccatgcacatgcaatcctaatgcaaaatcgtcctaagtatgtaaaacacactaaaacgactcctaatgagatgaaatgtggatgaaacaatgacaaagtggtgaagaatgaatgcctaaatcatgcaaattatagacatatcaactcccccaaacttagtctttgcttgccctcaagcaaacaaaaagacataagcggaaggagaggtttgaagttggggattcagaaccaaagcatgagatatgacaattaagatcaatgtaccagccaacagttctaagatgcgaggtgatcgaattctacttaaaaactttagccatgctctgttatgatccaaacctacactcaaatgcacaatgcttcaagatcaaccaatccctttaacattcattaagttcaaaaatatgaatcaagatatgcatcgctagtgaactcatttggctaatgacaggttatgagacaaagatggtccctttttagtggttcagattttaatagcaggggactctcaatgaaaaatgactgagctttagaagaatgctaaatgtaagtgccaacctatgcatacaagaatagcaccccatctacccaattacataaaccgtgaataacaagtagatggtcctatctctaaacccaatgatgatcctaagtctacccttttgcactaaaggcatatttcgatttttccttggatcaatgtttccttttcttttctttggctcttgttcttaaggagaagtttttcttaaactctatgagtctagtctagtgaattggttttttcttaaactcttatggctctaatcattttttttttttttctgttattgttgccatctatttttttagagtatatcttaacaattctatgcttcccaaacattcactagaccacaatatgatttttagcttccttctcctaaagactctaacccatttttttttctttctttttcttttcacactcaatctcaatccccaaataagttcccacctaatcctaccaagtccaaaaacgcggattggaactacatgagatactactcttgtcggctcaaacctaacacgttctaccaagctcaatcctgaaaataggcctcacatgctctcacaaaataacatggcttgaaagaagggttagttaagggtgggggaactactccaataatagaagcagctacttggattaacaagagtggtgaataagtgaaagaaaatccaaatatgtattctatccacgagttcaaaaacgatgcaaatatgattattataagtcagattcaagttcaaattgacagggaaaggtgtcatgacatgcatcgagtggtttctatagaacatggtgtggttttacttcaaagtcattcaaatgcctcaaagaactaataactcattttagtgaatcatcatgcttacaaggctatttcctcattatcccctatgcatatgcaacaatcctatatgaaacactctagactcgattctaaatgtaatgcaactaaatgatcactctgtttttgtgggattcattttcaaaaattgtcaaaaatttttgtttttttctatgacttagatgatatgcagactcaaatgatattcacaaaaaacaagtcaaatacgtcttgaaccctcccccaaacttaaattacacagtcccttgtgcaataaaaatttgtgaaagaattcaagataaacacaaaaacaaaaacaaaaggggtatttacaaaggattttggtgtgttaccttagtataatgtcctggagatgtagtcatccatatctgcttgagtgtactcagcaggcatgaccagttcttgatgtggctccgccatctcctcgtcattgtgcttgatcgcaaccccagcaggttgtgcatcacgacgctcaggtgttctccgacccttgcttgatgatcggaccatcctagcgctcttccgcctcttgtgctccctaacctcgtgagacgagtgtcgtgcgggttcttgcggtacagtgtgttctctctgttgataagcagattgccttggcggggcaatgtcatgacgcctggatggcatgtcttccggcggattgtctctggtgattgcactggtggatgtggtgcaactgattgccttctgcatgttgtcaatggccttgacacacttatgaatgatcttgtcttgaaacttgcaccacctttgggttagactgagcttctagtgtgcttcagcgagactcttgctttctcatgaagggggcttgtgttcttcaaagtggtaatggctcgtgtcatagttcttccagttggtctcctcattgtcactctgaccctctacttcttcaacattacgggacgcggatcctccaatcatagcatggaggatttcttgtggtggcgagaagtcgatgttgtctctcaccgtgatggttgtcatttcactgaatcggagaagaatagtggcttctcctattgacgggtgatcaaacttgaaagcgtacctcccatcatagaccttatgctcgatcacatgggcaagcttgagatgggcgatatccatccaacgtggttggatcggatctagtcgcagcgggacatcgcacgataggaggattggtgtgaccactcctccaatgcaaagggctcctttcgctttcttcttgtcattggccagcgcccaccctctgtagctgcataagtgattgagaagatacattgacagaggtgtgtcattggtatctcccttcatcgttttcccgtccttggtgcaacggaggaaacttagcagcgccaggttgtcttcgttcgttacagtggcggatatctccctagcgtaagggacattggccatggctctctggaaatagcgaatggcgggattgcgaatggagttgctcttggatctagcggagttgaagctagtggtgtctccgatcgtgttccacaaagattttaattcttctcgagcaaacttcggtttcgttcctgtgccactgggaaacccgaacatggattcaagcattttgatcgccatgatatagtcgcgctcgtcgatagtgaagcttaagtaaccaagcccttcttcccttaactcagcagctgacaacccctcaaacaattccacttgaagtgatgaaaggaattgaagtgtctcatcctcataggtaggatagggatgagacatgagtgttgtcatgtggcatttctcgaacaagagctgaacgtctaccagaatgcctaactccaccattgtctccgggtgaggatatcttgttccccaaaacggatttcttttgagaaccttgtagtagtctcccggggccagcttgtcttctttcatcaaggacttggtggtcttgcgggtttgctccggaatgtactccgcatcatcttccatctcttcatcaaccaactcatggttctctgtcattgctcgttttcctctggaaatctcttcccttctcctgtcattggcgactgctcgctctgtttcctccacaaatcgcctatactcctctgcttctctctctggcctagttgaccaagattcagcctcatcaacattgtagtcggcatccatagatgattcgtagctgtgtgaactcatcttgaagctgaaatcgatttgaaactcacaactaaagctcagtaggttagtgagaaacaaacaaaaacaatgaaagaaatgacttcctgttgatatagagttgcgatcgagtagaatttgatagtgagagcttaggtcgcgatcgagtgaagcaagcaaatgagagacagggttgcgatagagtagtttctaaggttctgttttagtcaataaaagctagcaacaacgaaagagttgagagcgtttttggtagtgaagtagagagataaacaagagagatgttttgaaatcacaagtgatgaagaaaagtgaagagtagtgacacttatctccctttgcgatttgaatgagtggaggaggtgtgttgcttttaaacggaagcgtagaaaattgtgacactttctagactagaaaagtgaagagtagtgacactttcactcctctttgcgatctagtagaaaattgttatcccgaaactgctagatcgcactcctgagctttcactcctatgttgtgatcgagaatttgaaaattttttataaaattttcatttgaacactcgatcacatccttgttgatcactccagctgttattcatttcctgagaatcaaagacacaaccaaaacgaatcaaaagtaacaaataaataaatagtatatacagggatagtcatgggacttcctcccaagtgagcttgtttagagtctctagcttgactcctcacactaatcaagtggagaaaatgtgacagagggaacttgagaagtcctcctcttcactgatatcatcatcatactcagcatcctctcttgacagttgcacagctgagtattcaattcttctttcctcatagtaggctgcttcctcctctggaggatagttgatagtaggtttttactcaattatcctaaaacactatctttccgttgtagacagatgagatatgatcagaagttgctaagtcaagcccagcagaatttgtttggttttctaacagtcctaaagttgatgcagaaaacagtaaaaaatcacagaaatgactgatataccctatcacagggtcgactgccaaaagggaccctgtgatcgagtacaacaggatgacagagtgtgaaaatgcagaaatggaccagtttactctatcacgcagtctcactgttagtagactggtatgatcgagaagaatggttgaaaacagaaaaatactaaaattcaatagcaagtgaatgaagcaggtaagtaaacagagaaatcaaatggatgagaaattcctaaggatggggtaatcgaatagtgtgatctccctaatcaattcagttggttaacaaatctcaatgaagctatccttagacaacaggttcaacaacagattaattaactcccgtgatagaaatcctcaagcatagctagacacatacctaattcccattagcgatctctaactaaggaggcaataagaatcgactgttaaagccaataaccgctctaaacggccaatcctttgggatagagacgattatcactggaattagtagatccaacgttccattaaacgccttctggacgttggaacgtctgggatcggattccagttgatcagaaaggaataagcagtaaacacaactaatcaagaagggattcaataaatctacacttaaccaacatattcgaccaggggttccacaactactctatcccatcctcagaaatcctaatcactactcagacaacatgcttaaagacaataacatagaaacgaaagatggacaagcaaatgaaagcaaaatctgaataacttagaagaaaaatcgaaatacacagttgcaggaatgaaaagcggctgctgaataatagtgcgaaattcgtgtctaaaaagtgcatgtctcagggcgaaacccttagagacttatttatactaagataagaaagcgggcttcgagcccacttaacggcccatggacggtgtgatcaagagtgtcggctcaaagtgggcttcctgatgggcttcgaatgggcttcgaatgggccttctcttctcttctctttccgatgctaaggttgtctggttgagtgcggattgatcagagggtcgaggtggtggtcgagtaggttggttgacagaatggtctgggctgcttcttggcctctgtgatcgagtaagtgtgtcagctatcaggatggactggttcttctcctctgcgatcgagtataactggtggactggcaaagtggactgcctggtcgcctctgcgatagagtagaactgtagaatggactgcctcctctcctctgcggtcgagtatatctggcagaatggactgcctggtctcctctacgatcgagtagaattgtctggatggactgctgagctgactgcttccctctctgctactagtgatcgagtatgttggtggaagtgtgacttcttgttctgtttttcctctttctgagcaccaatagctccaaaacacctgaaacaactccagaatgcagaatgtatgcaagactagtcctagactctactaaagatgcaaaatgtacaaaaataatggtaaatgctatgaaagatggatgaaactagactcaaaatcatatatatgaaagttggccaactctctccatatgattgacacatcatcactttaacatttgccatgtgtccactgaataattaatgtaagctcttcaacttttaatttatagattaatgatgtatttattatttaattttacatatttaattgtactaatactaaatttattttgttattaaatgtttttcaataaaataatttgattggttttctcatactcaaaagatttttttctataatcttaactcaaattatgagtgtatagtagtcatggattaattaatagtttgaatagtttgcatattgttatatatctatataataaatcgccgagggtgaagagtatgtaagaagtttaatcatcaaattcttaggtttcgagaatcccaatattaccctctatttaattagtttaagacgaacattgtttaggaattgtgtgtataatgcattgttgagaatgttgttagaaaaaatatattttaatactaagaataattacttattatataagtaaatgattagataattaaaaattatatttaaattaaacgatacaaaaaatttgaaaataccgcagcgtagcgcgggtgattacctagtggtgataaaaggatgtgtaaaacatgcaaattatagacatatcaactcccccaaacttagtctttgcttgccctcaagcaaacaagtagacataagctgaaggagaggtttgaaggtggggattcagaaccaaagcatcagataaatcagatagaatcaatgttcaagttggcagttctaggatgcgatattatcgaactctactcaaaaacgttagccatgccttattatagttcaatcccactcttatactcgacctacacatgctttcaaatctaccaatccctttaacattcattagtttaggaacgtgaatcaagctatgcatcatcaatgaactcatttggctaagatgaaggtcaggagacaaagatggtccctttctggtggttcaagtttagtaacaggggactctcaaaagaaatggactgagctttaggagaatgctaaaggtaagagccaacctatgcatacaagaatagtatcccatctacccaaaaacatagacactgtatacaccagcagatggtactaccatcaagcccagaatatgatcctagttctaccctttgcactcaaggcatttttttttttctcattcttatcttggatcaaaccactctttcttttctttgactcttattctaaggagaagtttcttttactttgatggatctagtggactttggttttcgttgacaactatggcttttgttatcttcttgtgatcaagacttttctagactttcctatattttttttagttccccaaaatccattactagactaaattgtttctcaacttccttctcctaagaacatcaacatttcctttccctcttattttctcatatactcgatccccacttcaagaatagacacccacctagtcctatctagcccagaaaacgtgggctagaactacatgagacactactcttgtcggctcaaacctaacactttcttccaagctcaatcctgaaacaggcctcacgatcgcacacgatatataacagggctcgaaagaaaggtttggttaagggcaagggaaattacttcaatgatggaagcaactacttgggttagcaagggtggtgaaaagtttaaagaaaacccaagtatgtatatggtatccatgagttcaaattcgatgctaagacatgataattgcaagtcagattcaggttcaaattgatagggaatggtatcagataataacagtgtgatcgagtagagcattcaagacatggtgcagttttacttcaatttcattgactacacatcaaacaactagcaacgatgaacaaaaatgcttacaaggctatctcatcataatccccaatgcatatgcgacaatcctatatgaaacatcctagactcaatcctaaatgtgatgcaactatatgaacactctgtttttgtggaatacattttcagaaattttttcaattttttttttttttttctatgtcttagatgaagttaagactcaaatgatgcaaataagactcactagcaaacatgttaaatacttcttgaatcctcccccaaacttaaactacacagtcccttgtgtaatagaagtctaaagaagagttcaagagacactaaaacaaaacgaaaacagaaaatggtatatacaattatggttgtgtgtggtaccttagttaaaggcacaggagatgtagtcgtccatctcctctctggtgtaatcccatggaatactgggaacttgttgttgttcctcatcctctggtgcgggatactcgatcgcagggttcacaggacgtttggtccggcggtcgagtatattggtctgagaaatggactaaagtgtcgccttggtgatcgagtgaaaacgggcagttgggatgcctccatggtcgagtaaacttggtgacctgtagatgttaactcggcttggtggtcgagtaaactcatttaaatgcggaggttaactctgcttgatgatcgagtatgtggtgatgcatttgaatttttgtgagtgaaaccagacggtactcgaccttcttactcgatcacaaggtcaccaggtgcaacagaaaattttcaaatttttgcactcctctggactggtatactcgatccccatgctcttggtggagtaaaatttctgaatttttactctatctccaggttacttcttcattcctgaaaaccagaaacacaacaaaaacaaatcaaaaataacaagaaagaaaaattatatacaaggataatcatgggacttcctcccaagtgagcttgttttaagtctctagcttgactcctcacactcattaggcttaaggagggtgatagagaggaattgaaatctgctcttcttcctcaatggatacagcaatgtactcaacatgctctcttgacaggtttgtagttgagtactcaatgtcccttttcttgtaagtttccttttgatcatctcgatagtcgtcttctctagaccgttcgaatgtgaattcacatccttctttgctaaccaaagcaattacttcatcatttgggacatccttgatgtcgagtggcgcttcgtaggcttttccatgaagctctttgatttgattcttcagctctctcaccgtgtgtgttaactctcttatagttttgtcctgccatatagacttctccttgagtactaaccaatcatttgattgcaaaatgcgtgactggagctgtttggtggaacatgacttctctggacaagttgaaaggttactcaagttgacggtcgagcatagtggtcgagtatgagttgagatttccttgttcaatgccctaacctctgttttcgatccaaagaactttgttcctactattgccttgtgtgagtctaatgacttatcatagctcaaagtctcactagggagatgtctagcttcaccactcctagtcaaagcagtttcaacctgatctttagaagcaggctcttctaatagttccttagctagctgacccttttcatcaactaagaaggtatggccgtctattgttggtttcttcatatcatctttgatgtcaaacttcattttaaaatcctttcccaaattaagatctatctttccttgcttaacatcaatgactgctccaactgtggccaagaagggtcttcccaagatcagaggatctttaggttcttcatccatctcgagcacaataaagtctgtaggcacttctactccattaatcttgataggcagatcttcgagcatgccataaggttttcttaaggtcctatcagcaaggatcaaggataggtcacatggcttatattgcacgaatcccagcttccttgtgatggtgagtggcattaagctgactgaggcccctaaatcacatagacaattgctgaaagctaaatcacataaagctgaccaggtggtggttgttgttgtggataacatccctggaactgctgctttggaacaaacccttgaccttggttgtaaggaacaaacggtttgggttgttgttgtggttgctggtgtggataaacttggtcttgtggattgcctacattggtgcttctgtatgatagatttgggttggatctgtaattgttgtactctttgttggagacaccttggttttgcacatagctaacttcttcagactgcagagtctccccatcctgaacttggaacgtctcatcgtcacctagaaaatgaatgtgcttctgttgcacaaggagtaacttgtccagcttttcattcaaagctttcatatccctacggtgcttctcatcagaatcagagctggagcggatgcttctatcgtactcttcattgtaattgccatccgactgtgccaaattctctaccagctcccatccttcttcaacgtccttgttgaggaagttcccgttggaagcggtatcaagaagcatcctgatcttgggaaggacacctttgtagagagtgctgagaagtgaagcttttttgaacccgtgatgagggcatttggtctgatagcctttgaagcgctcccatgcttcatagaatgtttcagtattctgctgtgtgaatccggatatctcattccggagtctggcggttctagagtttgagaaaaatttagccaggaaggctttcttgcagacgtcccaggttgtgactgatccctagggtagcgtcttctcccacagatgggctttgtctccaagtgaaaacgggaacaggcgaaacttgaaaccatcttcactaactccattaaaattgtaagggtgcagagcctttcaaactcgtccaggtgatcgagtgggtcttccattggcaggccgtgaaatttgttcccctgaaccattgcaatgagaccgctcttgatctcgaaattattgttctgaaccggcgaagggacaatgccattatgaaggttatggttgtgtgggaaatcaccagcgccaatgttgttgggcaattcttgctcatctacaacgtcagccatcgtatttgtaagtgtctgttctcttagagagcgagcgatgcggtcgatgttgtcgttgaagaggaggttctgatgtccttgtgaccgtgtttgcatacaataggtatcagcacagcttgaacagaccaatcagagactggtccagggaagcttgtgaatgtgagtacctgaaacacacaaatagagaaaaagacacagagtcagtaaccttgtaacaaacgaacttgatcttaacgtttccaaaaatctcaaatatagcaaagaaacacccaattggcaacggcgccaaattgatagtaggtttttagtcaattaatcctaaagcactatcatgtcgttgtagtacttagggtgtcaatccaaatgggtgtgatgcagacatatgagatatgatcagaagttgctaagtcaagccaagcagaatttggttgattttctaacagtcctaaagttgatgcagaaaacaataaaaaatcacagaaatgactgatatactctatcacagggtcgactgccagaagggaccctgtgatcgagtacaacaggatgacagagtgtgaaaatgcagaaatggaccagtttactctatcacgcagtctcactgttagtagactggtgtgatcgagtagaatggttgaaaacagaaaaatactaaaattcaatagcaagtgaatgaagcaggtaagtaaacagagaaatcaaatggatgagaaattcctaaggatggggtaatcgaatagtgtggtctccctaatcaattcagttggttaacaaatctcaattaagctatccctagacaacaggttcaacaacagattaattaactcccgtgatagaaatcctcaaacatagctagacacagacctaattcccattagcgatctctaactaaggaggcaataagaaccgactgttaaagccaataaccgttctaaacggccaatcctttgggatagagacgattatcactagaattagtagatccaacgttccattaaacgccttctggacgctggaacgtctgggatcggattccaattgatcagaaaggaataagtagtaaacacaactaatccagaagggattcaatgaatctacacttaaccaacagattcgaccaggggttccacaactactctatcccatcctccgaaatcctaatcactactcagacaacatgcttaaagacaataacatagaaacgaaagatggacaagcaaatgaaagcaaaatctgaataacttagaagaaaaatcaaaatacacagttgcaggaatgaaaagcggctgctgaataatagtgcaaaattcgtgtctaaaaagtgcatgtctcagggcgaaacccttagagacttatttatactaagataagaaagcgggcttcgagccaacttaacggccaatggacggcgtgatcaagagtgtcggctcaaagtgggcttcctgattggctttgaatgggcttcgaatgggccttctcttctcttctctttcggatgctcaggttgtctggttgagtgcggattgatcagagggtcgaggtggtggtcgagtaggttggttgacagaatggtctgggctgctcttggcctctgtgatcgagtaagtgtgtcagctattaggatggactggttcttctcctctgcgatcgagtataactggtggactggcaaagtggactgcctggtcgcctctacgatagagtagaattgtaaaatggactgcctcctctcctctgcggtcgagtatatctggcagaatggactgcctggtctcctctacaatcgagtagaattgtctggatggactgctgagctgactgcttccctctctgctactggtgatcgagtatgttggtggaagtgtgacttcctgttctgtttttcctctttctgagcaccaatagctccaaaacatctgaaacaactccagaatgcagaatgtatgcaagactagtcctagactctactaaagatgcaaaatgtacaaaaatgatggtgaatgctatgaaagatggatgaaactagactcaaaatggtgataaaaggatgtgtaaaacatgcaaattatagacatatcaatagtctttctcttctgaccaatcccaggtgatcttctttcttgaaatcgtgtcatggttgagctggggttgaacctccttttgcattcaactttgtttgtctctaagcttttcaacattgtagctcagtttctgaatggttctgttctggagatcagtctttcttttgagtagtcgagttcgatggcggagtttgaaccaaaatttgctccttcccgcttttaatctcaaggccttcacttggaaccgctctctagatctctaaggtttttccttctgttggtgaccttgtcggaaatttgttgatgtcaaactgtaacttgacatgcctcccaaggttgagatcaatcataccatatctgacatctattactgctcccactgaggctatgaaaggtcttcctacgataaaatcagtagatacctcaactccatctaccattactggcacgttctctagaatgcagaaatgtctccttgaagttctatcagcaaggatcaaggtgatgtcacagggcttgtactgaacgaatcccagcttccttgccacaaagagtggcattaaactgactgaggctcctagatcacatagacaattgctgaaagtcaattgcctaatggaacatggcaaagtgaaagatccaggatcttccagcttctcttgaataatcctctcaccagcggcttgatgcataatgacatcgtcttcgtcatctgaatcctgatatatgttgagcctttccagtatcaggtttctcacatctttgtgagggtctgaaatcaacttgaggacttctactaagggcatcaaagcttccatctcatcaagttgtctttctgccagagattcatatatgcttttccaagctttcctgaacgtccatggaagagcaagtgagggtgatggagctggcttgaatcgttttaccatcctctcgattatagcagccttctcctccaagtcagactaagcctgatagaaaggttgagctgaatagtcgatctcagcaacagagacttcaatctgagtggaagcctccccttctagaattacactatccttagtgtttgatgtagagacatgttgagttggcagatctagctcatgtctgatagtgattgcgtgtgcagtggcatactccttagggttctggattgcttttcctggaagctggccttggttgcttgtaacaggtggtgaagtagtgatgccgtcaagatatcgtacccttgtgttcaatgattcgaacctgctactcagttcattgacgtgtctgtcaaatttgttgtttaagtcagccagcttcttagcgggttccattacccctgcggcttggccttgcatgatctgttggagcatattcttgatgtctgattcctggggtgcagaggcctgatgttgttgtggtgtgaaaccagttggtggctgttgctgttgataccctccttggaactgctgcttagggacgaacccttggctttggttgtaagtaacaaacggtttgggttggttctgctgctgctgttgagggtaaacttggtcctgaggattggcgacatttgtgcttctgtatgacagatttgggttgggtctgtaattgatgtaccctttgtcgtagccgccttggttctgaacataactgatttcagcgcactgatcattctccccctcttggatttggaatactttgtcttcagaggcgaagtgaacatgcttctgctgcacttggaggagtttgtcgattttgtcatggagagctttaatctctcagcggtgcttgtcatcagattcagtactggtgcggatgcttctgtcataatcctcgttgtaattgccatccgactgagccaagttttcaactagctcccatccgtcttcgacatcctttttcaggaaattcccgttgtaggcggtgtcaaggagcatacgtatcttaggcaggacgcctctgtaaagtgtgctgagaagagaagcttccttaaatccgtgatgagggcatttggtttgataacccttaaagcgctcccaagcttcacagaagctttcattttgcttctgagtgaatccggatatctcgttccggagtcttgcagtcctggaattggagaagaattttgccaagaaggcctttttgcagtcatcccaggtcgtgattgatccctggggtagcgtcttttcccatagatgggcttttctccaagtgaaaatggaaacaagcgaagcttgaaaccatcttcactaactccattgattttagtaaggccacagagcctttcgaactcgtcaagatgatctagcggatcctccattggcaggccatgaaacttgttcccctgaaccattgcaatgagaccgcttttgatctcaaagttgttgttctgtactggaggtggaacaattccatgacgttggttgtggttctgagggaagtcaccagcaccaatgttggtaggttgctcttgctcatctacaacgtctgccattgtatcggtttctgtctgttctttcagttggcgagcaatacggtcgatgttatcgttgaataggaggtcctgatttccttgtgaccgtgtttgcatgcaacagatagcagccgggctataacagacgaatcagagatgcgtctgtaaagcgggttgcaaggtacctgaaacacaaagacagaaaaggcacaatgttagtaacttgtgtaacaaaaacgaacttgataataacgtttctaatgatctcaaatataacaaacaaacactaaactggcaacagcgccagattgatagtaggattttagtcaattaatcctaaaacactatcctgtcgttgtagtattttaggatgtcaatccaatccggtgtgatgcaaacagatgaaatatgatcaaaaagctctaagtcaagccaagaagaaagttggttggttctaacagtcctaatatgcaataacagaaatgaaatgaaactaaaagcagaaatggcaatagcaggcaggtgaataacaaagcagaaatgataacaagcaataaaatggataaacgattcctaaggatggggtaatcgaatagtgtggtctccttaatctattcaggcggttgacaaaacttcacagaagctatccgtagacaacaagttcaacaatagattaattcactcccgtgatagaaatcctcaagcaaagctagacactgacctaaatccctttagcgatctctaactaagcaggcattatcgaatcaacatgttaaagtcaataccctctctacagccaatcccttgaggtagagtcaaatatctctggaattaataggatccaacgcccattaaatgccttttgagcgctggacgtctggactcatactccacattagccagtgaaacaagcaataagcgcaactaatccagaagggattctactattctaaactcaaccacctaaaacgaccaagtaaaccacaactaatctatcccatcctcagaaatacagttcactactcagacataatcaaagacaataacaaagcaacgattgaaaacatgataacagaaatgatgaaagacttagacgaaaactgaatatcaaatacttgaaagtgcaaaaatacaaagtcgcaagagaaacactgcggctatcaaagttgcgaaatgtaaaagcgagataaataacggatacccacgggaaaaccctaagaggcagtttatataagcgagaaattaaacaaataaggaaactaaatatatagtgaatcttcacgtcatgatcctgcgaccgaatgtatcattggcatctgacagcttaaatgagcttcccagtgatcaagtatgtcattgatcaaactgggcgtcaagggcttcgtcttgcgatcgagcaagatgcagtgaagtcgagattgaatggtccagcgaccttgtgatccagtgcgatcgagtggatgtcatgaggtggtgatcgagtgctttcttcggcttctcttctcttctttgttctcagcttgtctggttgagtgcggaacgagcagataggcttcctggtggtcgagtggtgatcgagtggttctgatggggtgattcctctggcttcgcgattgagtgaaactgagctgcttgcttctccggggttgcgatagagtgatttgccctggcagggcttcgaggctacgatagagtacttttgctgaaggcgtcattgggcattctgacttcttgttctgtttttcctctgtttgaactccaaaagcatccaaagtacctgaaaacaaccaaatatgccatgcacatgcagtcctaattgaaaatcgtcctaagtatgtaaaacacactaaaacgactcctaatgagatgaaatgtggataaaacaatgacaaagtggtgaagaatgaatgcctaaatcatgcaaattatagacacatcaaagctctctgatgaatgaggaagcacaatggaattcttctatttgtatttttctactccaaattttgaccttaatgtactttttcaggcctttttgtgatcttttctatattacggggcgaaaattatatgttcggacattgtttttgaatattttgcgttaatcaaagctcatataaacaagatagggtattcctacatagctggtggaacccacggcaaatggatcataaagtcttcaaaaaagagtagatacgattgcattgcatgtagtaacggatgcgatcataccagcattaatgcaccggatcccatcagaactctgcagttaagcgtgcttgggcgagagttgtactaggatgggtgacctccaggaaattcctcgtgttgcatccctcttttttttctcggtttttctcttttttgttttgttaaaaatatatgattctataacttttagaccgtgaggccaaacttggcatgtgataccttttcggaaagcccaaagagagctctccaattaatgaggaaggaaaatggaattcttctattgttttttttttctactccaaattttgacctacatgtactttttcgggccatttcgtgatctgtgctatattacggggcaaaaattatatgttcggacattgttttcgaatattttacatgtatcaaagctcatataaacaagatagggtactcctacatagctggtgggacccacgccaaatggatcataaagtcctcaaaaaaaaatagatacgattgcattgcatgtagtaacagatgcgatcataccagcactaatgcaccggatcccatcagaactccgtagttaagcgtacttgggcgagagtagtacgaggatgggtgacctcacggaaagtcctcgtgttgcattcctcttttttcggttttcctctattttgttttgttaaaaatgtatgactctataactttaagaccgtgaggccaaccttgacatgtgataccttttcggaaagcctaaagagagctctccgatgaaagaggaaggaaaatggaattcttctattgtttttttttcttctccaaattttgaccttaatgtactttttcgagccttttcgtgatctttgctatagtacggggcaaaaattatatgttcggacattgttttcgaatattttgtatctatcaaagctcttataaacaagatagggtattcctacatagctggtgggacccatggcaaatgaatcataaagtcttcaaaaaagaatagatacgattgcattgcatgtagtaacagatgtgatcataccagctctaatgcaccggatcccatcagaactccgaagttaagcctgattgggcgagagtagtactaagatgggtgacctcgaggaatgtcctcgtgttccatccctctttttttcggtttttctctattttgttttattaaaaatgtatgactctataactttaagaccgtgaggcaaaacttgacatgtgataccttttcggaaagcccaaagagagctctccaatgaatgaggaagtctttttctattccaaattttgaccttaatgtactttttcgagtcttttcgtgatctttgctatattacggggcgaacattatacgttcggacattgttttcgaatattttgtatctatcaaagctcttataaacaagatagggtattcctacatagctggtgggacccacggcaaatggatcataaagtcttaaaaaaagaatagatacgattgcattgcatgtagtaacagatgcgatcataccagcactaatgcaccggatcccatcagaactccgcagttaagcgtgcttgggcgagagtagtactaggatgggtgacctcgaagaatgtcctcgtgttgcatccctctttttttcggtttttctctttttttgttttgttaaaaatgtatgactttataacttttagaccgtgaggccaaacttggcatgccataccttttcggaaagcccaaagagagctctccaattaatgaggaaggaaaatggaattcttctattgttttttttttctactccaaattttgaccttaatgtactttttcgtgccttttcgtgatctttgctatagtacggggtgaaaattatatgttcggacattgttttcgaatattttgcatgtatcaaagctctaataaacaagatagggtattcctacatagctagtgggacccacgacaaatggatcataaagtcttaaaaaagaatagatacgattgcattgcatgtattaacggatgcgattataccagcattaatgcactggatcccatcagaaatctgtagttaagcgtgcttgggcgagagttgtactaggatgggtgacctccaggaaagtcctcgtgttgcattccccttttttttctcggtttttctcttttttgttttgttaaaagtatatgactctataacttttagaccgtgaggccaaacttggcatgtgataccttttcggaaagcccaaagagagctctccaactaatgaggaaggaaaatagaattcttctattggtttttttttctactccaaattttgaccttaatgtactttttcgggccttttaatgatctttgctatagtacggggcgaaaattatatgttcggacattgttttcgaatattttgtatctatcaaagctcttataaacaagatagggtattcctacatagctggtcgaacccacggcaaatggatcataaagtcttaaaaaaagaatagatacgattgcattgcatgtagtaacagatgcgatcataccagcactaatgaaccggatcccatcagaactctacagttaagcgtgcttgggcgagagttgtactaggatgagtgagctccaggaaagtcctcgtgttgcatccctctttttttcggtttttctctttttttatgttaaaaataaatgactctataacttttggaccgtgaggccaaacttggcatgtgatacctttttggaaagcccaaagagagctctccaattaatgaggaaggaaaatgaaattcttctattgtttttttttctacgccaaattttgaccttaatgtaattttttgggcctttccgtgttttttgctttattacggggcacaaattatatgttcggccattgttttcgaatattttacatgtatcaaagctcttataaacaagatagggtattcctacatatctggtgggacccacagcaaatggatcataaagtcttcaaaaaagaatagatacgattgcattccatgtagtaacagatgcgatcataccagcactaatgcaccggatcccatcaaaactccacagttaagcgtgcttgggcgagagtagtacgaggatgggtgacctcacggaaagtcctcgtgttgcatccctcttttttcggttttcctctattttgttttgttaaaaatgtatgactctataactttaagaccgtgaggccaaccttgacatgtgataccttttcggaaagcctaaagagagctctccgatgaaagaggaaggaaaatggaattcttctattgtttttttttcttctccaaattttgaccttaatgtactttttcgagccttttcgtgatctttgctatagtacggggcaaaaattatatgttcggacattgttttcgaatattttgtatctatcaaagctcttataaacaagatagggtattcctacatagctggtgggacccatggcaaatgaatcataaagtcttcaaaaaagaatagatacgattgcattgcatgtagtaacagatgtgatcataccagcactaatgcaccggatcccatcagaactccgaagttaagcgtgattgggcgagagtagtactaagatgggtgacctcgaggaatgtcctcgtgttgcatgcctcttttttcggtttttctctattttgttttattaaaaatgtatgactctataactttaagaccgtgaggcaaaacttgacatgtgataccttttcggaaagcccaaagagagctctccaatgaatgaggaagtctttttctattccaaattttgaccttaatgtactttttcgagtcttttcgtgatctttgctatattacggggcgaacattatacgttcggacattgttttcgaatattttgtatctatcaaagctcttataaacaagatagggtattcctacattgctggtgggacccacggcaaatggatcataaagtcttaaaaaaagaatagatacgattgcattgcatgtagtaacagatgcgatcataccagcactaatgcaccggatcccatcagaactccgcagttaagcgtgcttgggcgagagtagtactaggatgggtgacctcgaagaatgtcctcgtgttgcatccctctttttttcggtttttctctttttttgttttgttaaaaatgtatgactttataacttttagaccgtgaggccaaacttggcatgccataccttttcggaaagcccaaagagagctctccaattaatgaggaargaaaatggaattcttctattgttttttttttctactccaaattttgaccttaatgtactttttcgtgccttttcgtgatctttgctatagtacggggtgaaaattatatgttcggacattgttttcgaatattttgcatgtatcaaagctctaataaacaagatagggtattcctacatagctagtgggacccacgacaaatggatcataaagtcttaaaaaagaatagatacgattgcattgcatgtaktaacggatgcgattataccarcattaatgcacyggatcccatcagaaatctgyagttaagcgtgcttkggcgagagttgtactaggatgggtgacctmcaggaaagtcctcgtgttgcattccycttttttttctcggtttttctcttttttgttttgytaaaagtatatgactctataacttttagaccgtgaggccaaacttggcatgtgataccttttcgraaagcccaaagagagctctccaactaatgaggaaggaaaatggaattcttctattggtttttttttctactccaaattttgaccttaatgtactttttcgggccttttaatgatctttgctatagtacaaggcgaaaattatatgttcggacattgttttcgaatattttgtatctatcaaagctcttataaacaagatagggtattcctacatagctggtgggacccacggcaaatggatcataaagtcttaaaaaaagaatagatacgattgcattgcatgtagtaacagatgcgatcataccagcactaatgcaccggatcccattagaactccgcagttaagcgtgcttgggcgagagtagtactaggatgggtgacctcgaagaatgtcctcgtgttgcatccctctttttttcggtttttctctttttttgttttgttaaaaatgtatgactttataacttttagaccgtgaggccaaacttggcatgccataccttttcggaaagcccaaagagagctctccaattaatgaggaargaaaatggaattcttctattgttttttttttctactccaaattttgaccttaatgtactttttcgtgccttttcgtgatctttgctatagtacggggtgaaaattatatgttcggacaktgttttcgaatattttgcatgtatcaaagctctaataaacaagatagggtattcctacatagctagtgggacccacgacaaatggatcataaagtcttaaaaaagaatagatacgattgcattgcatgtattaacggatgcgattataccagcattaatgcaccggatcccatcagaaatctgcagttaagcgtgcttgggcgagagttgtactaggatgggtgacctccaggaaagtcctcgtgttgcattcctcttttttttctcggtttttctcttttctgttttgttaaaagtatatgactctataacttttagaccgtgaggccaaacttggcatgtgatacctcttcggaaagcccaaagagagctctccaactaatgaggaaggaaaatggaattctcctattgatttttttttctactccaaattttgaccttaatgtactttttcgggccttttaatgatctttgctatagtacggggcgaaaattatatgttcggacattgttttcgaatattttgcatgtatcaaagctcttattaacaagatagggtgttcctacatagctaatgggacccacggcaaatggatcataaagtcttcaaaaaagaatagatataattgcattgcatgtagtaacagctacgatcataccagcactaattgcattgcatgtagtatgaggatgggtgacctcccggaaagtcctactgttgcagccctcttttttcggtttttctctattttgttttgttaaaaatgtataactctataactttaagaccgtgaggccaaccttgacatgtgataccttttcggaaagcctaaagagagctctccgatgaaagaggaaggaaaatggaattcttctattgtttttttttcttctccaaattttgaccttaatgtactttttcgagccttttcgtgatctttgctatattacggggcaaaattatatgttcggacaatgttttcgaatattttgtatctatcaaagctcttataaacaagatagggtattcctacatagctggtgggacccatggcaaatgaatcataaagtcttcaaaaaggaatagatacgattgcattgcatgtagtaacagatgggatcataccagcactaatgcaccggatcccatcagaactccgcagttaagcgtgcttgggcgagagtagtactaggatgggtgacctcgaggaatgtcctcgtgttgcatccctctttttttttcggtttttctcttttttttgttttgttaaaaatgtatgactttataacttttagaccgtgaggccaaacttggcatgccataccttttcggaaagcccaaagagagttctccaatgaatgaggaaggaaaatggaattcttctattgtttttttttctactccaaattttgaccttaatgtcttttttcgggccttttcttgatctttgctatattacgaggcgaaaaattatatgtttggacattgttttcgaatattttgcatgtatcaaagctcttataaacaagatagggtattcctacatagctggtgggacccacgacaaatagatcataaagtattcaaaaaagaatagatacgattgcaatgcatgtagtaacggatgctatcatactagcactaatgcaccggatcccatcagaactccgcagttaagcgtgcttgggcgagagtagtatgaggatgggtgacctcccggaaagtcctcatgttgcatccctctttttttcggtttttctctattttgtattgttaaagatgtatgactctatacctttaagaccgtgaggccaaacttgacatgtgataccatttcggaaatcccaaagagagctctccgatgaaagaggaaggaaaatggaatacttctattgggttttgtttttactccaaattttgacctaaatgtacttttccgggccttttcgtgatctttgctatattacggggtgaaaattatatgttcggacattggtttccaatattttgcaagtatcaaagctcttataaaaaaatagggtattcctacatagctggtgggacccacggcaaatggatcataaaatcttcaaaaaagaatagatacgattgcattgcatgtagtaacagatgcgatcataccagcactaatgcaacggatcccatcagaactccgcagttaagggtgcttgtgagagagtagtactaggatgggtgacctcaaggaatgtcctcgtgttgcatccctcttttttttttctgtttttctctttttttgttctgttaaaaatgtatgactttataacctttagaccgtgaggccaaacttggcatgccataccttttcggaaagcccaaagagagctctccaattaatgaggaaggaaaatggaattcttctattgttttttttttctactccaaattttgaccttaatgtactttttcgtgccttttcgtgatctttgctatagtacggggtgaaaattatatgttcggacattgttttcgaatattttgcatgtatcaaagctctaataaacaagatagggtattcctacatagctagtgggacccacgacaaatggatcataaagtcttaaaaaaaaatagatacgattgcattgcatgtagtaacggatgcgattataccagcattaatgcaccggatcccatcagaaatcwgcagttaagcgtscttgggcgagagttgtactaggatgggtgacctacaggaaagtcctcgtgttgcattccccttttttttctcggtttttctcttttttgttttgttaaaagtatatgactctataacttttagaccgtgaggccaaacttggcatgtgataccttttcggaaagcccaaagagagctctccaactaatgaggaaggaaaatagaattcttctattggtttttttttctactccaaattttgaccttaatgtactttttcgggccttttaatgatctttgctatagtacggggcgaaaattatatgttcggacattgttttcgaatattttgtatctatcaaagctcttataaacaagatagggtattcctacatagctggtcgaacccacggcaaatggatcataaagtcttaaaaaaagaatagatacgattgcattgcatgtagtaacagatgcgatcataccagcactaatgcaccggatcccatcagaactccgcagttaagtgtgcttgggcgagagtagtactaagatgggtgacctcgaagaatgtcctcgtgttgcatccctcttttttttcrgtttttctctttttatgttttgttaaaaatgtatgactttataacttttagaccgtgaggccaaacttgkcatgccataccttttcggaaagcccaaagagagctctccaattaatgaggaaggaaaatggaattcttctattgttttttttttctactcyaaattttgaccttaatgtactttttcgtgccttttcgtgatctttgctatagtacggggtgaaaattatatgttcggacattgttttcgaatattttgcatgtatcaaagctctaataaacaagatagggtattcctacatagctagtgggacccacgacaaatggatcataaagtcttaaaaaagaatagatacgattgcattgcatgtattaacggatgcgattataccagcattaatgcactggatcccatcagaaatctgtagttaagcgtgcttgggcgagagttgtactaggatgggtgacctccaggaaagtcctcgtgttgcattcctctttttttctcggtttttctcttttctgttttgttaaaagtatatgactctataacttttagaccgtgaggccaaacttggcatgtgataccatttcggaaagcccaaagagagctctccaactaatgaggaaggaaaatggaattctcctattgatttttttttctactccaaatttwgaccttaatgtactttttcgggccttttaatgatctttgctatagtacggggcaaaaattataagttcggacattgttttcgaatattttgcatggatcaaagctcttattaacaagatagggtgttcctacatagctaatgggacccacggcaaatggatcataaagtcttcaaaaaagaatagatataattgcattgcatgtagtaacagctacgatcataccagcactaatgaaccggatcccatcagaactctacagttaagcgtgcttgggcgagagttgtactaggatgagtgagctccaggaaagtcctcgtgttgcatccctctttttttcggtttttctctttttttatgttaaaaataaatgactctataacttttggaccgtgaggccaaacttggcatgtggtacctttttggaaagcccaaagagagctctccaattaatgaggaaggaaaatgaaattcttctattgtttttttctctacgccaaattttgaccttaatgtaattttttgggcctttccgtgttttttgctttattacggggcaaaaattatatgttcggccattgttttcgaatattttacatgtatcaaagctcttataaacaagatagggtattcctacatatctggtgggacccacagcaaatggatcataaagtcttcaaaaaagaatagatacgattgcattccatgtagtaacagatgcgatcataccagcactaatgcaccggatcccatcaaaactccacagttaakcgtgcttgggcgagagtagtatgaggatgggtgacctcccggaaagtcctnnnnnnnnnnnnnnnnnnnnnnnnnnnnnnnnnnnnnnnnnnnnnnnnnnagtactagtatgggtgacctcccggaaagtcctcgtgttgcatccctcttttttttcggtttttctcttntgttttgttaaaaataaatgactctataacttttagactgtgaggccaaacttggcatgtgatacattttcagaaagcccaaagagagctctccgatgaatgaggaagcacaatggaagtcttctattagtttttttctactccaaattttgaccttaatgtactttttcaggccttttcgtgatctttgctttattacgaggcgaaaattttatgttcggacattgttttcgaatattttgcatgtatcaaagctcttataaacaagatagggtattcttacatagctggtgggacccacggcaaatggatcataaagtcttcaaaaaagaatagatacgattgcattgcatgtagtaacggatgcgatcatacccgcattaatgcaccggatcccatcagaactctacagttaagcgtgcttgggtgagagtagtactaggatgggtgacctctcggaaagtcctcgtgttgcatccctctttttttttcgagttttctcttttttttgtaaaaaaagtatgactctataaattttagaccgtgaggccaaacttggcatgtgataccttttcggaaagcccaaagagagctctccgatgaatgaggaagcacaatggaattcttctatttktttttttgtactccaaattttgaccttaatgtactttttcaggccttatgtgatctttgctatattacgaggcaaaaattatatgttcggacattgtttttaaatattttgcgtttatcaaagctcatataaacaagatagggtattcctacatagctggtaggacccacggaaaatggatcataaagtcttcaaaaaagaataaatacgattgcattgcatgtagtaacggatgcgatcataccagcattaatgcacgggatcccatcagaactctgcagttaagcgtgcttgggcgagagttgtactaggatgggtgaccttcaggaaagtcctcgtgttgcatccctctttttttctcggtttttctcttttttgttttgttaaaagtatatgactctataaattttagaccgtgaggccaaacttggcatgtgataccttttcggaaagcccaaagagagctctccgatgaatgaggaagcacaatggaattcttttctttgtttttttctactctaaattttgaccttaatgtattttttcaggcctttttcgtgatctttgctatattacggggcaaaaattaaatgttcggacattatttttgaatactttgcgtttatcaaaactcatatagacaagatagggtattcctacatagctggtggtacccacggcaaatagatcataaagtcttcaaaaaataatagatagaattgcattgcatgtattaacagctgcgatcataccagcactaatgaaccggatcccatcagaactccacagttaagcgtgcttgggcgagagttgttctaggatggatgacctctaggaaagtcctcgtgttccatccctcttttgtttcggtttttctctttttttttgttaaaaataaatgactctataacttttagaccgtgaggccaaacttggcatgtgataccttttcggaaagtccaaagagagctctccaattaatgaggaaggaaaatggaattcttctattgttttttttttccactccaaattttgacattaatgtaatttttctggccttttcgtgttctttgctatattacggggcaaaacttatatgttcggacattgttttcaaatattttgcatgtatcaaagctcttataaacaagatagggtattcctacatagctggtgggatccacgacaaatagatcataaagtattcaaaaaaaaatagacacgattgcattgcatgtagtaacggatgctatcataacagcactaatgcaccggatcccatcagaactctacagttaagcgtgcttgggtgagagcagtactagtatgggtgacctcccggaaagtcctcgtgttgcatccctcttttttttcggtttttctcttttgttttgttaaaaataaatgactctataacctttagactgtgaggccaaacttggcatgtgatacattttcagaaagcccaaagagagctctccgatgaatgaggaagcacaatggaagtcttctattagtttttttctactccaaattttgaccttaatgtactttttcaggccttttcgtgatctttgctttattacgaggcgaaaattttatgttcggacattgttttcaaatattttgcatgtatcaaagctcttataaacaagatagggtattcttacatagctggtgggacccacggcaaatggatcataaagtcttcaaaaaagaatagatacgattgcattgcatgtagtaacggatgcgatcatacccgcattaatgcaccggatccaatcagaactctacagttaagcgtgcttgggtgagagtagtactaggatgggtgacctctcggaaagtcctcgtgttgcatccctctttttttttcgagttttctcttttttttgttaaaaaagtatgactctataaattttagaccgtgaggccaaacttggcatgtgataccttttcggaaagcccaaagagagctctccgatgaatgaggaagcacaatggaattcttctatttgtttttttgtactccaaattttgaccttaatgtactttttcaggccttatgtgatctttgctatattacgaggcaaaaattatatgttcggacattgtttttaaatattttgcgtttatcaaagctcatataaacaagatagggtattcctacatagctggtaggacccacggaaaatggatcataaagtcttcaaaaaagaataaatacgattgcattgcatgtagtaacggatgcgatcataccagcattaatgcacgggatcccatcagaactctgcagttaagcgtgcttgggcgagagttgtactaggatgggtgaccttcaggaaagtcctcgtgttgcatccctctttttttctcggtttttctcttttttgttttgttaaaagtatatgactctataaattttagaccgtgaggccaaacttggcatgtgataccttttcggaaagcccaaagagagctctccgatgaatgaggaagcacaatggaattattctatttttttttttgtactccaaatttttaccttaatgtactttttcaggccttatgtgatctttgctatattacgaggcaaaaattatatgttcggacattgtttctaaatattttgcgtttatcaaagctcatataaacaagatagggtattcctacatagctggtgggacccacggaaaatggatcataaagtcttcaaaaaagaatagatacgattgcattgcatgtagtaacgaatgcgatcataccagcattaatgcacgggatcccatcagaactctgcagttaagcgtgcttgggcgagagttgtactaggatgggtgacctccagaaaagtcctcgtgttttgccatttttgcttttagtttcatttcattcctgttattgcatattaggactgttagaaccaaccaactctctgcttggcttgatttagagctttctaatcatatctcaactgtttgcatcacactggattggattgacaacctaaaatattacaacaacatgattagtgttttaggaattaactgactataatcctactatcaatttggcgtcgttgccagtttggtgtttgtttgctatatttgagatcattagaaacagtatgatcaagtttgtttttgttacacaagttactaacattgtgccttttctgtgtttgtgtttcaggtaccttgcaacccgctttacatacacatctctgatttatttattatagccatgctgctatctgtttcatgcatacacggtcacaaggaaatcagaacctcttattcaacgataacatcgaccttattgcccgccaactgagagaaccgacagaaactgacacaatggcttacgttgtagatgagcaagagcaacctaccaacattggtgctggtgacttccctcacaaccacaaccagcgtcatggcattgttccacctccagtacataacaacaattttgagataaaaagcggtctcattgcaatggttcagggaacaattttcatggcctgccaatggaggatctgctcgatcatcttgacgagttgggaagactttgtggccttactaaaatcaatggagttaatgaagatggtttcaagattcgcttgttcccattctcacttggagataaagcctatctgtgggaaaagacgctgctcagaattcaatcacaacctgggacgactgcaaaaaggccttcttggcaaaactcttctccaactatagaactgcaagactccggaatgagatatccggatttattcagaagcaaaatgaaagcttctgtgaagcttgagagcgctaagggttatcaaaccaaatgccctcatcacaaatttaagcaagcttctcttctcagcacactttacagaggcgtcctacctaaaattaggatgctgcttgacaccgcttccaatgggaatttcatgaacaaggatgttgaagaaggatgggagctagttgaaaacttggctcagtgggatggcaattataacgaggattatgacagaagcatccgcaccagttctgaatctgatgacaagcaccgccgagagattaaagctctcaatgacaaaaatgacaaactcctccaagtgcagtagaagcatgttcacttcgcttttgtagatgaagtattccaaatcgaagagagggagaatgatcagtgtgctgtaatcaactatgttcagaaccaaggtggctacaacaagagttacaacaagtacagatccaatccaaatctgtcatacagaagcactaatgtcgccaacccaaaccatttgttccttacaaccaaagccaatggttcattccaaagtcgtaattccgggggataccaacaacaaaaaccaccacctagtttcacaccacaacaacatcaagcacctgcgcctcatgaatcagacatcaagaatatgctccaacatattatgcaaggccaagccgcatgagtaatggaagccgctaagaagctggttgacttaaacaacaaagttgacagacagttcgctgaaataaattgcaggtttgaatcattaagcacaagggtatgatatctggacaacataaccacttcaccaacatttactaataatcccgaccagcttctaggaaaagcaatccagaaccctaaggagtatgccactgcccacgcaatcactatcagacatgatcgagagctgccaactcaacatgtctctacatcaaacaccgaggacagtgtaattcaagaaggggaggcttccactcagattgaagcctcttttgctgagatcgactatctagctcaacctttctatcaggcttagtctgacttggaagagaaggccgctataatcgagagaatgataaaacaattcaagccagctccatcaccttcacttgctcttccatggacgttcaagaaagcttggaaaagcatatatgaatctcttgcagaaaaataacttcatgagatggaagttgtgatgccattaatagaagtccgcaagttgattccagatcctcacaaagatgtgagaaacatgatgttggaaaggctcaacatatatcagaattcagatgatgatgatgatgtcataccgcttcaagctactagtgagaggattattcaagagaagctggaagatcctgcatctttcactctaccatgctccacaaggcaattgactttcatcaattgtctatgtgatctaggagccccagtcagtttaatgccactcttggtggcaaggaagttgggattcgttcagtacaagccctgtgacatcaccttgatccttgctgatagaattcaaggagaccattcaacattctagaggatgtgctagtaatgataaatggagtaaaggtgcctattgattttgtcgtgcttgagatggatgaagagtctaagaatcttctgatcttaggaacacctttcttggcctcagtgggagcagtaatagatgtcagatatggtaagattgatctcaaccttgggaggcacgttaagttacagtttgacatcaacaaatctccaacaaagtcaccaatagaaggaaaaaccttagagatttagtgaacagatccaagagaaggccttgcgattaaaatagggaaggagaaaattctagtcaaactcagccttcgaactctactactcgatcgagtataccatcaacgcttgattggctggaacttaaaaggaggactgatctccaaaacagaaccattaagaagttgaacttcacagttgaaaagcttagagacaaactaagtcgaatgcagattgaggttcaaccccagctcaacagtgacacgatttgaagaaaggagattacctcggatttgtcagaagagaaagactatcctctagaggaggaagcatcttactttgaggaaagaggagttgaatactcagctatgcaaatgttaagggaggatgctgagtatgatgatgagatcagtgaagaggaggacttctcaagttcccccagtcacattttctccacctattaagtgtgaggagtcaagctagagactctaaacaagctcacttgggaggaaatcccatgactatccctctatatactttttatttacttgttacttttgatttgttttggttgtgtctttgattctcaggaaaataataatagctagagtgatcaacatggatgtgatcgagtgctcaaatgaaaaattttcaaattttttgctggaatactcgatcgcaacataggtgtaaaagctcaagagtgcgatctagcggttctaagataacaatttcctcaacatcaatgtcaaaccactagatcgtagggaggactgaaagcatccgcagaacttcagtgacaacccatgctaccataaagtccactagacttaagtcttcaccaaaactccaaaaagcccatgatgtgtccccttgtagcccctgagacaaaattaaaggatcaacggcccatactcgatcacaaggcgagtgacttgaaggaaccacatcctaccgacataaagcaccatgctttgtcgccttatcactttaccgacatcataaagggcattccatctcatccgtccgtttaaaagcaacacacctcctccactcattcaaatcgcaaagggagataagtatcactactcttcacttttcttcatcagttgtgatttcaaaacatcgctcttatctatctctctacttcactaccaaaatggtctcaactctttcattgttgcaagctgttattcactaaaacagaacctcagaaaccactcaattgcaaccctgtctctcctctgcttgttccactcgatcgcgacatgaactctcacctttgatttatactcgattgcaacagcctaacaataggaagtcacttctctcattctctttgtttgattttcactaacgtactaaactttagttttaagtttcaaatcgatttcaacttcaggatgagttcacatagctacgaatcatctatggatgccgactacaatgttgatgaagctgaatcttggtcaactagaccagaaagagaagcagaggagtataggcgatttgtggaggaaatagagcgagcattcaccaatgacaagaggagggaagcgatttccagaggaaaatgggcaatgacagagaaccatgagttggttgacgaagagatgaaggatgatgcggactacattccggagccaacccgcaagaccgccaagtctttgttgaaggaagacaagctgactccgagagactactataaggttctcaagagaaatccgttttggggaacgtgatatcctcacccggaggccatggcggagttaggcatcctggaggacgttcatctcttgttcaagaagagccacatgacaacactcatgtctcatccctatcttgcctatgaggatgagacactccaattcctttcatctcttcaaatggaattgtttgagaggttgtcatctgctgaaatgagacaataagggcttgggtacttaagcttcaccatcgacgaccgcgactacatcatggtgataaagacgctggaaaccatgttcgagtttcctagtggcacgggaacgaaaccgaagtttgtacgagccaaactcaaagccttgtggaacacgatcggagacaccacctgcttcaactccgctagatccaagagcaactccatccgcaatcccgccatccgctatttccagagagccttggccaatgtcccttacgctagggagatatctgccactgtgacggaccaagacatggagacgttagtcctggcgctgatgagcttcctcctttacagcaaggacggaaaaacgatgaacagagatgccaatgacacaaccccgtcgatgtatctcttcaatcacctatgcagctacagagggtgggcactgaccaatgacaggaagaaagcaaaaggagccctttgcattggaggagttgtgacgccaatcctcctatcgtgcaaagtcttgcggcgatcggatccaatcaaaccacgatggatggacatcgcccatctcaagcttgcccatgtgatcgagcatcaagtctatgacaagaggtacgatttcaagttcgatcacccgtcaaaagaagaagcgactatacttctccccttcagtgaaatgacaaccatcacggtgagagactacatcgccttctcaccaccacaagaaatcctccatgttgtgattggaggatcctcgtctcggaacactgaagaagtagaaggtcagagtaacaatgaggagatcaactgggagaactatgacactagccggttccactttgaagaacacaagcgcccttcaccggaaagcaagagtctcactgaagcacactgaaagctcaatctaacccaaagatggtgcaagttttaagataagatcaaaagccccctgcatatcatctaagtcataaaaaaacaaaataattttgaattccacaaaaacaaagtgatcatttagttgcattacatttaggatcgagtgtagagtgtttcatataggattgttgcatatgcataggggataatgaggagataaccttgtaagcatgatgattcactaaaatgagttattagttctttgatgtattagaataactttgaagtaaaagcgcaccatgttctatagaaaccattcgatgcatgtcatgacaccttttcctgtcaatttgaacttgaatctgacttataattatcatgtttgcatcgtttttgaactcatggatagaatacatacttggattttctttcacttattcaccactcttgttaatccaagtagctgctcctgtcattggagtagttcccccacccttaactaacccttctttcaagccatgtaattttgtgagagcatgtgaggcctattttcaggattgagcttggtagaacatgttaggtttgagccaacaagagtagtatctcatgtagtttcgatccgcgttttcggacttggtaggactaggtgggaacttatttgaagattgagattgagtgtaaaaagaaaaagaaagataaaaatgggttagaatctttaggagaaggaagctgaaaatcatattgagatctagtgaatgtttgggaatcatagaattgttaagatatgttttaaaaaaaaagatggcaacaaaaacagaaaagaaaaaaatttataatagccataagagtttaagaaaaactcaattcactagagcagactcagagtataagaaaagcctcttcttaagaacaagagccaaagaaatgaaggaaatgattcgatccaagaaagaatcgaaatatgcctttagtgcaaaagggtagacttaaaatcatcattgggtttagagataggactatctacttgttattcacggtttatgtcattgggtagatgggatgctattcttgtatgtataggttggcacttacctttagcattcttctaaagctcagtcctttttcattgagagtctcttgttattaaaatctgaaccacttaaaagggaccatctttgtctcataacctgtccttagccaaatgagttcactagcgatgcgtatcttcattcatgtttttgaacttaatgaatgttaaaagggattggttgattttgacgcattgtgcaattgagtgtaggtttggatcataacagagcatgactaaagttttttagtagaagtcgatcacctcgcgtcttagaactgttggctggttgataactaggtttttacgcctagttatatgctgaagtgtggttcagttcaattctccttaaacactaacatgtcgatgcatctataagaggtgtcaatctactccactgttattgctagcaatcaagatgtggacagaagcaactaagtcaagcctgattataatgatggtgggtttctagaaacaatcctaaatcaagattcaaacaacaaaaataagaactttaaatgccctactcgatcacagggtcgagcagaaccattcatgcaacaaatttaagtattgaaatgcaataagaggtaactcagcaagatgacacaaataacaggtgaataaaagtgcaatcaagggtgaatacaaataaatctaagaagaatagaagttctaagaatggattcattgataagggcaattctagggttcatcaggtggctaaaatacaaaaggcaaataccctaaacgattgttggagctggatttccctccaggaatccacttgcgaaaataccatgccaggccactaagcacagcaagcccaccaagtagaggacctgcatagctctggagcccatgtacggattaggtatctgggcccgataagccctaagcggataacgacttaggaactgaacaaggagatatccgcggagcggacatgatatctcagaactgacctaccgaatatccaggaggatccccacgaatctcggatgaagttagtcacgtgcgtagacttatataaggaagcaatgacgacttggaagacacattcattcatcttaacacttacacttatacttttacacttgtaatctcattctacattgtaaaagctcttctattatcaattcaaaagtccatttgttcttaacgatataaatctcaaagttcttgtgaatatctagccctcctttcttacaaatctatttacaaatctctagtgtggatttcagaacccacatttggcgccgtctgcggggacggaaatagatccttccaacaccaaaactaacgcatcaattgtgaccaacaactgaatggtcggtcaaagttcttgtgaatatcccgccccacaaaagaaaaacacgaggttcccattacgcctcccaaaattcggtagaaacgtaacccagcacctctcctcgaaacgcatcgattttatcatgggaggatctcagctctgcaactactcgatcaactcgatcaaaactcatcagaggaaagtagattcctacacaaaaggcaaaagcccgatgataggatctgatcaccagatcacattttgggaaagcgaaaccactgacctcgataaacctcatgatgacgctctctttatccgaatcgacgtaagcaactacgaactctcccgtataagggtcgatacggggagctcagttgacgtactcttcaatgacgccttcaaaaaaatgggacacctcgattttaagctacaaggcaggaaaatgccacttaccggattcgctggagataccaccttttctttagaaaccatccagctccccactgtcgcaagaggagtgagacaactcatgaccttcctcgtagtcgataagaaagctcctttcaacgcgatactgggaaggccatggctacacgccatgaaaaccgtcccatccacttaccattaatgcattaaattcccctccaacaaggggatagcagtcgtaaactgcagccaacgcagttcccgacaatgctacatgggtggctacgagcatatcaaaaaagtcgatcccgtggtattaaagttagaggataaactcgcagaaatgaaaacagttagatcctctgacccgtctcaacgcagacctcgaaaatcgttaacaacgcaggtctgcatagacgaataagatcctaaatgatgcgttgaaatagcccatgacctcgatccagcgatacgagaggatctcataaccttcctcaaggaaaacaaaaacagcttcgcatggtcaagctacgaggaataagcctcgaggtaacctcacacgaactcaacgtcgatccgacctaccggcccattaagtagaaacgtcgcaaattaggtcccgaaaaggccaaagctatgaacgatgaggtcgaccggttactcaaaatcggatcgataagggaagtaaaataccccaactggctcgctaacccagccgttgttaaacataaaaacgggaagtggagagtatgcattgactttacggacctgaataaagtatgtcctaaagacagtttcccactcccgcatatcgaccgacttgtcgaagccaccgcaggacacggactactgtcctccatggccgcattctccgggtacaaccaaatagttatgcgcccaaacgaccaagaaaaaaccgctttcattaccgaccgaggcaattattgttataaagtaatgccctttgttttgaaaaatgccagagctacctaccaatgaccacgtcccacaattaagggcatctccaacccatccctatttttgtccctaaactctatttttgtctttatttcactccaacccatctctattctcacctctgttatagagctctctattttttctctatatatagagacaaaaaatagggatctctatttttttccctatttttccttctaacaaatagagatctctagttttgagaaaccattggagtaaaaatagagatctcttttttttcttctgtatttacaagaaaaaatagagacaaccattggagatggtctaagagaatgcttcaaaatcctaaacaaatttgaaatgaagctaaatcccgagaagtgctctttcggggtcccatcaggagaattcctcgggtatctagtaaccaaaagaggcatccacgccaatcctaagcaaatgacatcactaaaaacggcacgagaggtccaacggctgactagccgtatcgccgcccttaatagattcatatctaggtccaacgataaatgcgtcctgttctatcagctcctctggaaggataagaagtttgactgaatgaggattgcgaacaagccttcaagcaatttaaaacataactgctcgacccacctgtactcgcaaaactcaaagagggagaaccgatgtacctgtacactgcagtctcccgatctgcgaaaaagtggaagatccgtcttaccacgtccacccccgttacccataggggaatgtacaagcagaagccgccaacaatgttatacttagcaacatcaagaaaagactcgattctaaaaaatcgatgtggtctgacgtactccacggagttctatgggcttaccgaactatacctcgcaaatcaacgcaagaaatcccgttctctctcgcctatggtttggaagcagttatcactgtcgaaaccatagtgccaagggtgagaagaaccgccagtcctactaactcggacctgaacacgcaaatgttgcaggacaacatggacttcatcgataaacgcagagatcaggcgatgatacaagttcaaaactatcagcaagctgccgcctgctattacaactccaatatcaaaatttggagattcgtcgtgggagagctcgttttacgaaaagtgttcagcaacacgagggagctaaacgccagaaagctaagaaccaactgggaaggtccctatcgaatcaccgcggtggtacatgacggcatctataagctcgaaaaagttatcaattgagtacctcagttacggccttggaatgccatgcatctcaagaaataccacgaataggtactcaaaaacaatcgaactacgataaagcttgatctcctggcagggtacgtaggcagctccccccaagagcgcaaccaatacctcaatcgaactacgtcatggcttgatcccctaatcgggtacataggcagttcccccgcagaacgcatccagcacctcgactcttccagttaaagcagatcccttcgacaaagaaaatggacatcatgcctccatcagagaacgttagctggctcacctgacaattcaaccatcaatcaacaccaagcaggtcccctcttatcaactacattgtgaatcgtcattttttttacctcgtttgtacttaaccattttgagatcagaataaaagaaagttcgatacttaatattactctttgcaaaccattcgatacttattatcactctttgcaaaccaatcgctaccagtgcaatttaaaactcattcgtaatcttacgatacctaaagcccaacacctgaatgttggcaaatccatttttgtgatcacgcttccaaaaagtcgagagtgaaacttatccttaaaagcacgtcacttcgacttcatcagagctcacctacgacaaccatatctaactccttccttcaccatcaaagatgacatattaaacaaggaagaaatgaaggtttcattcgcgatctggcgataccacaagcctaggttccaaaacatggcaggtcccttgtgtgaccttgttccaacaggtccccgagacaagtaacataaacttacttgattttgagcctacgaagaacataccatctcaaagcagaaacaacttagaattaaagcaagtcctaacattatccaaaacagaatcaaaacaaggcgacaagcacatcatacaccgaattcgattaagtgtcaacgcgcgagtaagaaacgataaatagccttcccaggcaccgattactcaaacaaatgataaaagctttcccaggcacccggttcaaaataaaacgagcaaaaggatgaaagccttccctgacactaagtctgaaatgaaagcattaaaaaaaaacttaaaacaaggagctaaaacaatcactccatcgaccccctggctggaatggcaaagacagtaccgggatcctctccgagacctcctagaaatgcatccttgttgatcccaaactcatccaaaccgatcggtgttccctgctcatcaacatcaatcggacgcaccactgacatcttcgacacttgcgggatatccagctcgctcagagtgaagtccgacacctcctttactgcacatctcacctacaggtcatctagatctgcttgcaaccgaggtctctctacggccaggtcgacgacagccttcgcaatttgatcgattaaagccaagttcgactccacctcgaccgcttgactttccagcacggtgaattccttttttgcgacccacttatccttgattccatcaagcaacttcgaatacgaggcagccagttcaaccttggcatcatgtatctaaaccagtgcccttctatgaggccacctgttctttcttaaatgcctaggctcatctatgatagttcaaataacaattacctatggcgggaatacctattgtctaatatcaagttctaggtgatcaatctaaaactagcattaagaataatcaagatgaagaattctaagaataatcctaaggggttttcgatctaataatccatctaaatccctattgagacttcctaaactcaacaaggtgattactcagacatgacaatagaaacacaaatcataatatgaatagttttcactaatgaattaagaataatagcaaaggagttcagaatcctctctaaagggattggattcctctctcaaatgtgtaaccaaagctctaaaaacaaaactaggtctaacaatgaccaaacaattaggtatttccgtcactaaaaacgtgcatggactactttgcaaataaggaagacttcagggcttctcaaagacttggtagaaaacgagaattcccttggcagcgattagagtgtcgatcgacacaggtgtggtgtcgatcgacaccagcttctgaaaaaagtccttcaagatcttcattgctgaaaagcttccaaaattacttattgtgctccatagttcccaaatgtgtaagtgtacatgaaatgactcaaaacgtacgaaaaagactagaaagactctaaaaaccattctgaaactatgttagaaatcagtaaaaagcaggacatatcaatcaactcccccaaacatatctcttgcttgccctcaagcaaacacaaaatcttaagttgaaggagaggtttgaaggtgggaattcaaaaaccgaagcatgcatatagaatgggtgagatcaatgtccatgtagctaattctaggttgtaaagtgatagatccttacttaaaaactttagccatactcgtcatcatgcaacctatatatatatatatgtgtgtgcgtaataaaatatggtacaaataatatatgtttatatatatatatatatatatataaacattatccataagcaattatctattaaaactgaagaagcccatttctataatatgtttcaaagatataagccttaatgtattcaagcattcacatcaacatattccctttaacatttattaagaacgaacagtggatcaagcaatgcaatggttatgaactcatttggtttcgggcttaggctaagagactgttggggtcggatttcacccaagtaaccgagccaaccagaggaagtgcctcgggcatcacttcaaagggccgccctgagccggccctgaaacgcctcgggcatcactacggagttgtcccgagccggccctgaaacacctcggggatcgctaatgagttgtcccgagccagccctaaaacacctcggatatcacttcaaagagccatcccgagctggcgttggaacgcctcagatatcaccacggagccgtccgagccagccttaaaactggttgggagtcattccagagccatcccgaagcagatctcgaaacgcctcggacaactttcactcggctcgagatgcatccaggagacgagccgcccaaccacagccaaaggaccaacttgacctggctcgggagaaacttcgtttccgacgagaagacttagaaccgatgtaaagtcgaaacgtttctccccggaaaacgcggaagtgatactggagaatctctaaagatattgccgaatatggaagatcccgcgaaattctctaaggataaagttaatctccatcaccgactctaagataattggaaatctttcgagaatatcgcgggaggagattcgccaaagccttatataaagcacctcaaaggacaaacaaacaggacacgcacaaaaacgctctcaactttaggctatcaaaaacgctctgactttgaaggctaaaacacttattttctatatttctaaacacttgtacgatcaaatcatcattatctcaataatataatcaagaacaccgtccgtggtaatcagcaattcagttgttctttgagaatctcacaaatatccgttctttgaaggaacccaagatacaatttcgatggtgcgagttttgactctagcaatttggcgctagaaggagggggacttgagatttctcttactctcagaacacaaaaccaaccaaccaatccacaatggtcaacaatcagatctccgataacactgttgacgcagtgggaaacccgatccctccaatctagacagacgctcccgaagccaccgctcccagaagaagcatgagcttaactccagaagaaggtaaacgatcaagaacaggcgaatcggtctttggtgcaacagctcaaggcagctacctcccaaggacagatcaggactactcgcttcggcgcacgacatcttcaggatcgaggagcggcaccagatctcaacccaacacggcacgtgttccacacgcctggcaacacaacaaggcctatccgccgaaccgcgccagaatctggaagggaccgagcaaaatcggcagctttgggaaaccgagacgcgacgaaccgagcagagggaaccgacccgcaacttcctcttccctgagcagaatttgccgaggccaatcagatcaggatctcggacgatgatgactcagaagagaacgttcgttgggctgaggaatatgctagagaacaagaaataagcgctatcaaaccaagatgaagctcgtcagatcccaaatgcataacgtagtctcctttgccccaaacatcgaccgcattctggaggagtcccataacactcctttcattcgtaggatctccaacgcgataatttcagatccaggaaagctaaggatcgagtacttcaatggatcatctaacccgaaagggcttttgaagtccttcataatctctatggcccaagccaaattcagaccctacgaaagagacgccggtctctgtcacctgttcgtcgagcatttgaaaggaccagctctggattggttctcaagactcaaaggaaattccgttgacagttttcaggagctatctacactcttactcaagcaatattcggtgctaatcgatctggcacgtccgacgccgatctttggttattgtctcagcagccgaactagccacttcgagacttcctcgcaatccaccctagccaaagtcgaaggcatcaacgacgtagcggctctctctgctctaaaaaaagccctatggtacaagtctgaattccgaaaggagttaaatttgtccaaaccatagacaatccgagacgccttgcaccgagcctcgaattaagtttcccatgaagaaaaggcacgagccgctgaagcaaacgcctcatagcgaaaaatcccaacctagcgctccgaaccacgaaaagggcgctcaaggcggaacgttcgtacaccatgaaggacagaatttctccgaagcccacaattatcaagctgatacaccccgaggtcgaggacgaggccgcggccgaggtcgcggacgagaatcctacacctggacgaagaaccaacatgtgggaaacgagcaagaataatgcgaattacataaaagttacggccatcatacttccagatgccgtagcctcggggcaaagttagcagctaagttcctacccggagaaatcggtggaggcctaaccatcgaggacttagaggcggagaaagccaagaccgagttggtcaatgctatggcaaatcccgagcaagcagaggcagaggcaatcgcgagatagatgacgacgagccagaagctgctcggggaaggattttcacaattttaagagattcagctttctgtcaagacacaacggtgtcaatcaaagcttatcagaggaaggccaactcaaatcgtaactggacgctaccgtttaacggaccagatgacgaagtaacttttcacgagagcgatattatcggcttagacagtccacacaatgattccttggtcataacactaaccattggtgatttcaacgtcgaacgagttttagtcgacaaggggagcacactggacatcatctttctaacgaccctgcaagaaatgaaggtcggtatgacgcaaatcgtaccaactctgcgacctgtgctcgggttctttggggaaaccaccatgactctcggcactatcaagttaccagtccgagccaaggggataacgaaaatcatcgatttctccgttactgacgagccgaccgtttataacgcaattattggcactccatggttgaatcaattctgagccatcgcctcgacatatcatctctgcctgaaattttgacaagcaacggcgtgaagaccatctcgggaaatcagaaaaatgcctgaatttgcttcatggcagcacacaagctcagaaacccgagcgatgcgtggaaattggcgtaaacttaggcgaaaaattgacagccgagctgatctctttcctcatagagaacgtcaatactttcgcctggtccccagaagacttgcccggagtaagcgttgaaatcgtagcacacgagctcaacgtagacccaacgtttaaacccgtcaagcagaagacaagagcgttgggtcgagagcgagcggaagctgtgaaagccgaggtagagaaactgttaaggatcagctccatcaccgagacaaagtaccccgactggctcgcaaatcccgtcgtggtaaaaaagaaaaacggcaaatggagagtctgtgtagacttcactgatctgaacaaagcctgcccaaaggacactttcccattgccgcacatcgatcgcctcgtgtaatcaacctctggaaacaagttgctgtcattcatggacgcattcgctggctacaaccaaatcatgatgaaccctgaggatcaagaggaaaccgctttctacacagaacgcttcgtcaacaagatctgcgaaaattatcacgcacgcttcgtcaaccctgatgccattcggactcaagaatgccggggcaacttatcaacgcttcgtcaaccagatcttcgcattacaaattgggaaaacgatggaagtatatatcgacgacatgttggtaaaatccatggaagaggtagaacacataccccatttgcgcgagagtttccagcagcttaacctctatatgtcgatccggtgaatttctcggatatctagtcacgcatcgcggcatcgaggcgaatccaaagcagatcgaggcgttgttaggaatggcatcgccacaatacaagcgagacgtgcaaggccttaaccggttcatctcacgatccaccgacaagtgcttggccttttacgatgtggaacaagaaattcgaatggactacctgaaacgaagaggctttccaggaactcaagaaatacctggcaaccccaccgatcctcgcaaaacctgtaatcagggaaccactctacttatattttgctgtatcggacactatagtcaacggagtgttagttcgagaagacagaggcgaacataaatcgatcttttacgcctcgtagacatcaccggcgcagaatctcgctacccccaaatggaaaaactcgctttagcagttgtaatgtcagctcagaaattgcgaccctattttcaatcccattccatcgtagtaatgggatccatgccgctccgcgctatcctacacagtcaaagccagtcgggacgcctggctaaatgggcaatcgagctcagcgagtatgacatcgagtatcggaacaaaacatgtgcaaaatcccaggtcctagccgattttatcgtcgaattacccacaaaggaggtccgggagaatccgcttgatacaacttggctcttgcatgtagacggctcgtcatcaaagcaaggttcgggcgtgggcatccgtcttacctcgccaaacgggagaagttcttgaacaatcattcagattaaacttcgaggctaccaacaacgtggccgaatacgaagcgttcgtagtcggactcaatctagctcaggaactaaagatagaaaaaatccgagctttttgtgactctcagcttgtcgcaaatcaattcaacggagaatacacgactcgggacgaaagaatggaagcctatctggctcatgtacaaaatctggcaaagcatttcgacgaattagagttaacgagaatccctcgaggagaaaatacatcggccgacgctctagctgctctggcatctacatctgacccaagcccgagaagagtcattccagtggagttcatcgagaagtcaagtatcgagctcggcaaagaagaacaggttttccccattcaagttggcgcggattgcgacaacgctttggatgacagcccagacctaggttacaactcagaatggatagaacccatcaaaagctacatatctgaagggaaaatgccctcagataaatagggagctcggaaacttagagctcaggtcgcgcgctttgttctggtcgaggagaaactctacaagtgccgattatccggacccttaatgacttgcgtggaaaaagaagcggctcgcaaagtcatgaaagaagttcacgaaggctcgtgtggaaattattccaggggaagagccctagccatcaaaataaaacgccacgggctcttctggccgacgatgatcaaatattgcaaaaggttctccaaacaatgcgaaaaatgccaaaggcacgcgccaacaatccatcaaccagccgagctcctgtcatcaatcgtctcgccgtacccattcatgcgctggtcaatggacataatcggacccatgcatccctcgaggcagaagaagttggttctcatcttaaccgattatttctctaagtggatagaggccgaatcttatgccagcatcaaagatgctcaggtggaaagcttgcatgcctgcaggtcgactctagaggatccccgggtaccgagctcgaattcgccctatagtgagtcgtattacaattcactggccgtcgttttacaacgtcgtgactgggaaaaccctggcgttacccaacttaatcgccttgcagcacatccccctttcgccag

SEQ ID NO: 189 - DNA, 83391 bp, Arabidopsis thaliana
  modified_base (2556)..(2605): N = A, C G, or T/U
gcatcgcaaccgcatcagactccggcatcgcaaactgcacccggcgccgggcagccacatccagcgcaaaaaccttcgtgtagacttccgttgaactgatggacttatgtcccatcaggctttgcagaactttcagcggtataccggcatacagcatgtgcatcgcataggaatggcggaacgtatgtggtgtgaccggaacagagaacgtcacaccgtcagcagcagcggcggcaaccgcctccccaatccaggtcctgaccgttctgtccgtcacttcccagatccgcgctttctctgtccttcctgtgcgacggttacgccgctccatgagcttatcgcgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacatgagaattggtcgacggcccgggcggccgcaaggggttcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctttgagaagcaagaagaaggttggttagtgttttaaagtcgaatatgacttgatgtcatgtgtatgattgagtataagaacttaaaccgcaaccggatcttaaaggcgtaagaattgtatccttattagaagacacaaagccaaagactcatatggactttggctacaccatgaaagctttgagaagcaagaagaaggttggttagtgttttaaagtcaaatatgacttgatgtcatgtgtacgattgagtataagaacttaaaccgcaaccggatcttaaaggcgtaagaattgtgtccttgttagaagacacaaagccaaagactcatgtggactttggctacaccataaaagctttgagaagcaagaagaaggttggttagtgttttaaagtcgaatatgacttgatgtcatgtgtatgattgagtataagaacttaaaccgcaaccagatcttaaaggcgtaagagatgtatccttgttagaagacacaaagccaaatactcatatggactttggctacaccatgaaagctttgagaagcaagaagaaggttggttagtgttttggagtcgaatatgacttgatgtcatgtgtatgattgagtataacaacttaaaccgcaacccgatcttgtaagcctaagtagtgtatcgttgttagaagacacaaagccaaagactcatatggactgtggctacaccatgaaagctttgagaagcaagaagaaggttggttagtgttttggagtcgaatatgacttgatgtcatgtgtatgattgagtataagaacttaaaccgcaacctgatctataagcctaagtagtgtatccttgttagaagacacaaagccaaagactcatattgactttggctacaccatgaaaactttgagaagcaagaagaaggtcggttagtgttttggagtcgaatatgactcgatgtcatgtgtatgattgagtataannnnnnnnnnnnnnnnnnnnnnnnnnnnnnnnnnnnnnnnnnnnnnnnnntattacgccagctggcgaaagggggatgtgctgcaaggcgattaagttgggtaacgccagggttttcccagtcacgacgttgtaaaacgacggccagtgaattgtaatacgactcactatagggcgaattcgagctcggtacccggggatcctctagagtcgacctgcaggcatgcaagctttgatggtctagctgaagttcgtttgagtcattggctttgtatcttctaacatcgaaacactacttaggcttttaatatcgcgttgtggttctagttttacacgccatcataaacatgacatccagtcatatttgactccaaaacactaacagaacttcttcttgattctcaaagttttgatggtgtagccgaagtccatatgagtctttggatttgtatcttctaacaaggaaacactacttgggcattcaagatccgattgcggtttgagtatttatactcaatcatacacatgtcatctagtcatatttgactccaaaacaataaccaagcttcttcatgcttcctaaggctttgatggtgatgtcaaagtccgtatgaatcttttgttttgtatcttctagcatggaaacactacttttgcttttgggataagtttcaagatctagtccaaatacttaaccatacacatgacatcaagtgatatttgatccaaaacactaaccaagcttcttcttgcttctcaaagctttgatggtttaaccaaagtccgtatgagaatttggctttgtatcttctaacaaggaaacactacttgggctttcaagatctggttgtagttcgagtttttatactaaatcatagacatgccatcttgtcatatttgactccaaaacactaaccaagattcttcttgcttctcaaagttttaatggtgtaatcaaaatctgtattagtcattggctttgtatgttctaacaaggaaacactatttgggctttcgggattaggttgtagttcgagttcttatactaaatcatacaaatgtcgtctggtcatatttgactccaaaacactaaccaagattcttcttgcttctcaaagttttaatggtgtaatcgaaaatctgtatgagtctttggtttgtatcttctaacaaggaaacactacttagacttttaagatccggttgtggttctagttcttatactcaatcatacagattacatcaagtcatatttgactctaaaacactaactaagccccttcttgtttctcaaagctttgatagtgaagccgaagtccgtatgagtcattagctttgtctgttctaacaagaaaacactatttgggctttcaatatccggttgccaatctagttcttatactaaatcatacacaggacatcaattcatatttgactccaaaacactaaccaagcttcatcttgcttcttgatggtgtagccgaagtccgtatgagtatttggctttgtatcttctaacaaagaaacactacttgggctttcaagatctggttacggtttgagtttttatactcaatcatacacatgcaatctagtcatattggactccaaaaaactaactaagcttcttttggcttcctaaggctttgatggggatgtcgaagttcgtatgagtctttggctttgtatcttctagcatggaaacactacttttccttttcagatccgtttgcggttcaagttctaatattcaaccacagacaggacatcaatttatatttaactccaaaacataaaccaagatttttcaaagctttgatggtgtagccgaagtccgtatgagtcattggcgttgtatcttctaacaaagaaacactacttgggctttcaagatccagttgcggttcgagttcttgtactcaatcatacacatgccatctaggcatatttgactccaaaactaaccaagcttcttcttgcctctcaaagctttaatggtgtaaccaaagtccgtatgaatgtctggctttgtatctgttggagtaagcttgagtattacttaagaaataagttatttagttttgagaaggattagattaaatctttgggagttatctaaagatattattaggagttatctaatattaatctaaatgtttattctagaattatctattgatctctatataagagttaccaaagttgtggttaaccttatcgttttttagagattgtgaagagatcaatagctttaggttttgagtaattttcctaaagagattaaagagagttattctttactttgagttcttaaacacatctctaaactacaattggtatcagagcttacaaatcttgagaccataaagaagaatttgtaaggagaagatatgagcaaaatagttacgtcgggaacgaaaccaaaagaaggaggaggaacttcttcgatccaatgccctatgctaactcaaacaaattacacggcatgggctatgaagatggagattgctcttcaagtacacaaagtctgggaagctattgaaacagagtcaacagaacccgttgatgcagacaagaacatcatggctatagctttaatgattcaatccatacccgaatccctagctttgcaaattggagaatttaaagtagcaaagaaggtttgggaagctattcggtcgaggaacgtgggagcagaacgagttagagaagcgagactacagactctaatgaatgactttgatcgcttgaagatgaaggatattgagaagattgatgattttgtaggaaagttagcagaaattgcatccaaatctgcagctttaggagttcaaatcgaagaaccaaaactagtgaagaagtttctctcaagtctgcctcgaaagaaattcattcacatagttgcatcactcgaacaagttcttgatcttaacacaaacggatttgaagacattgtaggacgaatgaaagtatatgaagaacgagtggtagatgatgaagaaccacaagaagatcaaagcaagttgttgtatactaatcaagattaccaaacaaatcaagagtacaacaactgctacagaggaagaggtcgaggaggacgctcttattacagaggaagaggacaaggaaggtcgaatggtggaagagatacatccaaagtaacttgctatagatgtgacaaattaggtcactacgcctctgactgcccgaatcgtcttttcaagttgcaggaagcccaagagaacgagaaagacgatacacaaactgcagatgaactcatggttcacgaagttgtgtatctaaatgagaagaattgtattccaagcaactatgaaactaacaatggagagaatgatgtttggtatctcgataacggagcaagtaaccacatgacaggagatcaaagatacttcactagtatagataattctatcaccgggaaagtacgctttggcgatgattcacggattgatatcaaagggaaaggaacgatctcgttttttgacaggaatggcgaacaaagaaaaatgtcagatgtctatttcattccagatttaaaaagcaacatcattagcttgggacaagctagagaatcaggctgtgacataagaatgaaggatgacattctaacaatgcatgaccgagagggaaaattacttgtcaaagcaacaagatcaaagaatcgacttaataaggttcggatggcaaaaagaggaacaatgtgtctatatctaacaaacctcagcgaatcaagtagatggcattcaagattgggacacataaatctcgacacaatcaagtcaatgatacaaaaggagctagtaagagggatcccacacgttaagatcgaaaaagaagtttgtgattcatgtttgtttgggaagcaatcaaggcaatttttcccgcaagcaacctcatacagagccaccaagatacttgaactcgttcatggagacttatgtggtcctataacaccaagcacagctgcaggaaacaggtacatctttgtcattattgatgatcattctagatacatgtggacaactctacttaaggagaaaagtgatgctctcaataaattcaagcgcttcaaggtcttagttgaacaagaatctggaagcaaaattcagactttcagaatagacagaggaggagagtttgtatcacatgagttcactaagttttgtgaagaatcgggtattaaaagacatcttactgctccatatacaccacaacagaatggtgtatttgaaagaagaaacagaactctaatggaaatgacaaggagtgtcatgaaacacatgcatatacctagttacttatggggagaaacagtatgacacgccacctacctgctgaaccggatagctacaagatcgttgaatgacaacactccatatgaagctttctaccaaaagaaaccaaacgtgaatcatctcacagtatttggctgcattggatacgcagaagtggagacaccacacttgaggaaactagatgacaggtcgagaaagctagttcatctaggtactgagccgggttcaaaggcatatcgtctacttgacccagtaaatcggaaaattgtggtgagtagagatgttgtattcgatgaagaaaaaggatgggattggaatcacaacgaacctaaacaagatggaagcttcagtgtcacacttggagaattcgggaatcatggtctacaagaagaagacaacgaatatggtgagacagagcaaacacagcctattcacgtgaatgaagaacaacatgatcatgaaacctttgcagaaaatgaagaagtctctgctgatcttggaacagaaagtcaacaacctaatctaagaagatcgcaaagacaaaccataagaccaaagtaccttgaagactatgcattacttgtagaagaagaaggagaaaggctacttctaatattgaataacgaaccgagcagtttcagtgaggctaaggagtccagagagtggacacttgcgtgtgaagaagagatgttttcaataacaaagaataagacatggagtcttgaagatctgccgcatggagttaaacgtataggtctaaagtgggtttttaaactcaaacgcaactcggacgggagcatcaacaaatacaaggctcgattggtcgcgaaaggttacgttttggcgctatggagtggactttgaagaagtgttcgctcccgtagctcgccttgaaaccaaacgactacttgtgaaccttgcagcatcaaatggttgggagatacaccatcttgatgtcaagacagcatttctccttggagaactaagagaaaccgtgtatgtgacacaaccagaaggattcgaagaaagaggataggaagggaaagtctataggcttcacaaagctttgtatggattacgacaagcaccgagagcatggaaccataagctgaatcagattcttacagaactacaattcgagaagtgttccaaagaaccatcagtatatcgtaaaactgtaagtgggaatatttttcttcttgtggtagtgtacgtagatgaccttttcataaccggaacagatgaaagaagtattagtggattcaagagagagatggcttctaagttcgagatgagtgatcttggaaaattgacgtactatcttggaatagaagtctgtcaacaagagcaaggaatcacactaagtcaacaccgatatgcaatgaagattttagaagacgctgggatgaaggactgtaacttgatgcacataccaatggaatctggtttgcaattgtccaaatcacatcatgaagaaggaattgatgctaccggatacaggaaaaaagttggttgccttcgctatttaattcatacaagaccggatctgtccttttgcgtgggagtgttaagtcgatacatgcaagatccaaatgaatcacatggtgctgcaatgagacaatgtttgaggtacttgaaaggtacgactacactcggtttggtatttaaacgatcaagtgaaaagataccaaagctagtaggctatagtgacagcaaccacaatgttgatcctgatgatggcaagagtacagccggtcacatttcctaccttggagagagtcccatctcgtggtgttcacagaaacaagaaacaatggcaatgtcctcatgtgaagcagagtttatggcaggaacagaagcagctaggcaagcaatttggcttcaagacttgcttagtgaagttataggagaaccaagcgagaaggtgctcataagaatcgacaacaaatcagcaatcgcccttaccaagaatccggtcttccatggctgaagcaagcacattcataggcgttaccacttcataagagaatgcgtcgaaaatggacaagtggaagtagagcatgttccggggaatgagcaaaaggcagacatcctaactaaagcacttgggagaatgaagtttaaagagatgagagatcttatgggtgttcaagaagtgaagaggagtgatctcaagcttaaaggggagattgttggagtaagcttgagtattacttaagaaataagttatttagttttgagaaggattagattaaatctttgggagttatctgatagtagttttttatggtcaattatcctaaaacaccaatcatgtcgttgtagtattttaggtgtcaatccaaatgggtgtgatgcaaacagatgagatgtgatcaaaagtcactaagtcaagccaagcaataacagttttggggtttctaacagtcctaagcgaacatgcagaaaacagaaacaataatagaattactaaaatcactcgaccacaacaggctgatgccagaagtaggatgtggtcgagtaacagacaggatatgaaacagatatacttgactgcatagtctgttgccagacactgggtgtggtcgagtattctggtcgagtaacagacaggaaatgagacaactgtactcgactgcacagtctgttaccagacactgggtgtggtcaagtaagttgatcgagtaattgcaaaaacgaagaaacaggcaatgagaacgaataagcgataacgataaaacagagaaatcagatagacgagaaattcctaaggatggggtaatcgaatagagtggtatcctagcctatccgaatggttaacaagcgcaatcaaggtatccctagacaacaggttcaacaacagatcaattcactcccttgatagaaatcctcaagcaaagctagcccagactaattcccattaacggaatctaattatgcaggcaataagaacagactgataaagtcaataaacgctctaaacggccaatcccttgggatagagacgaatatctcaggaactagtggatcaagcattccatagaacaccttctgggtgcgggaatgcttgggatcgaattccagttgattagaaagaaataagcagtaaacacaactagtcctgaagggattcaatcaattctaagacttaaccattctacagactacggattccacaactactctaacccatccttaagaattctgagtcactactctgacaacatgcttaaagacaataacatagaaacgaaagatgaacaagcaaatgaaagcaaaatctgaatgacttagaagaaaaatcgaaatataaaattgcaggaatgaaaagcggctgctgaataatagtgcaaaattcgtgtctctaaaagtgcatgtcccagggcgaaacccttagagacttatttatactaaaataagaaagcgggcttcgagcccacttaacggcccatgaacggcgtgatcaagagtgtcggctcaaagtgggcttcttgatgggcttcgaatgggtttcgaatgggcttcgaatgggccttctcttctcttctcttttcgatgctcaggttgtctggttgagtgcggattgataagagggtcaaggtggtggtcgagtaggttggttgacagaatgatctgggctgcttcttggcctctgtgatcgagtaagtgtgtcagcagtcaggatgtactggttcttcacctctacgatcgagtataactggtggactggcaaagtggactgcatggtcgcctctgcgatagagtagaattgtagaatggattgcctcctctcctctgcggtcgagtatatctggcagaatggactgcctagtctcctctatgatcgagtagaagtgtctggatggactgcttagctgactacttccctctcagctactggtgatcgagtatgtttggtggaagtgtgactttctgttctgttttccctctttctgagcaccaatagctccaaaacacctgaaacaactccagaatgtagaatgtatgcaagattagtcctagactcgactaaagatgcaaaatgtacgaaaatgatggtgaatgctatgaaagatggatgaaactagactcaaaatggtgattaaaggatgtgtaaaacatgcaaattatacacatatcaactcctccaaacttagtctttgcttgccctcaagcaaacaagtagacataagctgaaggagaggtttgaaggtggggattcagaaccaaagcatcaaataaatcagatagaatcaatgtccaagttggcagttctaggatgccatattatcgaactctactcaaaaacgttagccatgccttattatagttcaatcccactcttatactcgacctacacatgctttcaaatctaccaatccctttaacattcattagattaggaacgtgaatcaagctatgcatcatcaatgaactcatttggctaaggtgaaggtcaagagacacagatggtccctttctggtggttcaagtttagtaacaggggactctgaaaagaaatggactgagctttaggagaatgctaaaggtaagagccaacctatgcatacaagaatagtatcccatctacccaaaaacatacacagtgtatacaccagcagatggtactacccttaagcccagaatatgatcctagttctaccctttgcactcaaggcatttttttctcattcttatcttggatcaaaccactctttcttttctttgactcttattctaaggagaagtttcttttactttgttggatctagtggactttggttttctttgacaactatggctcatgttatcttcttgtgatcaagacttttctagactttttttcttttgttgtgagcctattttttttttagttccccaaaatccattactagactaacttgtttctcaacttccttctcctaagaacatcaacatttcctttctctcttattttctcatatactcgatccccacttcaagaatagacacccaccttgtcctatctagcccagaaaacgtggactagaactacatgagacactactcttgtcggctcaaacctaacactttcttccaagctcaatcctgaaacaggcctcacaatcgcacacgatatataacagggctcgaaagaaaggtttggttaagggcaagggaaactacttcaatgatggaagcagctacttgggttagcaagggtggtgaaaagtttaaagaaaacccaagtatgtatatggtatccatgagttcaaattcgatgctaagacatgataattgcaagtcagattcaggttcaaattgatagggaatggtatcagataataacagtgtgatcgagtagagcattcaagacatggtgcagttttacttcaatttcattgactacacatcagacaactagaaacgatgaacaaaaatgcttacaaggctatctcatcataatccccaatgcatatgcgacaatcctatatgaaacatcctagactcaatcctaaatgtgatgcaactatatgaacactctgtttttgtggaatacattttcagaaatgttttcattttttttttattttttttctatgtcttagatgaagttaagactcaaatgatgcaaataagactcactagcaaacatgttaaatacttcttgaatcctcccccaaacttaaactatacagtcccttgtgtaatagaagtctaaagaagagttcaagagacactaaaacaaaacgaaaacagaaaatggtatatacaatgatggttgtgtgtgccatctcctctctggtgtaatcccatggaatactgggaccttgttgttgttcctcctcctctggtgcatgatactcgatcgcagggttcacatgacgtttggtccgacggtcgagtatattggtctgagaaatggtctaaagtgtcgccttggtgatcgagtgaaaacgggcagttgggatgcctccatggtcgagtaaacttggtgacctgtagatgttaactcggcttcgagcccacttaacggcccatggacggcgtgatcaagagtgtcggctcaaagtgggcttcctgatgggctttgaatgggtttcgaatgggccttctcttctcttctcttctctttccgatgctcaggttatctggttgagtgcggattgatcagagggtcgaggtggtggtcgagtaggttggttgacagaatgatctgggctgcttcttggcctctgtgatcgagtaagtgtgtcagctgtcaggatgtactggttcttctcctctgcgatcgagtataactggtggactggcaaagtggactgcatggttgcctctgcgatagagtagaattgcagaatggactgcctcctctcctctacggtcgagtatatctggcagaatggactgcctggtctcctctgtgatcgagtagaagtgtctggatggactactgagctgactgcttccctctctgctactggtgatcgagtatgtttggtggaagtgtgactttctgttttgttttccctctttctgagcaccaatagctccaaaacacctgaaacaactccagaatgcagaatgtatgcaagactagtcctagactcgacttaagatgcaaaatgtatgaaaatgatggtgaatgctgataagtgtgtattttgcatgttttgagcatccatttgtcatcactttagcatcatatcatcactgttttatacaatttctcatcatttgtcatcactttacaatttttggatagatttgcatgcatgttgcatatttgcgttgatttcaggtgatttggagctgttgacaagctatctggaagaagcgggcctgatcatatcaaacgacttgaccccgaggtcgattaggagcttcaagatctcaacagatcactcgaccccctggtcgagtagaggacatcactacttcaccacatcactcgaccacgaggtcgagtgtcttcatcccatcacctgaccatcactcgatcacgtcactcgaccctgaggccgagtgtcttcaccttcattgccagaccactacttgacctcttcactctacgtggaagtcgagtatcaccatcaccaccactcgactacatactcgatgacaagcttcagagccttcttcattccgcactcaaccagacactcgagcacaaggaagaaaagaagactccagctattcactcgacctcccactcgaccacatgggtcgagtacagttcttaatccgtcccaatactgcgtcgttttaagtattagggtttcggaatatttggctgtaagtagcatgtacttcacattttggcagacaagtttttatctagttttattccgtagaccttgtgttctagaccttttgtaatccagatttctctttatctatttagtattcagtattcagcttttgttcttgatttcgtttactgttgttcattctgttatcatcttgttgttacacagttgttatcatgttttcaacttgttcaacgtttatgcttactgttatgatgtctgagtagtgaataggtttctgaggatgggttagagtagtgtagaattctcaatatgctaggtgattgagtattggttgatatatcccttctggattagttgttcttaatccctattgctttctgatcaactggaatttgagcccagacatttccgcgcccaaaaggtgttcgatgaaatgtctgaaccactaattccagagtttcgtgaccctgtaccaaggtattggttgcaaggagcgttttggctttaacttgttgattcgtaatgcctgttaggttatctctcgtcaatggtgattgagtctgggactaggttaacttgagagtctctgttgcggtggcacttagatttggttaatgaacttgttgtctagggttaatttattgagcatgtcaatcacctgtaaactgaggaaacgaaactactcaattaccccatcctcaggaattctttatctgattgaattctgtgtttactccactgttatttactgcatcttgttatctgtcgcgtaatttctgcagttctttcttgttactcgaccacccaattgtctggtaacagactgtgcagtcgagtatctgtattttattttctgtctgttactcgacctgtcactcgacctcacccagtgctctgcaaagagctgtgttggtcgagtgttttactgtttctgcttgaatttctattttctccatgttcacttagaactgctagaacacaccacaacctgttattgcttggcttgacttagtgacttctgatcacatcttgattgttagcatcacacccatttggattgacaaccttcagtattacaacgacatgatagtgctttaggtttaattaattaaaaacctattatcaaatgctatgaaagatggatgaaactagactcaaaatggtgataaaaagatgtgtaaaacatgcaaattatagacatatcattacctaaagatattattaggagttatctaatattaatctaaatgtttattctagaattatctattgatctctatataagagttaccaaagttgtggttaaccttatgggtttttagagattgtgaagagatcaatagctttaggttttgagtaattttcctaaagagattaaagagagttattctttactttgagttcttaaacacatctctaaactagaaacacatctctaaactagagtatcttctaaaaaagaaatactacttaggcttttaagatccggttgcggttctacttcttatacccaatcaaaaacatgaaatcaagtcatatttgattccaaaaaactaaccaagcttcttctttcttctcaaagcattgttggtgtagctgaagtccgtatgagtctttggctttgtatcttctaacaaggaaacactacttaggattttaagatcgggttacagttctagtttttatactcaatcatacacatgaaatctagtcatatttgactccaaaacactaaccaagcttcttcttgattcccaacgctttaatagtgttaccaaagtccacaacaatctttagctttgtatcttctaacaaagaaacactactttgggttttaagatccggttgtggttctagttatactcaatcatacacatgacatcaagtcatatttgactctaaaacactaactaagcttcttcttgcttcacaaagctttgatggtgtagctaaagtccgcatgatttattggctttgtatcttctaacaaggaaacactacttaggcttttaagatccggttgtggttctagttcttatactcaataatacacatgacatcaagtcatatttgactctaaaacactaactaagcctcttcttgcttttcaaagctttgatagtgtagccaaagtccgtatgagtatttggctttgtatcttctaacaaacaaacactagttgggctttcaagatccggttgcgatttgagtttttatactcaatcatacacatgtcatctagtcatatttgactccaaaaagctaaccaagcttcttctggcttcctaaggcgttgatggtgatgtcgaagtccgtatgagtctttggctttgtatcttctcgcatggaaactctacttttccttttcggatccgtttgcggttcaagttctaatactcaaccatagacatgacatcaatttatatctaactccaaaacacaaaccaagattcttgttccttctcaaagatttgatggtgtagccgaaatccgtatgagtcattggcgttgtatcttctaacaaggaaacactacttgggctttcaagatccagttgcggttcgagttcttgtactcaatcatacacatgacatctaggcatatttgactccaaaacaataaccaagctttttcttgcttctcaaagctttaatggtgtaaccaaagtccgtatgaatgtttggctttgtatcttctaaaaaacaaatactacttaggcttttaagatccggttgcggttctagttcttatacccaatcatacacatgacatcaagtcatatttgactcgaaaacactaaccaagtttcttcttgcttcgcaaagctttgttggtgtagctgaagtccgtatgagtttttggatttgtatcttctaacaaggaaacactaactaggcttttaagatcgggttgcagttccagtttttatactcaatcatacacatgacatctagtcatatttgactccaaaacactaacaaagcttcttcttgcttcacaaagctttaatggtgtaaccaaagtccgtatgaatgtttggctttgtatcttctaaatactacttaggcttttaagatccggttgcggttctagttcttatacccaatcatacacatgacatcaagtcatatttgactcgaaaacactaaccaagtttcttcttgcttctcaaagctttgttggtgtagctgaagtccgtatgagtctttggctttgtatcttctaaaagggaaacactaactaggttttaagatcgggttgcagttccagtttttatactcaatcatacacatgacatctagtcatatttgactccaaaacactaaccaagcttcttattgattctcaacgctttaatagtattaccaaagtccacatgagtctttagctttgtatcttctaacaaggaaacactaatttgggttttaagatccggttgtggttctagttcgtatactcaatcatacacatgacatcaagtcatatttgactctaaaacactaactaagcttcttcttgcttcacaaagctttgatggtgtagctaaagtccgtatgattcattggcttgtatcttctaacaaggaaacactacttaggctttaaagatccgattgcaattcttgtcctgatactccatcatacacatgacatcaagtcatatttgactccaaaacaataaccaggcttcttcttgcttcccaaagttttgatggtgtacccaaagtccgtatgagtctttgtctttgtaccttctaataaggaaacactacttggactttcaagatccggttgcggttcgagttcttatactcaatcatacacatgtcatctagtcatatttgtctccaaaacaataaccaagcttcttcatgcttcctaaggctttgatggtgatgtcgaagtccttatgaatcttttgctttgtatcttctagcatggaaacactactttaaattttgggataagtttctgataataggtttttatggtcaattatcctaaaacaccaatcatgtcattgtagtattttaggtgtcaatccaaatgggtgtgatgcagacaaatgagatgtgatgagaagtcactaagtcaagccaatcaataacggttttggggtttctaacagtcctaagtgaacatgtagaaaacagaaacaataacagaattactaaaatcactcgaccacaacaggctgatgccaggagtaggatgtggtcgagtaacaggcaggatatgaaacagatatactcgactgcacagtctgttgccagacactaggtgtggtcgagtatactggtcgagtaacaaacaggaaatgaaacaactgcactccactgcacagtctgttgccagacactgggtgtggtcgagtatgttggtcgagtaattacaaaaactaagaaacaggcaatgagaacgattaagcgataacgataaaacagagaaataagatagacaagaaactcctaaggatggggtaatcgagtagagtggtatcctagcctattagaatggttaacaagcgcaatcaagctatccctagacaacaggttcaacaacagattaattcactcccgtgatagaaatcctcaagcaaagctagcctagactaattcccattaacggaatctaactatgcaagcaataagaacagactgataaagtcaataaacgctctaaacggccaatcccttgggatagagacgcatatctcaggaactagtggatcaagcattccatcgaacaccttctgggtgcgggaatgcttgggatcgaattccagttgatcagaaaaaaataagcagtaaacacaactagttctaaagggatacaatcaattctaaaacttaaccattctacagactacggattccacaactactctatcccatccctaataattctaagtcactactcagacaacatgcttaaagacataaacgcaggtaaacgataatattgcataagtaaagagataaagagtatagaaacaagatgacagatgaaatcaaaagcggaatctgaataacttggaaaagtctcgaattacaggttgtagaagcaaaagcggcgcagcaaagtaaaacagaaataaaactgaagcaaaaactcaatgtcgactggatgtctcaggacagaaccctaagacatctattaatacaaaacaaaataaaatgatggtaaacaggccaataacctaattacccggcccatagaaagataatgggccgagatgggcttcgtgatccgatggaggtccaagccgcttctaaacactttgtcttctcctcttctcttccttgtgctcagcttgtctggttgagtgcggatttgagtagactgtgaagacgtgatcgagtgtccggtcgagtgatggtgatggtgtggcgaagtgatactcgaccatggggtcgagtgatgtggtagagtgaacggtcgagtgttgtcaggtggtgtggcgaagtgatactcgaccatggggtcgagtgatgtggtagagtgaacggtcgagtgttgtcaggtggtgtggcgaagtgatactcgaccaggggatcgagtagtgtcattgagtagcctgagctgaggatactcgaccaagtggtcgagtaggtgggaagaatgactccaaagtcactcgacctgggggtcgagtatgtcttctggttctggctcgtttcttccaatttgctcgcaaacagctccaaatcacctgaaaacaactcagaaatgcaatatgtatgcaaagttatcctaatcatgcaaagtatgcaagaatgatgagaaatgatataaaatagtgatgaatgatacgaaactggactcaaaacgatgatgaatggacactgaaaacatgcaaattatagacatatcaactcccccaaacttagtctttgcttgccctcaagcaaataagaagacatagttgaaggagaggtttgaaggcggggactcagaaccaaagcatatgttagagcaaataaaatcaatgtccaaattggtagttctaagatgcgatatgattgaattttactcaaaaacgttagccatgccttgttatcaatcaatccgtctcttatactcgacctacacatgctttcaaatctaccaatccctttaacattcattagttctggaacgtgaatcaagcaatgcatcatcaatgaactcatttggctaaggtgaaggtcaagagacaaagatggtcccttacagaataggcttaagtaacaggggatccctcaagaatgattgagctttagtagaatgctaaaggtaagtcccaagttatgcatacagagataagatcccatctacccagagtatagcaatgaagttctaatggtaatcccaactcctgtcccaacttaactctaccatttgcactcatgaatctttcaaactctttttcatatcattcttttattttctcttaactctaggagaagctttctcaacactctgatacatctagcggatttggatttctttaacaactaaggttcctgttttaaatctttaaaaccaaaggcttttaacccttcttctttagctaacaagaacctcattcttttctttaacattcccaaaacctttactagatttttttctaacttctttagcttacttcccctagaattctttccctttccttatcaacaataaattcacccttttcttttaaagacatcccaacccatgatataagcgcccacctagtcctatccagtccgaagaacgcgaactagaactacatgagacactatctctgtcgttacgaagctaacactttttaccaagctcaatcgaaataagacctcacaaacactcacaagtgatatagggcttgaaagaaagttcatgtttgggttcgggttaactgctctaataaggagagtcagctatttggatcaacaagagtggttaaaaggagtaagaaaatccaagtattttagggtatccatgagttcaaattcgatgccaagacatgataattctaaatcagattcaagttcaaattgatagggaatgatatcagatcctaacagtgtggtcgagtagagcaatctaggcatggtgcagttttacttcaatttcaatgacaacgcatcaaacaactaacaacgagggcactgagcttatctggtgaaccaaaatgcttacaaggctatctcatcattatcccctatgcatatgcaacaatcctaaacgaaacactctagactcgatcctaaatgcaatgcaactacatgaacactctatttttgtgaaatcattttctgaaatttttcaatttttttggttcttttctatgccttagatgaatgcagactcaagattatatacaatgcaatacacactttctgagccctcccccaaacttaaatcacacagtccactgtgtgaccaaatttggaagagagtacttaggacaaaacacatcacaaaaacaaaataaaaacaagagatggtatattacaatggtggagtgaggtgcatacctcagtggaagaaggagcgaagttggtcgccaatagctgcctgtgattgctcccaggccatcgaagaatctccctgctgtgtctcagcttccccctgggggtactcgacctctgctccttcgtcgcggccagcaccgctctgatgatactcgacctctcttcttctgctgcggccagcaccgcggtcgcgtaagctacgggactggagaagtcgtgtactcctgctgccagaccgagcgagtgcagccttcttctttctcccgagctcccgaggctcgaatgatgaatgccttgcagggactggtgggactactcggtcactaggctcaggcttgtggtgacttggctcaggcctgtgatgacttggccctggcgcgtcatatctcctcgaaggcatgtcctgaggacgctctccctgcggaatagctgtggtagaagagaagcagctaagcttgtctgtcagaaacgtgatggctttgaagcacttgatgagtagcctatcttgtttcttgcaccacctctgcaacttactgttgtttctgtgagcttcactcaagctcttgctctcccgcgctggaggtacgtgctctctgaaatgatacatgctcgtatcgtactcctcctccctatcctcatccgtctcagcaatatcatcctctatagcttccgtcgtagggacattatcatcagtcggtggagcgctctcaaagtagaggtaatcacgtgcaggtttgaagtcaatgttcctaccctgaagtatggtcgtggcctcgatgcagggaagcaaaatgttggctgttcggatcagggagtgctcgaatttgtagcgatagaaatcgccaaccatatcatactccagaaactcacaacaacgcaagtgatctaaatccatcatcctcggatcaaaccttggagacgtgagaggtacaccacatgcaatcagaatcggtgtcacaacgccacctacacaaagggctcctcgcaccttcttcttcccgttggtgtgcgcccacttcctgtatccacataggtggatcaacagaagcataaccggtggtgcatcattaaggtcgccctttaggaccttcttcccctttgttctccggagaatgcccttgagtggagaatcaatcatctccatgtctgtgttaaacacggtgcctgtagattccctggggtacagaacattcgctactgagcgctgatagtagcggatcacagggctacgaatctggttgctcttagaccttgcaaagttgagcgccaaatcgttcccaatggttaaccacaaatccttcaactcttccctctcgaacttgggtttagttccctttccactgggaaaaccaaataatccttccaagctcttgatagatagctggtaacgctgctcgttcactgaaaaagtcaagaaccccaacccttcactctccagctcatctgctgtaagtccctgatacatctccacttgcagagtgaagagaaactctattgtttccttcttgtaagcgacgtacgggtaagacatcagcgtctccagatggcacttctcgaataagtgatgtacgtcctccagtagccccagctatgctaaagtctcataacaggggtacctcgttccccagaagtcgttcatcaggcttgttcaacagcttcgtttctctgtgccatgactcaggctcatactcgacgtcaatatcttcgtcgatcaactcatatctgctggtcattgctctctttctctagcaatctcagctctcttctcattgcgtcgagctactgagcgttgggtctcagctctaaagctctcataagcctgtcgctctctctctggtccagttgaccaagattcagcttcatcgacgttgtaatctgcatccatggaggattcgccactgtagttactcatattgatttcctgaaaaataatgtaacttaaaaccaaatatcaatatgttagtccaaataaacacaaacactaaaccaatcaagttcacggtcgagtaaccggtcgagtatagtcaaattgtgtgttcaaattttgtggtcgagtggaagagaatgagaaacggtgactgtgtggccgagtaaatgtcgaatggagagaagacggtggcggtttgaggagcggtcgagtgaagagatgaacggaggcgaagtgaatggcgaggtcgagtgaacggtgagaacggagagttgagagaaagagatcgaagtagaggctgaggtgctcttgcggtcgagtgaatgggaggcgagatcgagtgaggaatgttgaagttggagcggcgagatcgagtgaaaaggaggcgacggtgagagtccggcggagtgaagggcggagtggtcgagtgaacgacgagaagctccggcgaagtcgagttagcttgcgagaacgagagagagaaactctggccgtttatcgaaaatcgaatgaagagcctctttgtccaaattgcgatgcggtcgagtgaaagaagtcgagtagcggttgagtgaagatgaaacctgtcccgtcgtcgagtgaatgagagagagagggcggaggcgtgagcagtgagagctgggacgacgaggtcgagaaagcggcggatggagaggagggcgttgcaatcgagtaaatgggaggcggtgcgagagatgacgagtgaggtttggtcgagtgagagggtgacaaagcagcgagagatggtgaagccggaggggagagatcgagtgaacggtgaggtcgagtgtgatggtgcggtcaagtgcttggagaggaagagagatggtgaggtttggtcgagtgagaaacgtgaggtagagtgaatcttcttggtcgagtgtttggagagggagagagatgatgtcggtgggagaggatagggatagagtgagatcgagtggttgggaaagagggaagagattttgttatctctaaaaacgcgtgggggaacaaaggtgagaggtggttggccacgctctgtctgtttgtcctgaagcgctgttctctgttgactagaaccttctgtaatcctctgtaaacttgttaaactccctgcaagtctctgtagcttctgttggtcgagtatagatatgatttaaaaattttgggtttttttaaaatcatcactaatactcgaccaaacttactcgacctcatggcctcttagtgcaacaaaagtttttcaaactcttgaatttctgacatactcgttctcctgttgctctgtagagtaaaatttttaaatttttactctacctccacgctgtttctctgttcctgagaatcacaaacacaaccaaaaacaaatcaaaaataacaagaaaataaaagttttatttacagaaacagtcttgggaattcctcccaagtgagcttgtttaaagtctctagcttgactcctcacactcattaagaagaaaatgggtgatagagaggatcttcatagtcctctctgatctcatcatcatattcagcatcctctcttgagagatgagtagcagaatactcaattcttctttcctcgaaataggcctctttctcttctggtggataatctatctccttagaccatcttgaagtaatcttttttctcgggatagtgttattcccgcatttggattgagctatctcttgcatatgatccagtttactcttaagttcctcaactgtctgagctagcttctctatggtctcttcttgctcatcagatttctttttgagatctcgcaagttaggtgtagaggctgtgcttggtctggtgattgaattcgaacgttgaggttgagccctgatcttttcttctacagctgacctttgcgaagtttcgttgatgtcaaactgcatcttgatgtgcttcccaaggttaagacttattctcccatctctgacatctatcatcgcttccactgaggctaagaaaggtcttcctaggattagaggatccttaggttctgcttccatatcaagaacaacgaaatccgtaggcacttccactccattaatcattactggcagatcttgtagaaggtcaaagggttttcttgaagacctatcagcaaggatcaaagtcaggtcgcaaggcctgtactgagtgaattccagcttccttgccacggagagtggcattaagcttactgaagctcccaaatcacaaagacaatggctgaaaaccaattgaccaatgaaacatggtagagtgaaagttcctggatcttcctgtttttcttgaacactcctcttagcagtggtcctaaacggaatagcatcacattcgtcttctgaatcttgatgaatcttgatcctttccagaattgactttctcacatctttgtgaggatccgggattaggttgagaacttctattagaggcatcaccgcttccatctcatcaagccgtttccatctcatcaagctgcttctctgcaagagaattgtatctttctatacatgctttcctgaattttctatggaagagcacgtgaaggtaatggtgctggcttgaatcgttttaccatcctctcaatgatggctgctttctcgtctaggttggactcggtttgaaaacgggatccagctgaatggtcgagtccaaccactgaaatttcaatctgagtagaagcctccccgtcctgaacatcactgtcctcggtgattgatgtggaaacatgtcgagtaggcagctctcgatcatgacagatggtgatagcgtgagcggtggcgtattccttcgggttctgtattgactttcctggaagtcctgttacttttggagcagaagttgacgctgtttgtccttccatgtatctgaccttagaggtaagtgcctcaagtttgatattcagatcattgaaagtacaatcaaccttgttgtggatttttgccatctttttggcaagatccattgcacctgcagcttgtccctagagaatctgctgtaacatgttcttcaagtctgaatctggagttgttgaagctagttgttgttgctggtgtgtgaacctaggtggtggaagttgctgctgatagttgccctgatactgcggcttaggaacatacccctgaccttggttgtatgaacaaagggcttgggttgattttgctgctgtgaagggtagacttggtcatgcgggtttgcaacatttgtactcctgtaagacagatttggatggctctgcttgaagttgttgaaacctttgttgtaacctccttggttctgcacatagctgacctccttggttctgcacttggactgtctcatcatcacccagaaaatgaatgtgcttttgttgcacaaggagtagcttgtccagtttgtcattcatggctttcatttccctgcggtgcttctcatcagaatcagagctggtgcggatgcttctgtcataatcttcattatagttgccatccgactgagctaagttctctaccagctctcatccttcttcaacgtctttgttgaggaagttcccgttggaagcggtatcaagaagcattctgatcttgggaaggacacctctatagagagtgctgagaagtgaagctttggagaaaccatgatgaggacattgcgtctgataacctttgaagcgctcccatgcttcacagaaagtctcattattcgtttgagtgaaactggagatatcattccttagtctcgcagtcctggagtttgagaaaaacttagccaagaaggctttcttgcagtcattccaggaggtgatagagccttgaggaagtgacttttcccactgatgtgctttgtctccaagagagaatggaaacaatctgagcttgaaaccatcctcactaactccattgatctttgttaggctgtagagcctatcaaactcgtccaggtgatcgagtggatcctccatagggaggccgtggaacttgttgctctgaaccatggcaatgagaccgctcttgatctcaaagttgttgttctgcacaggtggaggcacgatgccattacgctgattctggttgcgtggtgcatcgcctgcacctatgttgtttggttgcacctgctcatcaacaactgcagccattgtctctgtttctgtctgtgttctgagttggcgtgcaatacggtcgatgttatcgttgaacaggagattctgatttcctcgtgaccgtatttgcatacaacgagtaccaacttgtaaagctggtatcgtagtacctaaatcaaaacagacaaacagaaaaaacacaaagttagtaactttcagaaaaaatgaaaaagataacagcgccaaattgataataggtttttatggtcaattatcctaaaacacctatcatgtcattgtagtattttaggtgtcaatccaaatgggtgtgatgcagacaaatgagatgtgatcagaagtcactaagtcaagccaagcaataacagttttggggtttctaacagtcctaagtgaacatgcagaaaacagaaagaataacagaattactaaaatcactcgaccacaacaggctaatgccaggagtaggatgtggtcgagtaacaggcaggatatgaaacagatatactcgactgcacagtctgttgctagacactgggtgtggtcgagtatactggtcgagtaacagacaggaaatgaaacaactgcactcgactgcacagtctgttgccagacactgggtgtggtcgagtaagttggtcgagtaattgcaaaaactaagaaacaggcaatgacaacgattaagcgataacaataaaacagagaaataagatagacgagaaattcctaaggatagggtaatcgagtagagtggtatcctagcctattcgaatggttaacaagcgcaatcaagctatccctagacaacaggttcaacaacagattaattcactcccgtgatagaaatcctcaagcaaagctagcccagactaattcccattaacggaatctaactatgcaggcaataagaacagacttataaagtcaataaacgctctaatcggccaatcccttgggatagagacgaatatctcaggaactagtcgatcgaacattccatcgaacaccttctgggtgcgggaatgcttgggttgaattccagttgatcataaagaaataagcagtaaacgcaactagtcctgaagggattcaatcaattctaaaacttaaccattctacagactacggattccacaactactctatcccatccctaagaattctaagtcactactcagacaaaatgcttaaagacataaacgcaggtaaacgataatattgcataagtaaagagataaagagtatagaaacaagatgacagatgaaatcaaatgcggaatctgaataacttggaaaaatctcgaattacaggttgcagaagcaaaagcggcgcagcagagtaaaacagaaaataaaactgaagcaaaaactcaatgtcgactggatgtctcaggacagaaccctaagacatctatttatacaaaacaaaataaaatgatggtaaacgggccaataacctaattacccggcccatagaaagataatgggccgagacgggcttcgtgatccgatggaggtccaggccgcttccaaacactttgtcttctcctcttctcttccttgtgctcagcttgtctggttgagtgcggatttgagtagactgtgaagacgtgatcgagtgtccggtcgagtgatggtgatggtgtggcgaagtgatactcgaccatggggtcgagtgatgtggtagagtgaacggtcgagtgttgtaaggtggtgtggcgaagtgatactcgaccatggggtcgagtgatgtggtagagtgaacggtcgagtgttgtcaagtggtcgagtaggtgggaagaatggctccgaagtcactcgacctgggggtcgagtatgtcttctggttccggctcgtttcttccaatttgctcgcaaacagctccaaatcacctaaaacaactcataaatgcaatatgtatgcaaagctatcctaatcatgcaaagtatgcaagaatgataagaaatgatataaaacagtgatgaatgatacgaaactggactcaaaacgatgatgaatggacactgaaaacatgcaaattatagacatatcagtttccatttctagtccaaatacttaaccatacacatgacatcaagtcatatttgactctaaaacactaactaagcctcttcttgcttctcaaagctttgatagtgtagctgaaattcgtatgagtcattggctttgtatgttctaacaaggaaacactatttgggctttcaagattaggttgtagttcgagttcttatactaaatcatacacatgtcgtctggacatatttgactccaaaacactaaccaagattcttcttgcttcttaaagttttaatggtgtaatcaaaatctgtatgagtctttggtttgtatcttctaacaaggaaacactacttaggcttttaagatctggtagtggttctagttcttatactcaatcatatacattacatcaagtcatatttgactctaaaacactaactaagcctcttcttacttcccaaagctttgatagtgtagatgaagtccgtatgaatcattggctttgtatgttctaacaaggaaacactatttaggctttcaagatctggttgccaatctaggtcttatacttaatcatacacaggacatcaattcatatttgactccaaaacactaaccaagcttcttcttgcttctcgatggtgtagccaaagtccgtatgagtatttggctttgtatcttctaaaaaagaaacactacttcggcattcaagatccggttgcagtttgaattcttatactcaatcatagtcatatttgactccaaaaaactaaccaagcctcttctggcttcctaaggctttgatggtgatgtcgaagtccgtatgagtctttggctttgtattttctggcatggaaacactacttttcctttttggatccgtttgcggttcaagttctaatattcaaccatagacatcacatcactttatatttaactccaaaacacaaaccaagattcttcttgcttctcaaagctttgacggtgtagccgaagtccgtatgagtaattggcgttgcatcttctaacaaggaaacactactttggctttcaagatccagttgtggttcgagttcttgtactcaatcatacacatgccatctaggcatatttgactctaaaacaataatcaagcttcttcttgcttctcaaagctttaatggtgtaaccaaagcccgtatgaatgtttggctttgtatcttctaaaaaataaatactacttaggttttaagatccggttgcggttataattcttatacccaatcatacacatgacatcaagtcatatttgactccaaaacactaaccaagcttcttcttgcttctcgaaactttgttggtgtagctgaagtccgtatgagtctttggctttgtatcttctaacaaggaaacactacttaggctttaaagatcgggttgcagttctagttcttatactcaaatcatacacatgaaatctagtcatatttgacaccaaaatactaaccaagcttcttcttgattctcaatgctttaatagtgttaccaaagtccacatgcgtcttttgctttgtatcttctaacaaggaaacactactttgggttttaagatccagttaaggttctagttcgtatactcaatcatacacatgacatcaagtcatatttgactctaaaatactaactaagcttcttcttgcttcacaaagctttgatggtgtagcgaaagtccgtatgattcattggctttgtatcttctaacaaggaaacactacttaggcttttaagatccggttgcaattctcgtccttatactccatcatacacatgacatcaagtcatatttgattccaaaacattaaccaagcttcttcttgcttctcaaagttttgatggtgtacccaaagtccgtatgagtctttgtctttgtaccttctaaaaaggaaacactacttgggctttcaagatccggttgtggttgagttcctatactcaatcatacacatgccatcaagtcatatttgacttcaaaacaccaaccaagcttcttcatgctccctaaggctttaatggtgatgtcgaagtcagtatgaatattttgctttgtatcttctagcatggaaaaactaattttgcttttgggatccgtttgtagtttaagttctaatacttaaacatacacatgacataaagtcatatttgactccaaaacactaaccaagcttcttcttgcttctcaaagcattgatggtgtagccgacgttcgtatgagaatttggctttgtatcttctatcaaggaaacactatttgggctttcaagatccggctgtggtttgagttcttatactcaatcatacaaatgacatctggtcatatttgactgaaaaacacaaaccaaacttcttcttgcttctcaaagctttaatggtgtaaccgaagtccgtatgagtcttgggctttgtatcttctaacaaggaaacactacttgggttttcaaaatccggttgcggttctagctcttctacttgataagtgtgcattttacatgttttgagcatccatttgttatcactattgcatcatattaccatttttttatattatttctcatcatttgtcatcactttgcatgtttaggatagttttgcatgcatgttgcatatttgtgttgctttcaggatatttggagctattggcgagttaattggaagaagcggacctgatcatatcaaaccactcgacctacctagtcgagtacatggcttaacgacttcaacacaccacctgacaatcactcgatcacaccactcgaccccctggtcgagcatccccatcacaatcactcgatcactcactcgattacacgaccgagtcccaccatcatcacacactctacgatcactttaacaccaagccgagtaccaccatctcaatcactcgacttcttactcgacttccagctttagagtcttctccattccgtactcaaccaacactcaagcacaaggaagagaagaagactccagcttatcactcgacaaattactcgacaacctgggtcgagtaccgttcttaatccgtcccaatattgtgtcgttttgagtattagggtttcataatatttcgctatcagtaccatgtattttacattttcgtttacctaagttttattttccgcagacactgtgttcttgacgtttttgtaatccggatttctcttaatctattcagtattcagtatttgcttttgatttggtttaccaagttgttcatcctattatcatcctgctattactttgttgctatcatgttgataagtgtgtattttgcaagtttgagcataccatttgtcatcactttagcaccttatcatcagtgttttataccattctcatcatttgtcatcactttgcatgtttaggataggtttgcatgcatgttgcatatttgtgttgatttcaggtgatttagagctgttgacgagctaactggaagaagcggacctgatcatgtcaaaccactcgaccccgaggtcgagtagaagcttcaagacctcaacagaccactcgaccccctggtcgagtaggggagttcacaatttcatctcatcactcgaccctctggccgagtaccaccacgagagatactcgatcacctcactcgaccacctggtcgagtgtattcacctccaccacctgaccagtcactcgatcacatcattcaacccccaggttgagtgtcttcaccaccaccactcgactacatactctatggcaagctttagagtcttcttcattccgcactcaactagacactcgagcacaaggaagaaaagaagactctagcatatcactcgacctctcactcgaccatctgggttgagtatagttcttaatatgtcccaatactgcatcgttttgagtattagggttttcgaatattttgctataagtagcatgtactttacattttcgagaagaggtttttatctagttttatttcgcagacattgtgttctagaccttttgtaatctggatttctctttatctattcagtattcagtatttgttcttgattttgtttattgttgttcatcctgttattgttttgctattacactgttgttatcatgttttcatcctgttcaacgtttatgttctcttcaatgatgtctgagtagtgaataggtttctgaggatgggttagagtagtgtagaattctcagtatgctaggtggttgagtattgattgatagatcccttctggattagttgttcttaatccctattgctttttgatcaactggaatttgagcccagacatttccgcgcccaaaaggtgttcgatgaaatgtctgaaccactaattccagagattcgtggctcagtaccaaggtattggttgcagggagtgttttggctttaacttgttgattcgtaatgcctataaggttagctctcgtcaatggtgattgagtctgggactaggttaagttgagggtctctattgcggtggcacttagatttggttaatgaacttgttgtctagggataatttattgagcatgtcaatcacctgtaaattgaggaaacgaaactactcaattaccccatcctcgggaattctttatctgattgattttattgtttactctactgttgtttactgcatcttttcatctgttgcttagtttctgcaattctttactgttactcgacctgttacttgaccccccagttgtccggcaacagactgtgcaatcgagtatccctgttacattttctgtctgttactcgaactgtcactcgaccacacccagtgctctgcaacgagctgtgttggtcaagtgttttattgtttctgcttgattttctgttttctgcatgttcacttaggactgctagaacacaccaaaacctgttattacttggcttgacttagtgacttagtgacttagtggcttgctagaacactgctagaacaccaatcatacacatgccatcaagtcatccttattgttagcatcaaactcatttggattgacaacctaaaatattacaacgacatgattggtgttttaagataattgactaaaaaacctattatcaatttgtccctgttgccaattgggtgtttgtttgttacatttgagatttcagacttgcttagatcaagttctttttcaattttcaatttggttgctaactgtgtgtttttcttgttgtcttcttgttctaggtacacctctgctgtatgattggtgttctagcagtgttctagcaagccactaaaatactacaacgacatgattcgtgttttaagataactgactaaaaaatctattatcaatttgacgccgttgccaattgggtgtttttttgttacatttgagatttcagacttgcttagatcaagttctttttcaattttcaattcggttgctaactgtgtatttttcttgttgtcttcttgttctaggtacacctctgctgtatgcaaactcgatcaacaggcaatccgaacctccttttcaacgacaacatcgaccgcatagctcgcgaactcagagaaaagagaaacacagtcaacctaataccacaacaaccactcgaaatggctgacgaacagaatcatcaaaaaggccctgccaacattggtgctggaaacgcaccacgtgatcaccgttagcggaaaggaattgcacctcctgctatctagaacaacaacttcgagattaagagcggtctcatctcgatgattcaggggaacaaattccatggtctgccaattgaggatccactcgaccaccttaatgaattcgataggctctgcaacctaacaaaaatcaatggtgtcagtgaagacggattcaagctccgtttgtttccattctccttgggcgacaaagctcacatttgggagtagaatctgtcccatgactcaatcaccacctgggatgattgcaagaaggcttttctatcaaagttcgtctccaacgccagaactgcaagactcagaaatgagatctctggctttttacagaaggctggtgaaagcttctgtgaagaatgggagcgttttaagggttatacaacccaatgccctcatcatggcttcactaaagcctctctgctcagcactctttatagaggcgttttgccacgcatgagaatccttctggaaaccgccagcaatgggaacttccagaacaaagatgttgaagaaggctgggaaattgttgagaaccttgctcaatcagatggtaattacaacgaggactgtgataggaccgtcagaggcacaactgaatctgatgacaaacaaaggaaggagatcaaagcactgaatgacaagctggacatgattcttcttagccagcagaagcatgtgcacttccttgttgatgacgagaagtatcaagtccaaggtggggagggtaaccagttggaagaagtcagctacatcaacaacaaccagagcggctacaaagggtataacaacttcaaaaccaacaaccccaacctctcctaccgcagcaccaacgttgttaatcctcaagatcaagtgtatcctccacagcaacaacaagatcagaacaaaccttttgttccttacaatcaaggttttgttcctaagcagcaatttcaggggaactaccagccgcaaccaccacctgggtttgcacctcagcaaaaccaagatcctgctgctcctgatgctgaaatgaaacagatggtacaacagctgctacagggacaagcatctagctccatggaaattgctaagaaattatttgaattgcaccataagctggactacaactacaatgacctgaatgccaaagtggaggcattgaataccaaagtcagatatttagaaggacaatcagcatctacctctgcacctaaagtcacaggacttccaaggaagtcaatacagaattcaaaggagtatgcaactgctcacgccatcactaactgccatgatcgagagctgccaactcgacatgtccctgacttaatcactagggacagtgatgttcaagaaaggaaggcttccactcagattgaagtctctgttcttgaattcaaccattcttcttgttctcgccatctcattcaatccacctcagaagagaagtccgccataatcgagagaatggtaaaacgattcaaacatacttcattaccctcacgtgcttttccgtggacattcaagaaagcgtggatggagagatacaagtctgttgcagcgaagcaggtagacaagattgaagaagtgatgccactgatggaaattctcaacctgattcccgatcctcacaaagatgtgagaaatttgatactggaaaagatcaagatgtatcacaattcagatgatgaaagtgatgccactccatctcgagctgttgataagaggattgttcaagaaaagttagaagatcctggatctttcactctaccatgttccattgggtaattagctttcagcgattgtctgtgcgatctcggagcctctgtcagcttaatgccactctctgtggcaagaaggttagagtttattcagtataaaccttgtgacctgactttgatccttgcggataggtctttaagaaaaccctacgacatgctgaaagatctaccagtcatgattaatggagtagaagtgcctacagacttcgtggtgctggatatggaagtagagcataagggtccttaatcctgggaagatccttcttagcttcagtgggagcagtgatagatgtcagggaagggaaaataagtctcaaccttggaaagcacatcaagttgcagtttgacatcaacaaaactccacaagggtcaacagaagatggaaaaacctttggaaatgatagagcgatctcaggagaaggatatgagactaaaagagtaaaggaacttaaaaagaggtctgagaagcaagatgaaactatagagaagcaagcccacactgttgaggaacttagaagtaagcagaatcagttgcagaaggaagctcaacctaaaggcgggattgacactatccctataaagaagttcacttcaagatggtctgaagagatagataaccctccaaaagagaaagaagcatattttgaagagaggggaattgagtattctgctgtagacctctccagggaggacgctgagtatgatgatgatattagagaggactatgcagaccctctctatcattcattttcttcttgataagtgtgaggagtcaagctagagactttaaacaaactcacttgggaggaagtcccatgattatccttgtaaataatttttactttcttgttatttttgatttattttagttgtgtttgtggttctcaggaacagaggaataacgtaaagctagagtaaaaattcaaaacttttactctacagacggcctagggaccgagtacattggttgagtgtttaaaatctaaaacttttaaatcatcatttcactcgaccaacagaagctacaagttcttacaggaagtttattaagtttacagaagattgttggatttcctgagactttcctagtgaagaaagaataataatttagaataaggagacagacgagggacccactgctgcaccctatgtctcccacgctcctaaccaacagacaagaaatccaactctttcttctcacaaccactcgaccccctcaccttatcctatctccactcaacctcgacgccatccccatcccacacctatcacttactcgacctcgttatctcctccacacctattaactcgaccccatccctcctcattcattacaaccaacaacccaactctcatactctcatccactcgacctcctcaccatcctcttcatatactcgacctcaacatctttctccacacaccaaacttttcgcaactctctcatctcccatcgtcgctcattgcaattcaagtcttcaagtgttcgttttaatcactcgacctccaagctcacaaccactcgattgcggcaactcacctcttcaccaaagccaccaccatcttctcttcttccgtgagctccacttcactcgatccctcataataaacttcttcatcgcctcttcactcgatcgcgtcttctcttctcacattcgcaaccgaggaatcattcagctcacctccgcctctcaaccaccacaatcactcgaatcaccgctcctccattttcacttaacctctttcaaaccgcatcaccatatctcctcctcttcaagctcaccactcgacctacgcatcactcttaccacgaaacgaacttcactcggtcgtacgaaatcacttgatcaaccgaaagaaaagaaaaaaaaaaaaaaattaaacgaaggtttactcgattacatcactcgaccggtttactgtgttggtttgtgtttttggttttgttgagactaacttattaacgtttatctttgagtttcaattgtttacaggtttgatcatgagtaactacagtcgagaatcctctatggatcctgattataatgtggatgaagctgagtcctggtcctctagaccggagagagaggaacatgtttacgagagcttcagggatgaatttcaacgctcctctgctcgacgtaatcagagaagagcagaaatcaccagagggaagagagcgatgcccagtagatatgagctgattgatgaggacatcaaaactgagtatgagccaaagtcatggtgcaagaagacgaagctactgaacaaacccgaataggttacagtggaggagtatatcagattctttgagatgaatgatttatggggaacgaggtatccctactatgagactttagcccagctggggttactggaggacgtgcagcatctgttcgagaagtggcatctggaaacactcatgtcttactcttacgcttcctataaggaggagacaatcgagtttctttccacactgcaagtggagatgtatgagggactcacatacattgagtttagggtttagggtttagggtttagggtttagggtttagggtttagggtttagggtttagggtttagggtttagggtttaaggtttagggtttagggtttagggtttagggtttagggtttagggtttagggtttagggtttagggtttagggtttagggtttagggtttagggtttagggtttagggtttagggtttagggtttagggtttagggtttagggtttagggtttagggtttagggtttagggtttagggtttagggtttagggtttagggtttagggtttagggttagggttcttgacgttctcaatggatgaacagtggtatcagctttcgatcaagaagttggaagaactgttttgtttccctagtggaaagggaaccaaaaccaggtttgacagggaagagcttaaggatttgtgggctactattgggaataatttaccgctaaacttggcgcggtccaaaagcaaccaaatccggagtcctgtgatccgctactttcaccgctcggttgccaacgttttttactctagggagtctacatgcaccgtgtctaacacggacatggagatgatagattccgcgcttacagggattctctgctgtacaaagggaaagaatgtcttgagaggcgatctcaacaacgcaccactagtcatgcctctgttgatccacctgtgtggatataggaagtgggcgttgacgaacgacaagaataaggtgacaggagcactatgcatggatggcgttgtgacgccaattctggaagcttgtggagtaccgcttaaggaaccagggttagcaccgagaatgatggacttggatcacttgcgccgatgtgagttcttggagtttgacatggctagcgactttcaccgctacaggttcgagcattcatcgattagaatcgccaacattcttctcccctacattgatgctactaggattcttgagggcaggaacattgacttcaagcctgcgcttgaagatctttatttcgagggcagtctgccaactgaggagattagtcacaccgaaggagctataacagaagatgttgatgagacagatgacatagattaggcggagtttgacacgagcatgtatcatttcagtgagcatatacttccagcgagggaaagcaagagtttgagcgaagctcacaggaataacatcaagctgcagaagtggtgcaagaaacaggataagtttctcgccaagtgcctcagggctatcaagtttctgaaggataagatcagctgctccacttccactacagctattccacagggacagctccctcaggacatgccttcgaggagatatgacgcgcccgagccaattcggcgcaaacctgagcctagagagcaggagattctgcatgtccctgcgaggcattcatcattcgagcctcatgaatctgggaggaagaggaggaccacactcactcaatctaacaacaagggtagacgacttctgcattctcgtagtttacatgaagaagagaggtcgagtatcctcagagcggtgatggccgccacagagctgaggaggtcgagtacccacctactggagctgatacggaacagggcggttcgtctatggccagggagcaatcacaagcagccattgacgaccgacttcgttcattcttcgactgaggtaagcgcctcacttcaccattgtattatatcatctcttgtgatttgttctttattttgtttctgtgaatggatttgtcctgggtactctcttccaagtttatccacacagtggactgtgtgatttaagttttggggagggctcaggaagtgtgtattgcattgtgtatattttttagtccgcatacatctaaggcatagaaaaaccaaaaaaattttgaaaaatttcagaaatgatttcacaaaaaaaagaatgtttatgtagttgcattacatttaggatcgagtctagagtgtttcatttaggatttttgcatatgcataggggataatgatgagatagccttgtaagcattttggttcaccggataaacttagtgccctctttgctagttgtctgttgcgtagtcaatgaattagaaataaaactgaaccatgcctagattgctctagtcgaccacactgtcatgatctgataccattccctatcaatatgaacctgaatctgatctttaattgtcatgtttgcatcaaatttgaactcatggataccctaaaatacttggattttctgatgagaaaaggtaaaagactctaggtaaggtaagctaaagaagcagaaaaaatctagtaaaggttttgggatttgtaaagaaaagaaagagttcttgttagctattgaagatgggcaaaagccctcggttttaaaatgctaaaaacaggaaccttagttgttaaagagatccaaatccgctagatgtatcaaagtgttgagaaatcttctcctagagttaagagaaaagaaaagaatgattagaaaaagggcataaaggattcatgaatgcaaagggtagagttaggtttttatattgggattggagatgggattaccattagagcttcatttgatatactctgggtagatgggatcttatctctatatgcatagcttgggacttacctttagcaatctactaaagcttaatcattttttgagagatcccctgttactgaagcctattctgtaagggacaatctttgtctcttgaccttttaccttagccaaatgagttcattgatgatgcattgcttgattcacgttccagaactaatgaatgttaaagggattggtagatttgaaagcatgtgtaggtcgagcatatgagtcagattgattaataacaaggcatggctaacgtttttgagtagaattcgatcatattgcagcttagaactatcaatttggacattgatttcatatggtttatcaggtgctttggctataagtccccgctttcaaacctcaccaccagcttgttcttaattgtttgcttgaggggaagcaaagactaagtttaggggagttatatgtctataatttgcatgttttcagtgtccattcatcatcgttttgagtccagttttgtatcattcatcactgttttatatcatttctcatcattcttgcatactttgcatgattaggatagctttgcatacatattgcatttctgatttgttttcaggtgatttggagctgtttgcgagcaaattggaagaaacgagccagacctagaagacatactcgaccaccaggtcctgtgcatccagcaccatactcgaccccaagtcgagtaactttggagccattcttcccatctactcgaccccctggtcgagtatcctcagctcaggccactcgatgatgccactcaaccccctggtcgagtatcacttcgccacaccacctgaccacactcggccattcactctaccaagttactcgaccccctggtcgagtatcatcactcaccaccatcaccatcactcgaccggacactcgatcacgtcttcacagtctactcaaatccgcactcaaccagacaagctgagcacaaggaagagaagaggagaaaacaaagtgtttggaagcggcctggacctccatcggatcacgaagcccatctcggcccattatcattctatgggccggggattaggttattggcctgtctactatcattttatttcgttttgtataaatagatgtcttagggttctgtcctgagacatctagtcgacattgagtttttgcttcagttttattttctgttttactctgctgcgccgcttttgcttctgcaaccagtaattcgagatttttccaagttattcagattccgcatttgatttcatctgtcatcttgtttctctactctttatctctttacttatgcaatattatcatttatctgcgtttatgtctttgagcatgttgtctgagtagtgacttagaattcttagggatgggatagagtagttgtggaattcgtagtctgtataatggttaagttttagaattgattgaatcccttcaggactagttgcgtttactgcttatttctttctgatcaactggaattcgatctcaagcattcccgcacctagaaggtgttcgatggaatgcttgatccactagttcctgagatattcgtctctatcccaagggattggccgtttagagcgtttattgactttatcagtctgttcttattgcctgcatagttaaattccgttaatgggaattagtctgggctagctttgcttgaggatttctatcacgggagtgaattgatttgttgttaaacctgttgcttgaggatttctatcactagcttcatcagttggtactcgttgtatgcaaacacggtcacgaggaaatcagaatctcctgttcaacgataatatcgaccgtattgcacgccaactcagaacacagacagaaacagacacaatggctacagttgtagatgagcaagtgcaaccaaacaacataggtgcaggcgatgcaccacgcaaccacaatcagcgtaatggatccgtgcctccaccagtgcagaacaacaactttgagatcaatagcggtctcattgccatggttcagagcaacaacttccacggcctccctatggaggatccactcgatcacctggacgagtttgataggctctgcagcctaacaaagatcaatggagttagtgaggatgacttcaagctcagattgtttccattctctcttggagacaaagcccatcagtgggaaaaatcgcttcctcaaggctctatcacctccaggaatgactgcaagaaagccttcttggctaagttgttctcaaactcctggactgcgagactaaggaatgatatctctggtttcacacaaacaaatatccctggtcctggctgacagatctgttagaattccccatggtctcctggaagacttaccagtcatgaaaggcgtggtcgaagtacctacagactttgtggttctagaaatggatgaagaacctaaagaccctttgatattgggaagaacatttttagctacagtcggagctatcattgatgttaagaagggaaagatcgatcttaacctcgggagagatctcaagatgaccttcgatatcaccaacaccatgaagaaacctacaatagaaggaaatgttttctggattgaagagatggatatgttagctgacgaaatgctagaagagctaagagaaacagatcatcaacagagtgctctaacaaaggatagctaagaaggagatttacatttggagactctagggtaccagaagctgttagatgaacacaaagcagttgagaatccaggagaatatgaagatttgggtgaaagagcaaggaaggaatatatacttgaccacatcactcgactaacagtccattcagtgtactcgaccgaactactcgaccacaacccctcctctgaagccaacttagtatccgatgactggtctgaactcaaggcacccaaagtagatttgaaaccgctaccaaaagggctaaggtacgtttttcttggactaaactctacttatcctgtcatagtgaatgatgagctaactgctgatcaagtaaacctgctgataactgagctcaagaagtataggaaagctataggatattcgttagatgatattaaggggatttcacccaccttgtgcacccatagaatccatcttgaaaatgaatcctactctagcattgaacctcaaaggagattaaatccaaacttgaaagaggttgtgaaaaaggagatacttaaactattagatgctggggttatttaccctatctctgatagcacttgggtatctccagttcactgcgttcctaaaaagggaggtatgacagttgttaaaaatgctaaagatgaactgatacccactaggactataactcgacataggatgtgtattgactataggaagttaaatgctgcctctagaaaagaccatttcccattgcccttcattgatcaaatgctagaaagattagcaaaccatccttactattgcttgttggatggctatagcggattttttcaaatccctattcacccaaatgaccaagagaaaactacttttacttgtccttatgggacctttgcttacaagcgtatgcctttcggtctctgtaatgcacctgctacttttcagcggtggttgacttccattttctcggatttgatataggagatggtagaggtattcatggatgatttttctgtgtatggctcttccttctcctcgtgtttgttgaacctatgaagggtactcaaaagatgtgcagagacaaacctggtgctgaactcggagaaatgccatttcatggttagagaaggcatcgttttggggcacgaaatttctgaggaggggatagaggttgataaggctaaggttgacgtgatgatgtagttatagccaccaaagactgtcaaggacatcaggagttttcttggacatgcagggttttacaaaagattcatcaaggatttctccaagttggcaagaccgctcacaagactactgtgcaaggaagccgagtttacatttgatgaagaatgtttgacagcctttaagttaatcaaggaagctttggtcacggccccaatagtccaagctccaaactgggacttcccattcgagatcatgtgcgatgcttcagattatgcagtaggagcagttttgggccagaggattgataaaacgttgcatgtgatatactacgcgagaagaacgatggatgatgcacaggtaaggtatgccactacagagaaggaactgctagctgtggtatttgcattcgaaaaatttagaagctacctagtcggctctaaggtgacagtctacactgatcatgctgctctgaggcatatatacgcgaagaaggataccaaacctaggctgttgagatggatcttattgctccaagagtttgatatggagataattgataagtagggaatttaaaacggtgtagctgatcatctaactagaatgagaattgaagacgaggtccctattgacgattccatgccagaagaacagctaatggcaattcagcaacttaacgagagtgctcaaattcggaaatcactcgatcaagtatgtgcaattgaagaaaagcttttgtggtatgctgatcacgtcaactacttggttagtggtgaagagcctccgaatttgtcgagctatgagaagaagaagttcttcaaggacattaaccacttctagtgggacaaaccttatctctacacactctgcaaggataagatctacaggagatgcgtttcagaagacgaaatcgaaggcatcctactgcactaccatgggtccgcctatggttgccactttgcaacgttcaagacagtgtcaaaaatcttgcaagctggtttttggtggacgacaatgtttaaggatgctcaggaatttatctcgaaatgtgactcatgtcaaaggaaagggaacatcagcagaaggaatgagatgcctcagaatccgatcttagaagttgagatctttgacgtttggggaattgattttatgggtccgtttcctttttcttacgggaacaagtacatactggtcgtagtagactatgtatcaattgggtggaagccatagccagccccaccaatgatgctagagttgtgctaaagctgttcaagacaattatcttccctagatttggagtcccgagagttgtgatcagtgacggagggaaacattttatcaacaaggtttttgagaaccttttgaagaagcatggagtaaagcacaaggtagccactccttatcatccacagacgagcgggcaggtggaaatctccaacagggagataaaagcaattttagagaaaacaatgggaattacaaggaaagattggtctactaagctcgatgacgcactatgggcttacagaacagccttcaagacccctattggaacgactcctttcaacctcctctatggaaaatcctgtcatttgcctgttgaactcgagtataaagccatgtgggcagttaaactcctgaactttggcattaaaaccgccaaggagaagcgattgatccaactgaacgatctcaacgagattcgcttagaagcttatgagagttccaaaatctacaaggagcgaaccaagtctttccatgacaagaagatagtctcaagagattttaaggttggtgatcaagtgttgctgttcaactctcgcttgaggctttttccaggcaagctcaagtctagatggtctggtcctttctctgttactgcagtccgaccttatggtgctatcactctagctggaaagaatggagacttcacagtcaatggacaacggctcaagaaatacatgatagatcagtttattccagaaggaacttctgttcctttggatgagcctataaacgcctaatgagtatgaagagtcaagctagagacctaaaacaagctcacttgggaggaagtcccatgcctatctttgtacatatctttaatttttcttgttgtttttgatgcatcttgttagtgttttcaggcgataagtatgaagagctgacggaaatagattctggctttgagggaacagcaatacactcgaccaaagagcaatcaaggatactcgacattgttctggtttctccaccccatgaaatcactcgaccacaccctacagggactgaatgacgatgtgatcgagtatagcgagtggtgcaatcaaaacttctccatgtcagtaaatcactcgaccacggtgctggccgcagcagaagaagagaggtcgagtatcatcagagcggtgctggccgcgacgaaggagcagaggtcgagtacccctagggggaagctgagacacaactgggagattcttcgatggcctgggagcaatcacaggcagctattgacgaccaactctgctccttcttccactgaggtatgcacctcactccaccattgtaatataccatctcttgtttttattttgtttctgtgatgtgttttgtcctgagtactctcttccaaatttggtcacacagtggactgtgtgatttaagtttgggggagggctcaggcaatgtgtgttgcattgtatataatcttgagtctgcattcatctaaggcataggaaaaaacaaaaaaattgaaaaatttcagaaaatgatttcacaaaaatagagtgctcatgtagttgcattgcatttaggaacgagtctagagtgtttcgtttaggattgttgcatatgcataggggataatgatgagatagccttgtaagcattttggttcaccagataagctcagtgccctcgttgttagttgtctgatgcgtagtcattgaaattgaagtaaaactgcaccatgcctagattgctctactcgaccacactgtttggatctgataccattccctatcaatttgaacttgaatctgatttagaattatcatgtcttggcatcgaatttgaactcatggataccctaaaatacttggattttcttactcattttaaccactcttgttagtccaagtagctgactctccttattagagcagttaacccgaaccaaaacctaaactttctttcgagccctatatcacttgtgagtgtttgtgaggtcttatttcaattgagcttggtagaaagtgttaggttcgtaacgacagagatagtgtctcatgtagttctagttcgcgttttcggactggataggactaggtgggcgcttatatcacgggttgggatgtgtttaaaagaaaagggtgaattcattgttgataaggaaagggaaagaattctaggggaagtaagctaaaagaagttagaaaaaaaatctagtaaaggttttgggaatgttaaagaaaagaatgaggttcttgttagctaaagaagaagggttaaaagcctttggttttaaagattaaaaacaggaaccttagttgttaaagaaatccaaatccgctagatgtgtcagagtgttgagaaagcttctcttagagttaagagaaaagaaaagaatgatttgaaaaagaaaaaaaaaagtttgaaagattcatgagtgcaaagggtagagttaagttgggactggagttgggattaccattagagcttcattgttatactctgggtagatgcgatcttatctctatatgcataacttgggacttaccttaagcattctactaaagctcaatcattcttgagagatcccttggtacttaagcctattttgtgagggaccatctttgtctcctgaccttcaccttagccaaatgagttcattgatgatgcattgcttgattcacgttccagaactaatgaatgttaaagggattggtagatttgaaaacatgtgtaggtcgagtataagagacggattgattgataacaaggcatggctaacgtttttgagtaaaattcaatcatatcgcatcttagaactaccaacttggacattgattttattcgctctatcatatgctttggttctgagtccccgccttcaaacctctccttcaactatgtcttcttattagcttgagggcaagcaaagactaagtttgggggagttgatatgtctataatttgcatgttttcagtgtccattcatcatcgttttgagtccagttttgtatcattcatcactgttttatatcatttctcatcattcttgcatactttgcatgattaggatagctttgcatacatattgcatttctgagttgttttcagatgatttggagctgtttgcgagcaaatttgaagaaacgagccagaaccagaagacatactcgaccaccaggtcgtgtgcatccagcactatactctacccccaagtcgagtaactttggagctattcttcccacctactcaaccccctggtcgagtatcctcagctcaggccactcgatgacgccactcgaccccctggtcgaatatcacttcgccacacaacctgaccacactcagccattcactctaccaagttactcgaccccctggtcgagtatcatcactcaccaccatcaccatcactcgaccggacactcgatcacgtctttatagtctaatcaaatccgcactcaaccagacaagctgagcacaaggaagagaagaggagaagacaaagtgtttagaagcggcctagacctccatcggatcacgaagcccatctcggcccattatcattctatgggccgggcgattaggttattggcccgtctactatcattttatttcgttttgtataaatagatgtcttagggttctgtcctgagacatctagtcgacattgagtttttgcttcagttttattttctgttttactctgctgtgccgcttttgcttctgcaaccagtaattcgagatttttccaagttattcagattccgcatttgatttcatctgtcatcttgtttctctactctttatctctttacttatgcaatattatcatttatctgcgtttatgtctttgagcatgttgtctgagtagtgacttagaattcttagggatgggatagagtatttgtggaatccgtagtctgtagaatggttaaattttagaattgattgaatcccttcaggactagttgcgtttactgcttatttctttctgatcaactggaattcaagcaaagcattcccgcacccagaaggtgttcgatggaatgttcgatcgactagttcctgagatattcgtctctatcccaagggattggccgattagagcgtttattgactttatcagtctgttcttattgcctgcatagttagattccgttaatagaaattagtctgggctagctttgcttgaggatttctatcacgggagttaattgatcagtctagggatagcttgattgcgcttgttaaccattcgaataggctaggatacaactctacttgattaccccatccttaggaatttctcgtctatctgatttctccgttttattgttatcacttaatcgttttcattgcctgtttcttagtttttgcaattactcgaccaacttacttgaccacacccagtgtctggcaacagactgtgcaatcgagtacagctgtctcatttcctgtctgttactcgacatgtatactcgaccagacccagtgtctggcaatagactgtgcaatcgagtatatttgtttcatatcctgcctcttactcgatcacatcctacttcttgcatcagcctgttgtggtcgggtgattttagtaattctattattgtttctgttttctgcatgttcacttaggactgtaagaaaccccaatactgttattgcttggcttgacttagtgacttctgatcacatctcatctgtttgcatcacacccatttggattgacacctaaaatactacaaagacatgattggtgtttaaggataattgactaaaaacatattattagggagttaataagtgtgtattttgcatgttttgagcatccatttgtcatcacttaagcaccatatcatcactgtataataccatttctcatcatttgtcatcactttgcatgtttaggataggtttgcatgcatgttgcatatttgtgttgatttcaggtgatttggagctgttgacgagctaactggaagaagcggacctgatcatgtcaaaccactagaccccgaggtcgagtagaagcttcaagacctcaacagaccactcgaccccctggctgagtaggggacttcacaatttcatctcatcactcgaccccctggccgagtaccaccacgagagatacttgatcacctcactcgaccacctggtcgagtgtattcacctccacaacctgaccagtcactcgatcacatcactcgacccccaggtcgagtgtcttcaccaccaccactcgactacatactctatggcgagcttcagagtcttcttcatttctgcactcaactagacactcgagcacaaggaagaatagaagactccagcatatcactcgacctctcactcgaccatcagggtcgagtacagttcttaatccgtcccaatactgcgtcattttgagtattagagtttcagaatattttgctataataagcatgtactttacattttcgagaagaggtttttatctagttttattccgcagacactgtgttctagaccttttgtaatccggatttctctttatctactcagtattcagtatttgttcttgatttcgtttattgttgttcatcctgttatcgttttgctattatattattgttatcatgttttcatcctgttcaacgtttatgttctctataatgatgtctgagtagtgaataggtttctgaggatggattagagtagtgtagaattctcagtttgctaggtggttgagtattgattgatagatcccttctggattagttgttcttaatccctattgctttctaatcaactagaatttgagcccagacatttctgcgcccaaaaggtgttcgatgaaatgtctgaaccactaattccagagatttgtggctctgtaccaaggtattggttgtagggagcgttttggctttaacttgttgattcgtaatgcctgttaggttagctctcgtcaatggtgattgagtctgggactaggttaacttgagggtctttgttgcggtggcacttagatttggttaatgaacttgttgtctagggataatttattgagcatgtcagtcacctgttaactgaggaaacgaaactactcaattaccccatcctcgggaattctttatctgattgattttattgtttactccacaggactttctatcaaagttcttctccaacgccagaactgcaaaactcagaaataagatttctgatttttcacagaagacgggtgaaagcttctatgaagcatgggagcgtttcagaggttacatcaaccaatgccctcatcattgcttcacgaaagcctctctgctaagcactccatagataggcgttttaccacgcatcagaatgcttctggataccgccaacaatgggaatttccagaacaaggatgttgaagaaggctgggaattggttgagaacctagctcaattagatggtaattacaatgaggactacgataggaccatcagaagcacagctgactctgatgacaaacacaagaaggagatcaaagcgctgaacgacaagctggaaaggattcttcttagccagtagaagcatgtgcacttccttgttgatgacgagcagtatcaagtccaagatggggagggtaaccagttggaagaggtcagctacatcaacaacaaccagggtggctacaaagggtataacaacttcaaaaccaacaaccccaacctctcctaccggagcaccaacgttgcgaatcctcaggatcaggtgtatcctccacatcaacaacaaggtcagaacaaaccttttgttccttacaatcaaggatttgttcccaacaatttcaggggaactaccagccgcaaccaccacctgggtttgcacctcagcaaaaccaaggtcttgcagctcctgatcccgaaatgaaacagatggtacaacagctgctacagggacaagcatctagctccatgaaaattgctaagaagttatttgaattgcaccataagctggactatagctacaatgacctgaatgccaaagtggagacattgaataccaaagtcagatacttggaaggacaatcaacatctacctctggtcctaaagttacaggacttcctgggaagtcaatacaaaatccaaaggagtatgcaactgctcacgccatcactatctgccaggatcgagagcagccaactcgacctgtccctgacttaatcactggggacagtgatgttcaagaaggggagccttcaaccaagattgaggtctctgttgtagaattcaaccattctgctggttctcaccatctcatttaatccacctcggaagagaaagcagccataatcgagagaatggtaaaacgattcaaacctactccattaccctcacatgctcttccatgaaattcaggaaagcatggatggagagatacaagtctgttgcagcgaaacagctagacgagaatgaaacagtgatgccactgatggaagttctcaacctgattcctgatcctcacaaagatgtgagaaatctgatactggaaaggattaagatgtatcacgattcagatgatgatagtgacgctactccatctcgagttgctgataagaggattgttcaagaaaagttagaagatcctggatattctactctaccatgttcaattggggaattagctttcagcgattgcctgtgcgatctcggagcctctgtcaccttaatgtcactctctgtggcaagaaggttggaatttatttagtacaggccttgtgacctgactttgatccttgcagataggtcttcaagaaaaccctccgacatgttgaaagatctaccagtcatgattaatggagtggaagtgcctacaaacttcgtggtgctggatatggaagaagagcataaggatcccttaatcctgggaagacccttcttagcctcagtgggagcagtgatagatgtcagggaagaaaaaataagtctcaaccttggaaagcacatcaagttgcaatttgacatcaacaaaactccagaagagtcaaaagaatatgaaaaaccctctggagacgatagagtgatcccaagagaagcgtatgagactgaaaaagtaagggagcttaaaaagaggtctgataagcaagatgaaactatagggaagctagcccacactattgaggagcttaagagtaagctgaatcagatgcagaagaaagctcaacctaaaggcggaattgacattatcccgagaaaaaggttcacttcaagatggtctgaagagatagattaccctctagaagagaaagaagcctgttttgaagaaaggggaattgagtgttctgctgcagacctctccagggaggacgctgagtatgatgatgatatccgagaggactatgcagaccctctctatcattcattttcttcttgataagtgtgagcagtcaagctagagactttaaacaagctcacttgggaggaaggtcccatgactatctctgtaaataaatttttcttttgttgttatttttgatttgtcttagttgtgtttgtggttctcaggaacaaaggaacaaggtggagatagagtaaaaattcaaaacttttactttacaaaagacctggagatcgagtgtatagcccgttggagtgcaaaattttgtaaattttctgttgcacatggagaccttgcactcgagtacattggtcgagtatgagtgatgtttaaaaccaaaaaattttaaatcatcatattactcgaccaacagaagctacagagccttacagggagttaatcaagtttactgtagatttcctgcagttttcccaatcaacagagtgtggaccacgcgctgaggataagatggagagagaatctcaaactcaatctccaccactgcttttgaaatttcactcgaccaacctctattcagttttccaccactcgatcgcaagaatcaacttgacctctgaaaccaagccacgctcgacctcgccgaaaccactcgaccgcagctggaaagaattacagccgccgcagtcgagttcaaagtcccactcgaccaccgattacgtttcaccttgaatcactcaaccacttcacttcgccgttaaccgtcacttcccgtctaagtcgagtctccacctcgtttaccgtcgtcgtctcaagagctactcgattacatccactgtactcgatcgtcgatttgaggtttcgtccctgccaattttggctcacctatggtatactcgaccaacctgattcaccatctgcacactacttcctcaacattactcgacctcttatatctgagccactcgattcaacccgtgaaagagaaacttggaaaaagttaagcttacttgagtatttgattgtacttgaccgtttgggtctatattgtctgttgttaacaattttggtttgattgttctctttgagactatcctattgatattggagttttgagttctaaatcttctacaagagaatcatgagtaattacagtggcaattcttcagttgatcctgactacaacatggatgagacatagtcgtcatcttcaaggccagagagagaaaagatagaatttgatagcttcagaagaaaagctgagatagctcgagggaagagagcaatgacagagaggtacgagcttatagatgaggatctagaagacgagtacatgcttgagcatactagtagagccacaaagcttcttcacaaaccagatgtattacctgctgaggagtatatcagactcttcaaactaaatgagttctgtagcacaaggtatccatgctcgaccacacttgcataacttggattgttggaagatgttcaacacctgtaccagagtagtcatgtggacactctgatggcttatccgtatgtagcatatgaagaagagacaattcaattcctctccacacggcaagtggagctttaccaaggtatgacctctgatgagttggattgcgaaggattgggattcttgagattctctgtgtatggtcatgagtataggttatcaatcaaacgcttggaaggactttttggtttccccagtggaacgggtactaagcccaagtatgacagagaagagttgaaagacttatggatcaccattggcagctctgtaccgctaaattcttccaggttaaagagcaatcagatacgcagccctgtcatcaggtacttccagcgttctatagccaatgtcctctactccagagagatcacagggactgttaccaattctgatatggagatgatcgctatatgctctcaaaggcactctctaccaaactaagaacaacatatctgtgaaatcaatgacacacctttctctgtacttcttctaatccacctgtgtggatacaagagctgggctgtcagcaataatcacaagagagcacgaggcgctctttgcatagtcggtgttgtgacaccgattctgattgcttgtggagtcccaatcacatctgatggactcgagccacgggcaattgatatcaagcatctacgtcactgcgaagtcctggagttagcatcctacgtcctgaagttcggaatggttggcgacatgcactgttttaggtttaagcactctacggataagagagctagcatccttctccccagccctaaggttacacggataatagagggagataacattgattttcggcctgagcttggaaacctctactatgagaacgctccgccattggatgaggatgatcttatagaagaagctgcttaggatgggatggatgaagacagagcagtggagttcgacactagcatgtatcattttgatgaacatgtacctctggcgagggagagcaagagcttgagtgaagctcataggaacaacaataagctgcagaagtgttgcaagaagcaggacaagcggctcgccaagtgctttaagactatcaagtttctgatagattaactgagctgttcctcttctactacagctattccacagggacagcctcctctagatatgccattgaggagatttgatgagcctgagcacagacctgagcttagtgagcagagagtctcacatgtccctgctaggcattcgtcattcgagtcccgggagcacaagtgaagaaggaaggctacactcgttcgctctagcagtagatcatgcctaattcactcgaggagatcactcgaccacggtgctggccgcagcagaggaagagaggtcgagtatccacagagctgatgaggtcgagtacccacctgctggagctgatacagaacagggtggctcgtctatggcttgggagcaatcacaggcagccattgacgaccaacttcgttcattctttgattgaggtaagcgcctcacttcaccattgtattatatcatcttttgtgatttgttctttattttgtttctgtgattggatttgtcctgagttactctcttccaagattagtttgggggagtgctcatgaagtgtgtgttgcattgtttatactcttgagtctgcattcatctaaggcataaaaaaaccaaaaaaaaattgaaaaatttcagaaaatgatttcacaaaaaaaaagagtgttcatgtagttgcattacatttaggatcgagtatagagtgtttcatttaggattgttgcatatgcatagggaataatgatgagatagccttgtaagcattttggttcactggataaactcagtgccctcgttgctagttgtcttttgcgtagtcaatgaaattgaagtaaaaccgaaccatgcctagattcctctactcgaccacactgtcatgatctgataccattccctatcaatttgaacctgaatctgatctttaattatcatgtctgcatcaaatttgaactcatggataccctaaaatacttggattttcttattcattttgatcactcttgttaatccaagtagttgactctccttattagagcagttaacccgaaccaaaatctagactttctttcaagccttatatcacttgtgagtgtttctgaggtcttatttcgattaagcttggtagaaagtgttaggtttgtaacgacagagataatgtctcatgtagttctagttcgcatttttcggactagataggactaggtgggtgcttatactttgggttgggatgtgtctaaaagaaaaagaaaaaacaaaagagttgattcattgatgagaaaaggtaaaaggctctaggtgaagtaagctaaagaagtagaaaaagtctagtaaaggttttgggatttgtaaagaaaagaaaagggttcttgtcagctaatgaagaagggcaaaagtcctcggttttaaaaattgaaaagaggatccttagttgttaaagaaatacaaatccgctagatgtatcagagtgttgagaaagcttctcctagagttaagagaaaagaaaagaatgattagaaaaaggggttaaaagattcatgaatgcaaagggtagagttaagttcttatattgggattggagatgggattaccattagagcttcattggttatactcttggtagatgggatcttatctctgtatgcatagcttgggacttacctttagcattctactaaagcttaatcattttttgagagatccccttttgctgaagcctattctgtaaggggccatctttgtcacttgacctttaccttagccaaatgagttcattgatagatgcattgcttgattcacgttccataactaatgaatgttaaagggattggtagatttgaaaacatgtgtaggctgagcataagagtcggattgattgataacaaggcatagctaacgtttttgagtagaattcaatcatatcgcagcttagaactatcaacttggacattgatttcatctgatttatctggtgctttggctcaaagtccccgccttcaactctcacctcctacttgttcttaattgtttgcttgagggcaagcaaagactaagtttgggggagttgataagtgtgcattttgcctgttttgagcatccatttgtcatcactttatcatcatatcatcattgttttatatcatttgtcatcactttgcatgtttaggatagttttgcatgcatgttgcatatttgtgttgttttcaggtgatttggagctgttgacgagctaattggaagaagcgttcctgatcatgtcaaaccactcgacccccaggtcgagtagatgcttcacgacctcaacagaccactcgaccccctggtcgagtagaggacttcaccacttcacctcaccactcgaccccctggtcgagtctcataacctccaccacctgaccatcactcgatcacactactctaccacatggtcgactaccttcatcaccttcactcgatcactctaccacctggtcgagtatcatcacctccacacttgaccatcactcgatcacaccactctacaaggaagtcgagtgataagtggtgaacctatcaagaagattaagaacagaaagagatagaatcggatgaagaagaagaagaagatagagtggataaaggatagaggagagtaataataggaagtttgattaatactttgataccttaaccctaaagtagagttcaacatttatagtagtttccctatggaaaactacacacactctctcagactcttacttaaacaacatacagttaatatgaactatagcatacttatttctttgacacttcaaagcctctggatgcgacagagtgtttccttgcactttcttaaactctctttagccacttgggtcaaagatcttctttgaatcctcttccttgttgctctatctcctttccttgcttctccttccatagtctccaccttatcattactcccccgtaacgaagccaccttgtcctcaaggtgaaatgctgggaactgctgcctgatgactttcattggctcccatgtattctcacactctggcagacctctccatttaatcaataactcagtatctgcgcccgtgctgctttcccttatctctagtacatcttcaggttcaggttcccactccaagttagaagtcataatcgctgggagaggttgagcttgggctgaacttggttgcgcatgcttcagctgtgatatatggaagaccgggtgtatggagatgctgcttggtaactgaagtttgtaggctactgcacctattttttgaagaatctgataaggaccaaaaaatctgggagatagcttctcattgcgacgctgtgccacggttacctgcctgtaaggtcttaactttagataaacccaatcgccaactatgaattccagctcccttctatgcttgttagctgatttttgcattcgggcttgagctgcctgcagattttctctcagcatcgtgaccactctgtccctttcttgtagcatctcctctaccaccgcgttagcttttgggatgtcaccaaatcgtaacagtttcggtggttctcttccgtacaaggcctgaaatggagtcatcttgatggcagaatgaaacgaagtgttagaccagtattctgcccaggaaaacaattgagcccaagattttggctttccattaacaaaacagcgaaggtaagtctctaagcatctgtttaggacctcggtttggccatccgactgtgggtggtatgctgtgctcttagccagatgtgttccttgggacttgaaaagagcagaccaaaagtgactgacaaaaatcttgtcccgatctgaaaccatactctctagaaatccatgaagtctaacaatctctttaataaacacttctactactgatttagctgtgtaaggatgcttaaggggaataaaatgaccatacttgctgagccgatctaccacgacgagtaccgcatcatatccacttgaaactggaagcccttcaatgaaatcaaggctgatattggaccataccttagtcggaatgggtaatggttgcaagaggccggctggagacaatgtagaatacttgttttgttgacaaacttgacaacccttgaggaactccaccacgtccttgcgcatgcctttccagtaaacttcactagataaccttttaaatgtcttaaacgctccttcatgtcctccaatgggactagtatgaaactgttccagcaattttgggataaaaggagagctttctggcataacaattctgccatccttatataaggtgttagctaccagactgtatcctttctccccttcctctcctctaagcagttgttcctgtatgagtttgaggctgggatcattttgtacctgtgcctacagttcttccttgttcactgtcgccgaagctagaaacagcatgttcattatttgctcggttactggacgtctagatagcgcgtctgctactctattttctgagtcatgcttatactcaatctcatagtccaggctaactaatttcgaagcccacctttgttgtatggctgacactgccttctggttgagtaagtgtttcaggcttctctaatcagtcctgataatgacttttctcccgtgaggtagtgcttccacttatccactacaaaaacaatcgccaaaagtttcctctcatatattgatttaactctgcctttactggagaatccttggctaatgaacgcaatgggacgcttatcctgagatagaactgctcctatacccgtgcctaaagcatcagtctctatcacaaatggcttctcaaaatctggtaatgctaacgttggaagacagataaccgcctcttttaaagcctcaaaagtacttgtaccttcaacagaccattcaaatttccctttcttgagtaattctgtcagtggctttgctatcttcccataacctgccacaaaccttctgtagtaaccagtaaggcctaaaaacccgcgcagctctgttatattcttgggctgtggccactttaccatagcttctatctttgtgggatctgtagaatctccttcgctagtgatcatatggcccaaatatgatatccttgtgcaaccaaagtggcatttcttctcattggcgtagaacctgttctgtaaccgaatctgaagaaaaacctctaagtgtttgagatgtgtctctacatcaagattgtataccagaatgtcgtcaaagaacactaaaacaaaccggcgcatatatggtctaaacagctcattcatcactgattggaaggtggctggtgcattagtcagcacaaagggcattgataatagtttttttagtcaattatcctaaaacaccaatcatatcgttgtagtactgaaggttgtcaatccaaatgggtgtgatgctaacaatcaagatgtgatcagaagtcactaagtcaagccaagcaataacaggttttggtgtgttctagcagtcctaagtgaatatgcagaaaacagaaaatgaaacagaaacagtaaaaaacactcgaccaacacagctctttgcagagcactgggtgaggtcgagtaacagacaaaaaatgaaacacagatactcgactgcacagtctgttgccatacaactaggtggtcgagtatgaggtcgagtaacaagaaagaactgcagaaattaagcaacagataacaagatgcagtaaacaacaatatagtaaacaaagaattcaatcagataaagaattcccgaggatggggaaattgagtagtttcgttttctcagtttacaggtgattgacatgctcagtaaattaaccctagacaacaagttcattaaccaaatctaagtgccaccgcaacagagaccctcaagttaacctagttccagattcaatcaccattgacgagagctaacctaacaggcattacgaatcaacaagttaaagccaaaacgctccctgcaaccaataccttggtactgggtcacgaatctcttgaattagtggttcagacatttcatcgaacaccttttgggcgcggaaatgtctgggctcaaattctagttgatcagaaagcaataggcattaagaacaactaatccagaagggatctatcaaccaatactcaatcacctagcatactgagaattctacactactctaacccatcctcagaaacctattcactactcagacatcataatagaaagcagaaacgttgaacaggttgaagacatgacaacaacagtgtaacagtaggatgataacagaatgaacaacagtaaacgaaatcaagaacaaaagctgaatactgaacactgaatagataaagagaaatccggattacaaaaagtctagaacacaaggtctgcagaataaaactagataaaaacttcttgtctgcgaaaatgtgaagtacatgctacttatagccaaatattccgaaaccctaatactcaaaacgacaaagtattgggacggattaagaactgtactcgacccatgtggtcgagtgggaggtcgagtgaatagctggagtcttcttttctttcttgtgctcgagtgtctggttgagtgcggaatgaagaaggctctgaagcttgtcatcgagtatgcaatcgagtggtgtgatggtgatactcgacttccatgtagagtgatgaggtcgagtagaggtctagcaatgggatgaagtcactacatctgggggtcgagtgatgtgatcgagtggtggtcaagagatggagatgaagacactcgacctgggggtcgagtgatgtgatagagtggtggtgtcttctactcgacctgggggtcgagtggtctcttgagatcttgaagctcctactcgacctcttggtcgagtggtttgtcatgatcaggtccgcttcttccagttagatcgtcgacagctccaaatcacctgaaaacaacacaaatatgcaacatgcatgcaaaactatcctaaacatgcaaagtgatgacaaatgatgtgaaatggtataaaacagtgatgatatgatgctaaaatgatgacaaatggatgctcaaaacatgcaaaatacaaacttatcaactcccccaaacttagtctttgcttgcctcaagcaaacaatcaagaacaagctggaggtgaggtttgaaagcggggactcagagccaaagcaccagatagaccagatgaaatcaatgtccaagttgaaagttctaagctgcaagatcgaattctacttaaaaaagttagttatgcctcatcaatcaatcaatccgactcatatgctcgacctacacaagttttcaaatctaccaatccctttaacattcattagttctggaacgtgaatcaagcaatgcatcatcaaagaactcatttggctaaggtaaaaggtcaagagacaaagatggtcccttacagaataggcttcaataacaggggatctctcaaaaaatgattaagctttagtagaatgctaaaggtaagtcccaagctatgcatacagagataagatcccatctacccagagtacatcaaatgaagctctaatggtaatcccatctccaatcccaatacaagaactaaactctaccctttgcattcatgaatcttttaagccctttttctaatcattcttttcttttctcttaactctaggagaagctttctcaacactttgatacatctagcggatttggatttctttaacaactaaggttcctgtttttaacattttaaaaccaagggcttttgcccatcttcaatagctaacaagaactctttcttttctttacaaatcccaaaacctttagtagactttttctgcttctttagcttacttcacctagagtcttttaccttttcttatcaataaatcaaccttttttttttcttttaaacacatcccaacccaaagtataagcgcccacctagtcctatctagtccaaaaaatgcgaactagaactacatgagacactatctctgtcgttacgaacctaacactttctaccaagcttaatcggaataagacctcacaaacactcacaagtgatatagggcttgaaagaaagtctaggtttgggtttgggttaactgctctaataaggagagtcagctacttggattaacaagagtgatcaaaatgaataagaaaatccaagtattttagggtatccatgagttcaaatttgatgcagacatgataattaaagatcagattcaggttcaaattgatagggaatggtatcagatcatgatagtgtggtcgaatagagcaatctaggcatggttcagttttatttcaaattcattgactacgcaacagacaactagcaacgagggcactgagtttatcctgtgaatcaaaatgcttacaaggctatctcatcatcatcccctatgcatatgcaacaatcctaaatgaaacactctagactcgatcctaaatgtaatgcaactacatgaacactctttttttgtcaaatcattttctaaaatttttcaattttttttggtttttctatcccttagatgaatgcagactcaaaaatataacacacacttcctgagccctcccccaaacttaaatcacacagtccactatgcgaataaacttggaagagagtactcaggacaaatccaatcacagaaacgaaatgaagaaacaaatcacaacagatgatataatacaatggtgaagtgaggcgcgtacctcaatcgaagaatgaacgtagttgctcgtcaatggctgcctgtgattgctcccaggccatagacgaaccaccttgttctgtatcagctccagcaggtgggtactcgacctcattagctctgtggcggccagcaccgctctgaggatactcgacctctctccttctgctacggccggcaccgcggtcaagtgatctcctcgagtgaatgaggtgtgatctgctcctagatcaagtgagtgtagccttccttcttctcttgtgctcccgggactcgaatgacaaatgcctaaccggggcatgagagactctctgctcgctaagctcaggcttgtgcgcaggcttatcaaatctcctcgatggcatctccagaggaggcaatacctgtggaatagctgtggtggaggaggaacaactcagcttatctgtcagaagcttgatagccttgaaacacttggcgagcaacttgtcctgcttcttgcaccacttctgcaatttacttttgttcttatgagcttcggtcaagctcttgctctgcctcgctggaggtacatcttcaccaaagtgatacatgctagtgtcgaactccactgcgcaatcgtcatccatcccatccgaaacagcttcttctagaagatcctcctcattgaatggcggagcgttctcatagtagaggcgtccaacctcaggccaaaaatcaatattatctccctctattatccgtgtaacctcagggctagggagaaggatgttagctctcctgtctgtagagtgctcaaacctgaacctgtggaagtcgtcaaccattgcaaactctaggaattcgcagtgacgtaggtgctcgatatccattgctcgcggctcgagtccggcagatatgattgggactccacaagctatcagaatcggtgtcacaacaccacctatgcacagagcgcctcgtgctctcttgcggttattgctgacagcccaactcttgtatccacacagatggatcagaagaagtacagagagaggtgtgtcattgatttcaccttggagagacataccattcttcgtttggcgaagagttcccttgagggccattgcgatcatctccatatcagagttagtaacagtccctgtgatctctcgggagtagagtacattggctatagaacgctggaagtacctgatgacagggctgcgtatctgattgctctttgacctagaagcattcagcggtacagagctgcaaatggtgatccacaagtctttcaactcttctctgtcatacttgggcttagatcccgttccactggggaagccaaacaatccttccaagcgcttgattgataacctatactcatggccatacacagaaaattgcaagaatcccaatccttcacaatccaactcatcagaggtcataccttggtagagctctacttgcagcgtggaaagaaattgtattgtctcatcttcatacgctacatacggataagccatcagagtgtccagatgacaactctggtacaggtgttgaacatcttccaacaatccgagttgtgcaagtgaggtcgagtaaggatacctcgtgctacagaactcgttcagcttgaaaagcctaacatattcctcagcaggcaatacgtcgggcttgtgcagaagtttggtagctctacgagtctgttcaggcatgtactcgtcttcctgatcttcgtctataagctcatacctctcagtgatcgctctcttccctcgggctatctcagctttccttctgaagctttcatattctctttgttctctctctggccttgaagatgttgactctgtctcatccatgttgtagtcaggatcaacagaagaactgccactgtaattgctcatgattctcctgtaaaaatttagaactcaaagctcaaagtcaataggttagtctcaaagatagcaatgaaaccaaaattgttatcaataggcaatgaaataaaccctattggtcgagtacaattctgtactcgagtagactgagctgttcttgagttccctttagacgatttggatcgagtatcgtctccggattcgagtgggtatgcttcaggagatcgagtaagttgtggaggttgagttcagccggtgaagcctagaggtcgagtaaacactctgacagttcttcagggctctgttgctttcaagaacaagaggtcgagttgctgctgcagaggtcgagtgaatactcgaggtcgagtgatagtttgtggtctagtagcttggtcgtaatcaagtggtcacggagacttcgacggtgaacgaggaggagtactcgattacggaagcgcagaggtcgagtggttcccggaggtcgagtgacggaagatatgatctggtgacggcggcgcggatgtcgagtaactctcggaggccgagtgatattgtcaggatcgagtatctctttggacggcgattcgtggtgtagagagattagagtgtcggtggtgaaatgaaaagaggtaggtcgagtggattttgtgaagtcgagtgatgtttttaaatgagtggtctaggttgagttttagattctctctccagcttatcctcagcgcgtggtccacactctgttgactgaaaaaatatgcagaagatctactgtaaactgcaagaaatccttgcaagtctctgtagctcctgttggtcgagtacaatgatgtttttttaaaattttggattttaaacatcacgtatactcgactgatgtactcgaattccgtgtctccagacgcagcagaaaactttataaattttgtactccaccaggttatacactcaatctccaggtcttctgtagagtaaaagttttgaatttttactctatctccacgttgttcccttttctctgaaaaccacaaacacaattaaaacaaatcaaaaataacaagacaagaaattttttatttacagagataatcatgggacttcctcccaagtgagcttgtttaaagtcattagcttgactcctttactcctttaatcatcaagaggttcttggagatgaaccgatgtcacctctggaaggatttggtctgctaagtatttcttgagcctttgaacatttactgtaaaatctctactcttaccagctagagtgactgctccataaggacggacctcagtgatacagaatgggccagaacatctggatttaagttttcttggaaagagtttcaagcgatagttgttgtatcttttgtagccaccctggttgttttatgtagctgacttcttccaactggttaccctccccatcttggacttgaaattgctcgtcatcaacaaggaagtgcacatgcttctgctggctaagaagaatcatgtccagcttgtcattcagcgctttgatctccttcctgtgtttgtcatcagaatcagctgttcctctgacgtatcacagtccacgttgtaattgccatctgattgagcgaggttctcaaccaattcccagccttcttcaacatccttgttctggaaattcccattgctagctgtatccagaagcattctgatgcgtggtaggactcctctgtaaagagtgctgagcagagaggctttagtaaagccatgatgagggcattggttggtgtaccccttgaaacgctcccatgcttcacagaagctttcaccagtcttctgtgagaaaccagaaatctcatttctgagtcttgcagttctggcattggagaagaactttgatagaaaagccttcttgcaatcatcctaggtggtgattgagtcatggggcagattcttctcccagatgtgtgctttgtcgcccaaggagaatgggaacaaacggagcttgaatccgtcttcactgacaccattgatctttgttaggttgcagagcctatcgaattcatcaaggtggtcgagtggatcctccattggcagaccatggaatttgttcccctgaatcatcgagatgagaccactcttaatctcgaagttgttgttctggatcgcaggaggtgcaattcctttcctctggcggtgatcacgtggtgcatctccagcaccaatgttggcagggccattttgttgattctgttcttcagccatttcgagtggttgctgagatacaggggtgactgtggttctcctttttctgagttcgcgagctatgcggttgatgttgtcgtcgaaaaggaggttctgattgcctgttgatcgaattcgcatacagcagaggtgtacctggatcaagaagacaacaagaaaaacacacagttagtaaccgaaaagaaaattgaaaaagaacttgatctaagcaagtctgaaatctcaaatgtaacaaacaaacacccaattggcaacggcgccaaattgataataggttttttagtcaattatcctaaaacaccaatcatatcgttgtagtattttaggttgtcaatccaaatgggtgtgatgctaacaatcaagatgtgatcagaagtcactaagtcaagccaagcaataacaggttttggtgtgttctagcagttctaagtgaacatgcagaaaacagaaaatcaaacagaaacagtaaaacactcgaccaacacagctctttgcagaacactgggtgaggtcaagtgacaggtcgagtaacagacagaaaatgaaacacagatactcgactgtacagtctgttgccaaacaactaggtggtcgagtatgaggtcgagtaacaagaaagaactgaagaaattaagcaacagataacaagatgcagtaaacaacagtagagtaaacaaagaattcaatcagataaagaattcctgaggatggggtaattgagtagtttcgttttctcagtttacaggtgattgacatgctcagtaaattaaccttagataacaagttcattaaccaaatctaagtgccaccgcaactgagaccctcaagttaacctagtcccagactcaatcaccattgacgagagctaacctaacaggcattacgaatcaacaagttaaagccaaaacgctccttgcaaccaataccttggtacagggtcacgaatctctggaattagtggttcaaacatttcatcgaacaccttttgggcacggaaatgtctgggctcaaattccagttgatcagaaagcaataggcattaagaacaactaatccagaagggatctatcaatcaatactcaatcacctagcatactgagaatcctacactactctaagccatcctcaaaaacctattcactactcagacatcataacagaaagcataaacgttgaacaggtggaagacatgataacaacagtgtaacaacatgatgataacagaatgaacaacagtaaacgaaatcaagaacaaaagctgaatactgaatactgaatagataaagagaaatcgggattacaaaaagtctagaattaagatccatttgctgtgggtcataccagccatgtaggaataccatatcttgtttataagagctttgatacatgcaaaatattcgaaaacaatgtccgatcatataattttcgccctgtaatatagcaaatatcacgaaaaggcccgaaaaagtacattaaggtcaaaattaggagtagaataaaaacccaatagaagaattacattttccttcctcattcatcggagagctctctttaggatttccgaaatggtatcacatgcgaagttttgcctcactatctaaaagttatggagtcatacatttttaacaaaaaaaagaagagaaaaaccgaaaaagaaaagagggattcaacacgaggactttccgggaggtcacccatcctagtactattatcgcccaagcacgcttaactgcggagttttaatgggatccggtgcattagtgctggtatgatcgcatccgctactacatgcaatgcaatcgtatctattcttttttgaagactttacgatccatttgccatgggtcccaccagctatgtaggaataccctatcttgtttataagagctttgatacatgcaaaatattcgaaaacactgtccgaacatataattttcgctccgtatatagcaaagatcacgaaaaggcccaaaaaagtacattaacgtcaaaatttggagtagaaaaaaaaaccaatagaagaattccattttccttccttattcatcagagagctctttttgggctttccgaaaaggtatcacatccgaagtttggcctcactgtctaaaagtaatagagtcatacattcttaacaaaaaaaagaggacaaaaaccgaaaaaagaaaagagggatccaacacgaggactttccgggaggtcacccatcctagtactactctcgcccaaacacgcttaactgcacagttttgatgggatcyggtgcgttagtgctggtatgatcgcatcygytactacatgcaatgcaatcgtatctattcttttttgaagactttacgatccatttgccrtgggtcccaccagctatgtaggaataccctatcttgtttataagagctttgatacatgcaaaatattcgaaaacactgtccgaacatataattttcgctccgtatatagcaaagatcacgaaaaggcccaaaaaagtacattaacgtcaaaatttggagtagaaaaaaaaaccaatagaagaattccattttccttccttattcatcagagagctctttttgggctttccgaaaaggtatcacatccgaagtttggcctcactgtctaaaagtaatagagtcatacattcttaacaaaaaaaagaggacaaaaaccgaaaaaagaaaagagggatccaacacgaggactttccgggaggtcacccatcctagtactactctcgcccaaacacgcttaactgcacagttttgatgggatccggtgcgttagtgctggtatgatcgcatccgctactacatgcaatgcaatcgtatctattcttttttgaagactttacgatccatttgccatgggtcccaccagctatgtaggaataccctatcttgtttataagagctttgatacatgcaaaatattcgaaaacactgtccgaacatataattttcgctccgtatatagcaaagatcacgaaaaggcccaaaaaagtacattaacgtcaaaatttggagtagaaaaaaaaaccaatagaagaattccattttccttccttattcatcagagagctctttttgggctttccgaaaaggtatcacatccgaagtttggcctcactgtctaaaagtaatagagtcatacattcttaacaaaaaaaagaggacaaaaaccgaaaaaagaaaagagggatccaacacgaggactttccgggaggtcacccatcctagtactactctcgcccaaacacgcttaactgcacagttttgatgggatctggtgcgttagtgctggtatgatcgcatctgttactacatgcaatgcaatcgtatctattcttttttgaagactttacgatccatttgccgtgggtcccaccagctatgtaggaataccctatcttgtttataagagctttgatacatgcaaattattcgaaaacaatgtccgaatatataacttttgctccgcaatatagcaaagatcacgaaaaggcccaaaaaagtacattaacgtcaaaatttggagttggaaaaaaaaacaatagaagaattcagttttccttcctcattcatcggagagctctctttgggctttccaaaatggtatcacatgcgaagttttgcctcactgtctaaaagttatagagtcatacatttttaacaaaaaaagaaaaagaaaaaccgaaaaaagaaaagagggatgcaacacgaggactttccgggaggtcacccatcctagtactactgtcgccccaagcacgcttaactacggagttttgatgggatcaggtgcattagtgctggtatgatcgcatccgttactacatgcaatgcaatcgtatctattcttttttgaagactttacgatccatttgccatgggtcccaccaactatgtaggaatatcctatcttgtttataagacctttgatacatgcaaaatattcgaaaacaatgtccgaacatataattttcgctccgtaatatagtaaagatcacgaaaaggcccaaaaaagtacattaacgtcaaaatttggagtagaaaaaaaaccaatagaaaaattcaattttccttcctcattcatcggagagctctctttgggctttctgaaaaggtatcacatgcgaagtttggcgtcactgtctaaaccttatagagtcatacatttctaacaaaaaaaaatagagaaacaccgaaaaaagaaaagagggatgcaacaggaggactttccgggaggtcacccatcctagtactactctcgcccaaacacgcttaactgcggagttttgatgagatccggtgcgttagtgctgatatgatcgcatccgttactacatgcaatgcaatagtatctattcttttatgaagactttactatccatttgtcgtgggtcccaccagctatgtaggaataccctatcttgtttatgagagctttgatacatgcaaaatattcgaaaacaatgtccaaacatataattttcgctccgtaatatagcaaagatcacgaaaaggccttaaaaagtaccttaacgtcaaaatttggagtagaaaaaaaaagaatagaagaattcaattttccttcctcattcatcagagagctctttttgggctttccgaaaaggtatcacatgcgaagtttggcctcactgtctaaaagtaatagagtcatacattcttaacaaaaaaaagaggacaaaaatcgaaaaaagaaaagagggatccaacacgaggactttccgtgaggtcacccatcctagtactagtctcgcccaaacacgcttaactgcacagttttgatgggatccggtgcgttagtgctggtatgatcgcatccgttactacatgcaatgcaatcgtatctattctttttcgaagactttacgatccatttgccgtgggtcccaccagctatgtaggaataccctatcttgtttatcagagctttgatacatgcaaaatattcgaaaacaatgtccaaacatataattttcgctccgtaatatagcaaagatcacgaaaaggccccaaaaagtacattaacgtcaaaatttggagtagaaaaaaaaaccaatagaaaaattcaattttccttcctcattcaccggagagctctctttgggctttctgaaaaggtatcacatgcgaagtttggcctcacggtctaaaagttaaagagtcatacaattttaacaaaaaaacatagagaaaaaccgaaaaaagaaaagagggatgcaacacgaggactttcttggaggtcacccatcctagtactactctctcccaagcacgcttaagtgtagagttttgatgggatccggtgcattagtgctggtatgatcgcatccgtttactacatgcaatgcaatcgtatctattcttttttgaaaactttatgatccatttgtcgtgggtcacaccagccatgtaggaatacgatatcttgtttataagagctttgatacatgaaaaatattcgaaaacaatgtccgaacatagcaaagatcacgaaaaggcccgaaaaactacattaaggtcaaaatttggaatagaaaaaaaaacaatagaagaatttcattttgcttcctcattcatcggagagctctctttgggctttccgaaaaggtatcacatgccaagtttggcctgacggtctaaacgttatagagtcatacatttttaacaaaacaaaatagagaaaaaccgaaagaaaaagtgggatgcaccacgaggactttttggtaggtcccccatcctagtactactctcgcccaaacacgcttaactgtggagttttgatgggatccggtgcgttagtgctgatatgatcgcatccattactacatgcaatgcaatagtatctattcttttttgaagattttactatccatttgccgtgggtcccaccaggtatgtaggaataccctatcttgtttatctgagctttgatacatgcaaaatattcgaaaacaatgtccaaacatataattttcgccccgtaatatagcaaagatcacgaaaaggcccgaaaaagtacattaagctcaaaatttggaatagaaaaaaaaaacaatagaagaattccattttgcttcctcattcatcggagagctctctttgggcttccgaaaaggtatcacatgccaagtttggcctgacggtctaaacgttatagaatcatacatttttagcaaaacaaaatagagaaaaaccgaaagaaaaagtcggatgcaccacggggactttctggtaggtcccccatcctagtactactctcgcccaagcacgcttaactgcggagttttgatgggatccgttgcattagtgctggtatgatcgcatccgttaactacatgcaatgcaatcgtatctattcttttttggaagactttaagatccatttgccgtggctcccaccagctatgtaggaataccctatcttgtttataagagctttgatacatgcaacatattcgaaaacaatgtccgatcatataattttcgccctgtcatatagcaaagatcacgaaaaagaccaaaaaagtacattaaggtcaaaatttggagtagaataaaaaaccaatagaagaattccattttctttcctcattcataggagagctctctttgggctttccgaaaaggtatcacattccaagtttggcctcatggtctaaaagttataaagtcgtacatttttaacaaaaaaaagaaaagagggatgcaacacgaggactttccgggaggtcacccatcctagtactactctcgcccaagtatgctcaactgcggagttttaattggatctggtgcattagtgctggtgtgatcgcatccgttactacatgcaatgcaatcgtatatattctttttttgaagactttatgatccatttgctgtgggtcacgccagccatgtaggaataccatatcttgtttataagagctttgatacatacaaaatattcaaaaccaatgtccgaacatataatttcgccccgtaatatggcaaagatcacgaaaaagcccgaaaaagtacattaaggtcaaaatttggaatagaaaaaacaaacaatagaagaattccattttccttcctcattcatcggagagctctctttgggctttccgaaaaggtatcacatgcaaagtttggcctcacggtctaaaagttatagagtcatacaattttaacaaaacaaaatagagaaaaaccgaaaaagaaaagagggatgcaacacgaggactatccgggaggtcacccagcctagtactactctcgcccaagcacgcttaactgcgtagttttgatgggatccggtgcattagtgctggtatgatcgcatccgtttactacatgcaatgcaatcgtatctatctttttttttaagactttatgatccatttgtcgtgggtcacaccagccatgtaggaataccatatcttgtttataagagctttgatacatgcaaaatattcgaaaacaatgtccgatcatataatttttgccctgtaatatagcaaatatcacgaaaaggaccaaaaaagtacattaaggtcaaaatttggaatagcaaaaaaaccaatagaagaattccattttccttcctcattcatcggagagctctctttgggctttccgaaaaggtatcacatgcgaagtttggcgtcacggtctaaaagttatagagtcatacaattttaacaaaacaaaatagagaaaaaccgaaaaagaaaagagggatgcaacacgaggactgtccgggaggtcacccagcctagtactactctcgcccaagcacgcttaactgcggagttttgatgggatccgttgcattagtgctggtatgatcgcatccgtttactacatccaatgcaatcgtatctattctttttttgaagactttaagatccatttgccgtggctcccaccagctatgtaggaataccctatcttgtttataagagctttgatacatgcaaaatattcgaaaacaatgtccgatcatataattttcgccctgtcatatagcaaagatcaccaaaaagaccaaaaaagtacattaaggtcaaaatttggagtagaataaaaaaccaatagaagaattccattttccttcctcatttatcggagagctctctttgggctttccgaaaaggtatcacattccaagttttgcctcacggtctaaacgttatagagtcatacatttttaacaaaacaaaatagagaaaaaccgaaagaaaaagtgggatgcaccacgaggactttctggttggtcccctatcctagtactactctcgcccaagcacgcttaactgcggagttctgatgggatctggtgcattagtgctggtatgatcgcatccgttactacatgcaatgcaatcgtatgtattcttttttgaagactttaagatccatttgccgtggctcccaccagctatgtaggaataccctatcttgtttatcagagctttgatacatgcaaaatattcgaaaacaatgtacgatcatataattttcgccctgtcatatagcaaagatcacgaaaaagaccaaaaaagtacattaaggtcaaaatttggagtagaataaaaaaccaatagaagaattccattttctttcctcattcataggagagctctctttgggctttccgaaaaggtatcacattccaagtttggcctcatggtctaaaagttataaagtcgtacatttttaacaaaaaaaaagaaaagagggatgcaacacgagtactttccgggaggtcacccatcctactactactctcgcccaagtatgcttaactgcggagttttaatgggatctggtgcattagtgctggtatgatcgcatccgttattacatgcaatgcaatcgtatatattctttttttaaagactttatgatccatttgccgtgggtcacaccagccatgtaggaataccatatcttgtttctaagagctttgatacatgcaaaatattcgaaaacaatgtccgaacatataattttgccccgtaatatagcaaagatcacgaaaaggcccaaaaaagtacattaaggtcaaaatttggaatagaaaaaaaaccaatagaagaattccattttccttcctcattcatcggagagctctctttgggctttccgaaaaggtatcacatgcgaagtttggcctcacggtctaaaagttatagagtcatacaattttaacaaaacaaaatagagaaaaaccgaaaaagaaaagagggatgcaacacgaggactgtccgggaggtcacccggcctagtactactctcgcctaagcacgcttaactacggagtttcttcttgcttttcaaagctttcatggtgtagccaaagtcaatatgagtctttggctttgtgtcttctaacaaggatacactacttaggcttacaagatcgggttgcggtttaagttgttatactcaatcatacacatgacatcaagtcatatttgactccaaaacactaaccaaccttcttcttgcttctcaaagctttcatggtgtagccaaagtccatatgagtctttgactttgtgtcttctaacaaggatacactacttaggcttacaagatcgggttgcggtttaagttcttatactcaatcatacacatgacatcaagtcatattcgactccaaaacactaaccaaccttcttcttgcttctcaaagctttcatggtgtagccaaagtccatatgagtctttggctttgtgtcttctaacaaggatacaattcttacgcctttaagatcgcgttgcggtttaagttcttatactcaatcatacacatgacatcaagtcatattcgactccaaaacactaaccaaccatcttcttgcttctcaaagctttcttggtgtagccaaagtccatatgagtctttggctttgtgtcttttaacaaggatacaattcttacgcctttaagatcgggttgcggtttaagttcttatactcaatcatacacatgacatcaagtcatattcgactccaaaacactaaccaaccttcttcttgcttcttaaagctttcatggagtagccaaagtccatctgagtctttggctttgtgtcttctaacaaggcaacactacttaggcttacaagatcgggttgcggtttaagttcttatactcaatgatacacatgacatcaagtcatattcgactttaaaacactaaacaaccttcttcttgcttctcaaagctttcatggtgtagccaaagtcaatatgagtctttggctttgtgtcttctaacaaggatacactacttaggcttacaagatcgggttgcggtttaagttcttatactcaatcatacacatgacatcaagtcatattcgactccaaaacactaaccaaccttcttcttgcttctcaaagctttcatggtgtagccaaagtccatatgagtctttggctttgtgtcttctaacaaggatacaattcttacgcctttaagatccggttgcggtgtaagttcttatactcaatcatacacatgacatcaagtcatattcgactttaaaacactaaccaacctttttcttgcttctcaaagctttcatggtgtagccaaagtccatatgagtctttggctttgtgtcttctaacaaggatacactacttaggcttacaagatcgggttgcggtttaagttgttatactcaatcatacacatgacatcaagtcatatttgactccaaaacactaaccaaccttcttcttgcttctcaaagctttcatggtgtagccaaagtccatatgagtctttggctttgtgtcttctaacaaggatacactacttaggcttacaagatcgggttgtggtttaagttgttatactcaatcatacacatgacatcaagtcatattcgactccaaaacactaaccaaccttctacttgcttctcaaagctttcatggtgtagccaaagtccatatgagtctttggctttgtgtcttctaacaaggatacaattcttacgcctttaagaccgggttgaggtttaagttcttatactcaatcatacacatgacatcaagtcatattcgactccaaaacactaaccaaccttcttcttgcttctcaaagctttcatggtgtagccaaagtccatatgagtctttggctttgtgtcttctaacaaggatacaattcttacgcctttaagatccggttgcggtttaagttcttatactcaatcatacacatgacatcaagtcatattcgactttaaaacactaaccaaccttcttcttgcttctcaaagctttcatggtgtagccaaagtccatatgagtctttggctttgtgtcttctaacaaggatacactacttaggcttacaagatcgggttgcggtttaagttgttatactcaatcatacacatgacatcaagtcatatttgactccaaaacactaaccaaccttcttcttgcttctcaaagctttcatggtgtagccaaagtccatatgagtctttggctttgtgtcttctaacaaggatacaattcttacgcctttaagatcgggttgcggtttaagttcttatactcaatcatacacatgacatcaagtcatattcgactccaaaacactaaccaaccttcttcttgcttctcatagctttcatggcgtagccaaagtccatatgagtctttggctttgtgtcttctaacaaggatacaattcttacgcctttaagatcggcttgcggtttaagttcttacactcaatcatacacatgacatcaagtcataatcgactccaaaacactaaccaaccttcttcttgcttctcaaagctttcatcgtgtagccaaagtccatatgagtctttggctttgtgtcttctaacaaggatacaattcttacgcctttaagatccggttgcggtttaagttcttatactcaatcatacacatgacatcaagtcatattcgactccaaaacactaaccaatcttcttcttgcttctcaaagttttcatggtgtagccaaagtcaatatgagtctttggctttgtgtcttctaacaaggatacactacttaggcttatagatcaggttgcggtttaaggtccttataatcacactggsgtcatacctgaattctgattcgactccaaaacactaaccaaccttcttcttgcttctcaaagctttcatggtgtagccaaagtccatatgagtctttggctttgtgtcttctaacaaggatacactwcttacgcttayaagatcgggttgcggtttaagttcttatactcaatcatacacatgacatcaagtcatattcgactccaaaacactaaccaaccttcttcttgcttctcaaagctttcatggtgt

SEQ ID NO: 190 - DNA, 121001 bp, Arabidopsis thaliana
  modified_base (2128)..(120379): N = A, C G, or T/U
agagctctctttgggcattccaaaaaggtatcacatgccaagtttggcctcacggtctaaaagttatagagtaatacatttttaccaaaaaaaaaagagaaaacccgaaaaaaagagggatgcaacacgaagacttttctggaggtcacccatcctagtactactctcccccaagcacgcttaactgtggtgttctgataggatcaagtgcattagtgctggtatgatcgcatcagttactacatgtaatgcaatcatatatattcttttttgaagactttatgatccatttgccgtaggtcccaccagctatgtaggaataccctatcttgtttataagagctttgatacatgcaaaatattcgaaaacaatgtccgaacatataatttttgtcccgtaatatagcaaagatcacgaaaaggccaggaaaaatacatttcggtcaaaatttggagtagaaaaaaaacccttcctcattcattggacagctctctttgggctttccgaaaaggtatcacatgccaagtttggcctcacggtctaaaccttatagactcatacatttttcacgaaaaaaagaagagaaaaaccaaaaaaaagagtgattaaacacgaggactttcctggaggtcacccatcctagtactactctcgcccaagcacgcttaactgcgaagttctgatgggatctggtgcattagtgctggtatgatcgcatctgttactacatgcaatgcaatcgtatctattcttttttgaagattttatgattcatttaccgtgggtcccaccagctatgtaggaataacctatcttatttataaaagctttgatacatgcaaaatatttgaaaacaatgtccgaacatataatgttcgccccaaaatatagcaaagaccacaaaaatgccataaaaagtacattaaggtcaaaattaggagtaggaaaaaaatcaataggagaattccattttccttccttcattcatcggagagctctctttgggcattccaaaaaggtatcacacgccaagtttggcctcacggtctaaaagttatagagtattacatttttaacaaaaaaaaaagagaaaaaccgaaaaaaagagggatgcaacacgaagacttttctggaggtcatccatcctagtactactctcgcccaagcacatttaactgcggtgttctgataggatcaagtgcattagtgctggtatgatcgcatcagttactacatgcaatgcaatcatatatattcttttttgaagactttatgatccatttgccgtaggtcccaccagctatgtaggaataccctatcttgtttataagagctttgatagatgcaaaatattcaaaaacaatgtccgaacatataatttttgtcccgtaatatagcaaagatcacgaaaaggccagaaaaaatacatttcggtcaaaatttggagtagaaaaaaaacccttcctcattcattggacagctctctttgggctttccgaaaaggtatcacatgccaagtttggcctcacggtctaaaccttatagactcatacatttttcacaaaaaaaagaagagaaaaaccaaaaaaaagagtgattaaacacgaggactttcctggaggtcacccatcctagtactactctcgcccaagcacgcttaactgcgaagttctgatgggatctggtgcattagtgctggtatgatcgcatctgttactacatgcaatgcaatcgtatctattcttttttgaagattttatgattcatttaccgtgggtcccaccagctatgtaggactaacctatcttatttataagatctttgatacatgcaaaatattggaaaacaatgtccgaacatataatgttcgccccaaaatatagcaaagaccacaaaaatgccataaaaaatacattaaggtcaaaatttggagtaggaaaaaaatcaataggagaattccattttccttccctcattcatcggagagctctctttgggcattccaaaaaggtatcacatgccaagtttggcctcacggtctaaaagttatagagtattacatttttaacaaaaaaaannnnnnnnnnnnnnnnnnnnnnnnnnnnnnnnnnnnnnnnnnnnnnnnnnaaaaaaaagagtgattaaacacgaggactttcctggaggtcacccatcctagtactactctcgcccaagcacgcttaactgcgaagttctgatgggatctggtgcattagtgctggtatgatcgcatctgttactacatgcaatgaaatcgtatctattcttttttgaagattttatgattcatttaccgtgggtcccaccagctatgtaggaataacctatctcgtttataagagctttgatacatgcaaaatattcgaaaacaatgtccgaacatataatgtttgccccaaaatatagaaaagaccacgaaaatgccataaaaagtacattaaggtcaaaatttggagtaggaaaaaaaatcaataggagaattccattttccttcctcattcatcggagagctctctttgggcattccataaaggtatcacatgccaagtttggcctcacggtctaaaagttatagagtaatacatttttaacaaaaaaaaaagagaaaaaccgaaaaaaagagggatgcaacacgaagacttttctggaggtcacccatcctagtactactctcccacaagcacgcttaactgtggtgttctgataggatcaagtgcattagtgctggtatgatcgcatcagttactacatgtaatgcaatcatatatattcttttttgaagactttatgatccatttgccgtaggtcccaccagttatgtaggaataccctatctcgtttataagagctttgatacatgcaaaatattcgaaaacaatgtccgaacatataatgtttgccccaaaatatagcaaagaccacgaaaatgccataaaaagtacattaaggtcaaaatttggagtaggaaaaaaaatcaataggagaattccattttccttcctcattcatgggagagctctctttgggcattccaaaaaggtatcacatgccaagtttggcctcacggcctaaaagttatagagtaatacatttttaacaaaaaaaaaagagaaaaaccgaaaaaaagagggatgcaacacgaagacttttctggaggtcacccatcctagtactactctcccccaagcacgcttaactgtggtgttctgataggatcaagtgcattagtgctggtatgatcgcatcagttactacatgcaatgcaatcatatatattcttttttgaagactttatgatccatttgccgtaggtcccaccagctatgtaggaataccctatcttgtttataagagctttgatacatgcaaaatattcgaaaacaatgtccgaacatataatttttgtcccgtaatatagcaaagatcacgaaaaggccaggaaaaatacatttcggtcaaaatttggagtagaaaaaaaacccttcctcattcattggacagctctctttgggctttccgaaaaggtatcacatgccaagtttggcctcacggtctaaaccttatagactcatacatttttcacaaaaaaaagaagagaaaaaccaaaaaaaagagtgattaaacacgaggactttcctggaggtcacccatcctagtactactctcgcccaagcacgcttaactgcgaagttctgatgggatctggtgcattagtgctggtatgatcgcatctgttactacatgcaatgcaatcgtatctattcttttttgaagattttatgattcatttaccgtgggtcccaccagctatgtaggactaacctatcttatttataagatctttgatacatgcaaaatattggaaaacaatgtccgaacatataatgttcgccccaaaatatagcaaagaccacaaaaatgccataaaaaatacattaaggtcaaaatttggagtaggaaaaaaatcaataggagaattccattttccttccctcattcatcggagagctctctttgggcattccaaaaaggtatcacatgccaagtttggcctcacggtctaaaagttatagagtattacatttttaacaaaaaaaaacgagaaaaaccgataaaaagagggatgcaacaccaagacttttctggaggtcacccatcctagtactactctcccccaagcacgcttaactgtggtgttctgataggatcaagtgcattagtgctggtatgatcgcatcagttactacatgcaatgcaatcatatatattcttttttgaagactttatgatccatttgccgtaggtcccaccagctatgtaggaataccctttcttgtttataagagctttgatacatgcaaaatattcgaaaacaatgtccgaacatataatttttgtcccgtaatatagcaaacatcacgaaaaggccagaaaaaatacatttcggtcaaaatttggagtagaaaaaaaacccttcctcattcattggacagctctctttgggctttccaaaaaggtatcacatgccaagtttggcctcacggtctaaaccttatagactcatacatttttcacaaaaaaaagaagagaaaaaccaaaaaaaagagtgattaaacacgaggactttcttggaggtcacccatcctagtactactctcgcccaagcacgcttaactgcgaagttctgatgggatctggtgcattagtgctggtatgatcgcatctgttactacatgcaatgaaatcgtatctattcttttttgaagattttatgattcatttaccgtgggtcccaccagctatgtagaaataacctatcttatttataagagctttgatacatgtaaaatattcgaaaacaatgtccgaacatataatgttcgccccaaaatatagcaaagaccacaaaaatgccataaaaagtacattaaggtcaaaatttggagtaggaaaaaaatcaataagagaattccattttccttccctcattcatcggagatctctctttgggcattccaaaaaggtatcacatgccaagtttggcctcacggtctaaacgttatagagtaatacatttttaacaaaaaaaaaagagaaaaaccgaaaaaaagagggatgcaacacgaagacttttctggaggtcacccatcctagtactactctcccccaagcacgcttaactgtggtgttctgataggatcaagtgcattagtgctggtatgatcgcatcagttactacatgcaatgcaatcatatatattcttttttgaagactttatgatccatttgccgtaggtcccaccagctatgtaggaataccctttcttgtttataagagctttgatacatgcaaaatattcgaaaacaatgtccgaacatattatttttgtcccgtaatatagcaaagatcacgaaaaggccaggaaaaatacatttcggtcaaaatttggagtagaaaaaaaacccttcctcattcattcgacagctctctttgagctttccgaaaaggtatcacatgccaagtttggcctcacggtctaaaccttatagactcatacatttttcacaaaaaaaaagaagagaaaaaccaaaaaatagagtgattaaacgcgaggactttcctggaggtcacccatcctagtactactctcgcccaagcacgcttaactgcgaagttctgatgggatctggtgcattagtgctggtatgatcgcatctgttactacatgcaatgaaatcgtatctattcttttttgatgattttatgattcatttaccgtgggtcccagcagctatgtaggaataacccatccttgtttataagagctttcatacatgcaaaatattcaaaaacaatgtccgaacatataatttttgtccggtaatattgcaaagatcacgaaaaggccagaaaaaatacatttcggtcaaaatttggagtagaaaaaaaacccttcctcattcattggacagctctctttgggttttccgaaaaggtatcacatgccaagtttggcctcacggtctaaaccttatagactcatacatttttcacaaaaaaaagaagagaaaaaccaaaaaaaagagtgattaaacacgaggactttcctggaggtcacccatcctagtactactctcgcccaagcacgcttaactgcgaagttctgatgggatctggtgcattagtgctggtatgatcgcatctgttactacatgcaatgcaatcatatctattcttttttgaagattttatgattcatttaccgtgggtcccaccagctatgtaggaataacctatcttatttataaaagctttgatacatgcaaaatattcgaaaacaatgtccgaacatataatgttcgccccaaaatatagcaaagaccacaaaaatgccataaaaagtacattaaggtcaaaatttggagtaggaaaaaaatcaataggagaattccattttccttccctcattcatcggagagctctctttgggcattccaaaaaggtatcacatgccaagtttggccttacggtctaaaagttatagagtaatacatttttaacaaaaaaaaaagaaaaaaaccgaaaacaaagagggatgcaacacgaagactttcctggaggtcacccatcctagtactactctcgcccaagcacacttaactgcggtgttctgataggatcaagtgcattagtgctggtatgatcgcatcagttactacatgcaatgcaatcatatatattcttttttgaagactttatgatccatttgccgtaggtcccaccagctatgtaggaataccctatctcgtttataagagctttgatacatgcaaaatattcgaaaacaatgtccgaacatataatttttgtcccgtaatatagcaaagatcacgaaaaggccagaaaaaatacatttcggtcaaaatttggagtagaaaaaaaacccttcctcattcattggacagctctttttgggctttccgaaaaggtatcacatgccaagtttggcctcacggtctaaaccttatagactcatacatttttcacaaaaaaaagaagagaaaaaccaaaaaaaagagtgattaaacacgaggactttcctggaggtcacccatcctagtactactctcgcccaagcacgcttaactgcgaagttctgatgggatctggtgcattagtgctggtatgatcgcatctgttactacatgcaatgcaatcgtatctattcttttttgaagattttatgattcatttaccgtgggtcccaccagnnnnnnnnnnnnnnnnnnnnnnnnnnnnnnnnnnnnnnnnnnnnnnnnnntcacggtttaaaagttatagagtcatacatttttcccaaaaaaaccaagagaaaaccaaaaaaaaagagtgatgaaacacgaggactttcctggaggtcacccatcctagtactactctcgcccaagcacgcttaactgcgaagttctgatgggatctggtgcattagtgctggtatgatcgcatcagttactacatgcaatgcaatcgtatatattcttttttgaagactttatgatccatttgtcgtaggtcccaccagttatgtaggaataccctatctcgtttataagagctttgatacatgcaaaatattcgaaaacaatgtccgaacatataatgtttgccccaaaatatagcaaagaccacgaaaatgccataaaaagtacattaaggtcaaaatttggagtaggaaaaaaatcaataggagaattccattttccttcctcattcattggagagctctctttgggcattccaaaaaggtatcacatggcaagtttggcctcacggtctaaaagttatagagtaatacatttttaacaaaaaaaaaagagaaaaaccgaaaaaaagagggatgcaacacgaagacttttctggaggtcacccatcctagtactactctcccccaagcacgcttaactgtggtgttctgataggatcaagtgcattagtgctggtatgatcgcatcagttactacatgcaatgcaatcatatatattcttttttgaagacgttatgatccatttgccgtaggtcccaccagctatgtaggaacaccctatcttgtttataagagctttgatacatgcaaaatattcgaaaacaatgtccgaacatataatttttgtcccgtaatatagcaaagatcacgaaaaggccagaaaaaatacatttcggtcaaaatttggagtagaaaaaaaacccttcctcattcattggacagctctctttgggctttccgaaaaggtatcacatgccaagtttggcctcacggtctaaaagttatagagtcatacatttttcacaaaaaaaacaagagaaaaacaaaaaaaaagagtgatgaaacacgaggactttcctggaggtcacccatcctagtactactctcgcccaagcacgcttaactgcgaagttctgatgggatctggtgcattagtgctggtatgatcgcatctgttactacatgcaatgcaatcgtatatattcttttttgaagactttatgatccatttgtcgtaggtcccaccagttatgtaggaataccctatctcgtttataagagctttgatacatgcaaaatattcgaaaacaatgtccgaacatataatgtttgccccaaaatatagcaaagaccacgaaaatgccataaaaagtacattaaggtcaaaatttggagtaggaaaaaaaatcaataggagaattccattttccttcctcattcattggagagctctctttgggcattccaaaaaggtatcacatgccaagtttggcctcacggtctaaaagttatagagtaatacatttttaacaaaaaaaaaagagaaaaaccgaaaaaaagagggatgcaacacgaagacttttctggaggtcacccatcctagtactactctcccccaagcacgcttaactgtggtgttctgataggatcaagtgcattagtgctggtatgatcgcatcagttactacatgcaatgcaatcatatatattcttttttgaagactttatgatccattgtcgtaggtcccaccagctatgtaggaataccctttcttgtttataagagctttgatacatggaaaatattcgaaaacaatgtccgaacatataatttttgtcccgtaatatagcaaagatcacgaaaaggccagaaaaaatacatttcggtcaaaatttggagtagaaaaaaagcccttcctcattcattggacagctctctttgggctttccgaaaaggtatcacatgccaagtttggcctcacggtctaaaccttatagactcatacatttttcacaaaaaaaagaagagaaaagccaaaaaaaaagagtgattaaacacgaggactttcctggaggtcacccatcctagtactactctcgcccaagcacgcttaactgcgaagttctgatgggatctggtgcattagtgctggtatgatcgcatctgttactacatgcaatgaaatcgtatctattcttttttgaagattttatgattcatttaccgtgggtcccaccagctatgtaggaataacctatcttatttataagatctttgatacatgcaaaatattggaaaacaatgtccgaacatataatgttcgccccaaaatatagcaaagaccacaaaaatgccataaaaagtacattaaggtcaaaatttggagtaggaaaaaaaccaataagagaattccattttccttccctcattcatcggagatctctctttgggcattccaaaaaggtatcacatgccaagtttggcctcacggtctaaaagttatagagtaatacatttttaacaaaaaaaaaaagagaaaaaccgaaaaaaagagggatgcaacacgaagacttttctggaggtcacccatcctagtactactctcccccaagcacgcttaactgtggtgttctgataggatcaagtgcattagtgctggtatgatcgcatcagttactacatgtaatgcaatcatatatattcttttttgaagactttatgatccatgtgccgtaggtcccaccagctatgtaggaataccctatctcatttataagagctttgatacatgcaaaatattcgaaaacaatgtccgaacatataatgtttgccccaaaatatagcaaagaccacgaaaatgccataaaaagtacattaaggtcaaaatttggagtaggaaaaaaaatcaataggagaattccattttccttcctcattcattggagagctctctttgggcattccaaaaaggtatcacatggcaagtttggcctcacggtctaaaagttatagagtaatacatttttaacaaaaaaaaaagagaaaaaccgaaaaaaagagggatgcaacacgaagacttttctggaggtcacccatcctagtactactctcccccaagcacgcttaactgtggtgttctgataggatcaagtgcattagtgctggtatgatcgcatcagttactacatgcaatgcaatcatatatattcttttttgaagacgttatgatccatttgccgtaggtcccaccagctatgtaggaacaccctatcttgtttataagagctttgatacatgcaaaatattcgaaaacaatgtccgaacatataatttttgtcccgtaatatagcaaagatcacgaaaaggccagaaaaaatacatttcggtcaaaatttggagtagaaaaaaaacccttcctcattcattggacagctctctttgggctttccgaaaaggtatcacatgccaagtttggcctcacggtctaaaagttatagagtcatacatttttcacaaaaaaaacaagagaaaaacaaaaaaaaagagtgatgaaacacgaggactttcctggaggtcacccatcctagtactactctcgcccaagcacgcttaactgcgaagttctgatgggatctggtgcattagtgctggtatgatcgcatctgttactacatgcaatgcaatcgnnnnnnnnnnnnnnnnnnnnnnnnnnnnnnnnnnnnnnnnnnnnnnnnnntatgatcgcatgtgttactacatgcaatgtaatcgtatctattcttttttaaagactttatgatccatttgccgtgagtcccaccagctatgtaggaatattctatcttctttataagagctttgatacatgcaaaatacntggaaaacaatgtccgaacatataattttccccccgtaatatagcanagatcacgaaaaggcccgaaaaagtacatttagttcanaatttggagtagaaaaaaaaacaatagaagaattccattttccttcctcaatcatcggagagctctctttgggctttccgaaaaggtatctcatgccaagtttggcctcacgaactaaaagttatagagtcatacatttttaacaaaacaaaatagagaaaaaccgaaaaaagagggatgcaacacaaggactttccgggaggtcacccatcctagtactactctcgcccaagcacccttaactgcggagttctgatgggatccggtgcattagtgctggtatgatcgcccgtgttactacatgcaatgcaatcgtatctattcttttttaaagattttatgatccatttgccgtgggtcccaccagctatgtaggaataccctatcttctttataagaggtttgatacatacaaaatattggatcacaatgtcagaacatataattttccccccttaatatagcaaagatcactaaaaggcccgaaaaaatacatttagttcaaaatttggagtagaaaaaaaaacaatagaagaattccattttccttcctcagttatcggagaactctctttgggctttccgaaaaggtatcacatgccaagtttggcctcacggtctaaaagatatagagtcatacattattaacaaaacaaaatagagaaaaaccgaaaaaaagaaggatgcaacacgaggactttgcgggaggtaatctatcctagtactactctcgcccaagcacccttaactgcggagttctgatgggatccggtgcattagtgctggtatgatcgcatgtgttactacatgcaatgtaatcgtatctattcttttttaaagactttatgatccatttgccgtgggtcccaccagctatgtaggaatactctatctactttataagagctttgatacatgcagaatattggaaaacaacgtccgaacatataatttccccccccccccccgtaatatagcaaaaatcacgaaaaggcccgaaaaagtacatttagttcaaaatttggagtagaaaaaaaaacaatagaagaatttcattttccttcctcagtcatcggagagctctctttgggctttccaaaaaggtatcacatgccaagtttggcctcacagtctaaaagttatagagtcatacatttttaacaaaacaaaatagagaaaaaccgaaaaaaagagggatgcaacacgaggactttccgggaggtaatctatcctagtactactctcgcccaagcacccttaactgcggagttctgatgggatccggtgcagtagtgctggtatgattgcatgtgttactacatgcaatgtaatcgtatctattcttttttaaagactttatgatccatttgccgtgagtcccaccagctatgtaggaatattctatcttctttataagagctttgatacatgcaaaatactggaaaacagtgtccgaacatataattttccccccgtaatatagcaaagatcacgaaaaggcccgaaaaagtacatttagttcaaaatttggagtagaaaaaaaaacaatagaagaattccattttccttcctcaatcatcggagagctctctttgggctttccgaaaaggtatctcatgccaagtttggcctcacgaactaaaagttatagagtcatacatttttaacaaaacaaaatagagaaaaaccgaaaaaagagggatgcaacacaaggactttccaggaggtcacccatcctagtactactctcgcccaagcacccttaactgcggagttctgatgggatccggtgcattagtgctggtatgatcgcatgtgttactacatgcaatgtaatcgtatctattcttttttaaagattttatgatccatttgccgtgggtcccaccagctatgtaggaataccctatcttctttataagagctttgatacatacaaaatattggatcacaatgtcagaacatataattttccccccttaatatagcaaagatcactaaaaggcccgaaaaaatacatttagttcaaaatttggagtagaaaaaaaaacaataaaagaattccattttccttcctcagttatcggagaactctctttgggctttccgaaaaggtatcacatgccaagtttggcctcacggtctaaaagatatagagtcatacattattaacaaaacaaaatagagaaaaaccgaaaaaaatagggatgcaacacgaggactatcctggaggtcacccatcctagtactaatctcgcccaaccacccttaactgcgtagttctgatgggatccgatgcattagtgctggtatgatcgcatttgttactatatgcaatataatcgtatctattcttttttaaagactttatgatccatttgccgtgggtcccaccagctatgtaggataccctatcttcataataagagctttgataaatgcaaaatattggaaaacaatgtccgaacatataatttccccccccccccccggtaatatagcaaagatcacgaaatagcccaaaaaagtacatttaggtcaaaatttgagtagaaaaaaaacaaatagaggaattccattttccgtcctcattcatcggagagctctctttcggctttccgaaaaggtatcacatgccaagtttggcctcacggtctaaaagttatagagtcatacattttaaacaaaacaaaatagagaaaaaccgaaaaaaagaaggatgcaacacgaggactttccgggaggtcacccatcctagtactactctcgcccaagcacccttaactgcggagttctgatgggatcaggtgcattagtgctggtatgatcgcatgtggtactacatgcaatgtaatcgtatatattcttttttaaagactttatgatccatttgccgtgggtcccaccagctatgtaggaataccctatcttctttataagagctttgatacatgcaaaatatttgaaaacaatgtccgaacatataattttccccccgttatatagcaaagatcacgaaaaggcccgaaaaagtacatttagttcaaaatttggagtagaaaaaaagacaatagaagaatttcattttccttcctcagtaatcggagagctctctttgggctttccgaaaaggtatcacatgccaagtttggcttcacggtataaaagttatagagtcatacatttttaacaaaaaaaaactagaaaaacagaaaaaaagagggatgcaatacgaggactttccaggaggtcacccatcctagtacaactctcgccgaagcacgcttaactgcggtgttcagatgggatctggtgcattagtgctggtatgatggcatttgttactacatgcaatgcaatcgtatctattcttttgtaaagactttatgatccatttgccgtgggttccaccagctatgtaggaataccctatcttgtttataagagatttgatacatgcaaaatattcgaacacaatgtccgaacatataatttttgccccgtaatatagcaaagatcacgaaaaggcccgaaaaagtacattaaggtcaaaatttggagtagaaaaaaaacacaatagaagtattccattgtccttcgtcattcatcgaagagctctctttgggcttttcgaaatgatatcatatgccaagtttggcctcacggtctaaaatttatagagtcatacatttttaacaaaacaaaaagagaaaaaccgaaaaaaagagggatgcaacacgaggactttcctggaggtcacccatcctagtactactctcgcccaagcacccttaactgcgtagttctgatgggatccgatgcattagtgctggtatgatcgaatctgttactacatgtaatgcaatcatatatattcttttttgaagactttatgatccatttgccgtaggtcccaccagctatgtaggaataccctatctcgtttataagagctttgatacatgcaaaatattcgaaaacaatgtccgaacatataatgtttgccccaaaatatagcaaagaccacgaaaatgccataaaaagtacattaaggtcaaaatttggagtaggaaaaaaaatcaataggagaattccattttccttcctcattcatcggagagctctctttgggcattccaaaaaggtatgacatgccaagtttggcctcacggtctaaaagttatagagtaatacatttttaacaaaaaaaaaagagaanaaaccgaaaaaaagagggatgcaacacgaagacttttctggaggtcatccatcctagtactactctcccccaagcacgcttaactgtggtgttctgataggatcaagtgcattagtgctggtatgatcgcatcagttactacatgcaatgcaatcatatatatnnnnnnnnnnnnnnnnnnnnnnnnnnnnnnnnnnnnnnnnnnnnnnnnnnaaagtcaaaatttggagtagaaaaaaacccaatagaagtattccattctccttcgtcattcatcggagagctctctttaggctttccgaaaagatatcacatgccaagtttggcctcacggtttaaaagttatagagtcatagatttttaacaaaacaaaaagagaaaaaccgaaaaaaattgggatgcaacacgaggactttcctggaggtcacccatcctagtactactctcgcccaagcacccttaactgcgtagttctgatgggatccgatgctntagtgctggtatgatcgcatctgttactacatgcaatgtaatcgtatctattctttnttaaagactttatgatccatttgccgtgggtcccaccagctatgtaggaataccctatcttctntataagagcntttgataaatgcanaatattggaaaccaatgtccgaacatataatttcgcccccgtaatatagcanagatcacgaaaaagcccaaaaaagttcatttaggtcaaaatttgagcagaagaaaaagaaatagaagaattccattttccttcctcatttattggagagctctctttgggctttccgaaaaggtatcacatgccaagtttggcctcacggtctaaaagttatagagtcatacatttttaacaaaatgaaatagagaaaaaccgaaaaaaagagggatgtaacacgaggactttccgggaggtaatctatcctactactactctcggccaagcacccttaactgcggagttctaatgggatccggtgcattagtgctggtatgatcgcatgtgttactacatgcaatgtaatcgtatctattcttttttaaagactttatgatccatttgccgtgggtcccaccagctatgtaggaataccctatcttctttataagagctttgatacatgcaaaatatatgaaaaaaacgtccgaacatataattttccccccgtaatatagcaaagatcatgaaaaggcccaaaaaagtacattaatgtcaaaatttggcgtagaaaaaaaaccaatagacatattccattgtccttcgtcattcattgaagagctctctttgggctttccgaaaaggtatcacatgccaagtttggcctcacggtctaaaagttatagagtcatacatttttaacaatacaaaatagagaaaaaccgaaaaaaagagggatgcaacacgaggactttccgggaggtaatccatcctagtactactctcgcccaagcacccttaactgcggagttctgatgggacccggtgcattagtgctggtatgatcgcatctgttactatatgcaatgtaatcgtatctattcttttttaaagactttatgatccatttgccgtgggtcccaccagctatgtaggaataccctatcttctttataagagctttgatatatgcaaaatattggaacaccatgtccgaacatataatttttcccgtgtaatatagcaaagatcaagaaaaagaaaaaaaagtacatttaggtcaaaatttgagtagaaaaaaacaaatagaagaattccattttccttcctcattcagctgagagctctctttgggctttccgaaaaggtatcatatgccaagtttggcctcacagtgtaaaagttatagagtctaacatttttaacaaaacaaaatagagaaaaaccaaaaaaagagggatgcaacacgaggactttctgggaggtcacccatcctagtactactctcgcccaagcacccttaactgcggagttctgatgggatccggtgcattagtgctggtatgatcgcatgtgttactacatgcaatgtaatcctatctattctttcttaaagactttatgatccatttgccgtgagtcccaccagctatgtaggaataccctatcttctttataagagctttgatacatgcaaaatattggaaaacaatgtccgaacatatagttttcccccgtaatatagcaaagatcacgaaaaggcccgaaaaagtacatttagttcaaaattgggagtagaaaaaaaaaacaatagaagaattccattttacttcctcagtcatcggagagctctctttgggctttccgaaaaggtatcacatgcccagtttggcctcacggtctaaaagttataaagtcatacatttttaacaaaaaaaaaagagaaaaaccgaaaaaaagagggatgcaatacgaggactttccacgaggtcacccatcctagtacaactctcgccaaagcatgcttaactgcggagtttagatgggatctggtgcattagtgctggtatgatcgcatctgttactacatgcaatgcaatcgtatctattcttatttaaagactttatcatccatttgccatgggtcccacctgtaggaatacccaatcttgtttataagagctttgatacatgcaaaatattcgaaaacaacgtccgaacatataattttcgccccgtaatatagcaaagatcacgaaaaggcccgaaaaagtacattaaggtcaaaatttggaatagaaaaaaaaaccaaaagaagtattccattgtcctttgtcattcatcgaagagctctctttgggctttccgaaaaggtatcgcaagccaagtttggcctcacggtttaaaagttataaagtcatacatttttaacaaaaaaaaaaagagaaaaaaccgaaaaaaagagggatgcaacacgaggacttttctggaggtcacccatcctagtactactctcgcccgatcacccttaactgcgtagttttgatgggattcgatgcattagtgctggtatgatcgcatctgttactacatgcaatgtaatcgtatctattcttttttaaagactttatgatccatttgccgtgggtcccaccagctatgtaggaataccctatcttctttataagagctttgatatatgcaaaatagtggaaaaccatgtccgaacatataatttttcccctgtaatatagcaaagatcaagaaaaagccaaaaaaagtatatttaggtcaaaatttggagtagaaaaaaaaacaatagaagaattccattttccttcctcagtcatcggagagctctctttcggctttccgaaaaggtatcaaatgccaagtttggcctcacggtctaaaagttatagagtcatacatttttaacaatacaaagtagagaaaaccggaaaaaagagggatgcaacatgaggactttccgggaggtaatccatcctagtacaactcttgcccaagcacccttaactgcggagttctgatggaatccggtgcattagtgctggtatgatcgcatgtgttactacatgnnnnnnnnnnnnnnnnnnnnnnnnnnnnnnnnnnnnnnnnnnnnnnnnnnccaaaaaggtatcacatgccaagtttggcctcncggtctaaaagttatagagtcatacatttttaacaaaccaaaatagagaaaaccggaaaaaagagggatgcaacacgaggactttccgggaggtcacccatcctagtactactttcgcccaagcacccttaactgcggagttctgatgggatccggtgcattagtgctggtatgatcgcatgtgttactacatgcaatgtaatcatatttcttgttatttaaagattttatgatccatttgccgtgggtcccaccatctatgtaggaataccttatcttctttataggagctttgatacatgcaaaatattggaaaacaatatccgaacatatatctttccccccgtaatatagcaaagatcgcgaaaaggcccgaaaaagtacatttaggtcaaaatttggagaggaaaaaaaaagcaatagaagaattccattttccttcctcagtcatcggagagctctctttgggctttccgaaaaggtatcacatgccaagtttggcctcatggtctaaaagttatagagccatacatttttaacaaaacaaaatagagaaaaaccaaaaaaagagagggatgcaacacgaggactttccgggaggtcacccatcctagtactactctcgcccaagcacccttaactgcggagttctgatgggatccagtgcattagtgctggtatgatcgcatgtgttactacatgcaatgtaatcgtatctattcttttttaaagattatatgatccatttgccgtgggtcccaccagctatgtaggaataccctatcttctttataagagctttgatacatgcaaaatattggaaaacaatgtccgaacatataattttccccccgtaatatagcaaagatcacgaaaaggcccaaaaaagtacatttaggtcaaaatttggagttgaaaaaaaacaaaaagaagaattccattttccttcctcattcattggagagctctctttgggctttccgaaaaggtatcacatgccatgtttagcctcacggtctaaaagttatagagtcatacatttttaacaaaacaaaatagagaaaaaccaaaaaaacgagggatgcaacacgaggactttctgggaagtcacccatcctagtactactctcgcccaagcacccttaactgcggagttctgatgggatccggtgcattagtgctggtatgatcgcatgtgttactacatgcaatgtaatcgtatctattgcttttaaagactttatgatccatttgccgtgggtcccaccagctatgtaggaataccctatcttctttataagagttttcatacatgcaaaatattggaaaacaatgtccgaacatataattttccccccgtaatatagcaaagatcacgaaaaggcccaaaaaagtacatttagttcaaaatttggagtagaaaaaaaaataatagaaaatttccaatttccttcttcattcatcggagagctctctttgggctttccgaaaaggtatcacatgccaagtttggcctcacggtctaaaagttataaagtcatacatttttaacaaaacaaaatagagaaaaacggaaaaagagggatgcaacacgtggactttccgggaggtcacccatcctagtactactctcgtccaaggacccttaactgcggagttctgttgggatccgttgcattagtgctggtatgatcgcatgtgttactacatgcaatgtaatcgtatctattcttttttaaagactttatgatccatttgccgtgggtcccaccaactatgtaggaataccctatcttctttataagagctttgatacatgcaaaatattggaaaacaatgtccgaacacataatttttcccccataatataacaaagatcacgaaaaggcccgaaatagtacatttagttcaaaatttggagtagaaaaaaaaccagtttaagaattccattttccttcctcattcatcggagagctctctttggactttccgaaaaggtatcacatgccaagtttggcctcacggtctaaaagttatagagtcatacatttttaacaaaacaaaatagagaaaaacagaaaaaagagggatgcaacacgaggactttccgggaggtcacccatcctagtactactctcgcccaagcacccttaactgcagagttctgctgggatccggtgcattagtgctggtatgatcgcatctgttactacatgcaatgtaatcgtatctattcttttttaaagcttttatgatccatttgccgtgggtcccaccagctatgtaggaataccctatcttctttataagagctttgatacatgcaaaatattggaaaacaatgtccgaacatataatttcccccctcgtaatatagcaaagatcacaaaaaggctcgaaaaagtacatttagttcaaaatttggagtagaaaaaaaccaacagaaaaattccaatttcctccctcattcatcggagagctctctttgggctttccaaaaaggtatcacatgccaagtttggcctcacggtctaaaagttatagagtcatacatttttaacaaaacaaaatagagaaaaacggaaaaaagagggatgcaacacgaggactttccgggaggtcacccatcctagtactactctcgtccaaggacccttaactgcgaagttctgatgggatccgttgcattagtgctggtatgatcgcatgtgttactacatgcaatgtaatcgtatctattcttttttaaagactttatgatccatttgccgtgggtcccaccagctatataggaaaacccaatcttctttataagagctttgatacatgcaaaatattggaaaacaatgtccgaacatataattttcccccataatatagcaaagatcacgaaaaggcccgaaaaagtacatttagttcaaaatttggagtagaaaaaaagacagtaaaagaattccattttccttcctcagtgatcggagagctctctttggactttccgaaaaggtatcacatgccaagtttggcctcacggtctaaaagttatagagtcatacatttttaacaaaacaaaatagagaaaaacggaaaaaagagggatgcaacacgaggactttccgggaggtcacccatcctagtactactttcgcccaagcacccttaactgcggagttctgatgggatccggtgcattagtgctggtatgatcgcatgtgttactacatgcaatgtaatcatatttcttgttatttaaagattttatgatccatttgccgtgggtcccaccatctatgtaggaataccttatcttctttataggagctttgatacatgcaaaatattggaaaacaatatccgaacatatatctttccccccgtaatatagcaaagatcgcgaaaaggcccgaaaaagtacatttaggtcaaaatttggagaagaaaaaaaaagcaatagaagaattccattttccttcctcagtcatcggagagctctctttgggctttccgaaaaggtatcacatgccaagtttggcctcatggtctaaaagttatagagccatacatttttaacaaaacaaaatagagaaaaaccaaaaaaagagagggatgcaacacgaggactttccgggaggtcacccatcctagtactactctcgcccaagcacccttaactgcggagttctgatgggatccagtgcattagtgctggtatgatcgcatgtgttactacatgcaatgtaatcgtatctattcttttttaaagattatatgatccatttgccgtgggtcccaccagctatgtatgaataccctatcttctttataagagctttgatacatgcaaaatattggaaaacaatgtccgaacatataattttccccccgtaatatagcaaagatcacgaaaaggcccaaaaaagtacatttaggtcaaaatttggagttgaaaaaaaacaaaaagaagaattccattttccttcctcattcattggagagctctctttgggctttccgaaaaggtatcacatgccatgtttagcctcacggtctaaaagttatagagtcatacatttttaacaaaacaaaatagagaaaaaccaaaaaaacgagggatgcaacacgaggactttctgggaagtcacctatcctagtactactctcgcccaagcacccttaactgcggagttctgatgggatccggtgcattagtgctggtatgatcgcatgtgttactacatgcaatgtaatcgtatctattgcttttaaagactttatgatccatttgccgtgggtcccaccagctatgtaggaataccctatcttctttataagagttttcatacatgcaaaatattggaaaacaatgtccgaacatataattttccccccgtatatagcaaagatcacgaaaaggcccaaaaaagtcctttaaggtcaaaatttgaagttgaaaaaaaacaaaaagaaaaattccattttccttcctcattcattgaaaagctctctttgggctttccgaaaaggtatcacatgccatgtttagcctcacggtctaaaagttatagagtcatacatttttaacaaaacaaaatagagaaaaaccaaaaaaacgagggatgcaacacgaggactttctgggaagtcacctatcctagtactactctcgcccaagcacccttaactgcggagttctgatgggatccggtgcattagtgctggtatgatcgcatgtgttactacatgcaatgtaatcgtatctattgcttttaaagactttatgatccatttgccgtgggtcccaccagctatgtaggaataccctatcttctttataagagttttcatacatgcaaaatattggaaaacaatgtccgaacatataattttccccccgtaatatagcaaagatcacgaaaaggcccaaaaaagtacatttagttcaaaatttggagtagaaaaaaaaacaatagaaaatttccaatttccttcttcattcatcggagagctctctttgggctttccgaaaaggtatcacatgccaagtttggcctcacggtctaaaagttataaagtcatacatttttaacaaaacaaaatagagaaaaacggaaaaagagggatgcaacacgtggactttccgggaggtcacccatcctagtactactctcgtccaaggacccttaactgcggagttctgttgggatccgttgcattagtgctggtatgatcgcatgtgttactacatgcaatgtaatcgtatctattcttttttaaagactttatgatccatttgccgtgggtcccaccaactatgtaggaataccctatcttctttataagagctttgatacatgcaaaatattggaaaacaatgtccgaacatataatttttcccccataatataacaaagatcacgaaaaggcccgaaaaagtacatttagttcaaaatttggagtagaaaaaaaccagtttaagaattccattttccttcctcattcatcggagagctctctttggactttccgaaaaggtatcacatgccaagtttggcctcacggtctaaaagttatagagtcatacatttttaacaaaacaaaatagagaaaaacagaaaaaagagggatgcaacacgaggactttccgggaggtcacccatcctagtactactctcgcccaagcacccttaactacagagttctgctgggatccggtgcattagtgctggtatgatcgcatctgttactacatgcaatgtaatcgtatctattcttttttaaagcttttatgatccatttgccgtgggtcccaccagctatgtaggaataccctatcttctttataagagctttgatacatgcaaaatattggaaaacaatgtccgaacatataatttcccccctcgtaatatagcaaagatcacaaaaaggctcgaaaaagtacatttaggtcaaaatttggagtagaaaaaaaaacaatagaagaattccattttccttcctcagtcattggagagatctctttgggctttgcgaaaaggtatcacatgccaagtttggcctcacggtctaaaagttataaagtcatacgtttttagcaaaaaaaaaagagaaaaaccgaaaaaaagagggatgcaacacgaggtcacccattctagtactactctcgcccaagcacccttaactgcgtagttctgatgggatctgaggcattagtgcttgtatgatcgcatctgttactacatgcaatgtaatcgtaaatattcttttttaaagactttattatccatttgccgtgggtccaaccagctatgtagggataccctatcttctttataagagctttgacacatgcaaaatattggaaaagaatgtccgaacatattcttttccccccgtaatatagcaaagatcacgaaaaggcccgaaaatgtatattaagttcaaaatttggagtagaaaaaaaaaacaatagatgaattccattttccttcctcattcattggagagctctctttgggctttccgaaaaggtatgacatttcaagtttggcctcatggtctcaaagttataaagtcatacatttttcacaaaaaaaaaaaaaagaaaaaccaaaaaaaaaaagagggatgtaacacgaggacttttttgggaggtcacccatcctagtactactctcgcccaagcacgcttaactgcggagttctgatgggatccagttcattagtgctggtatgatcgcatgtgttactatatgcaatgtaatcgtatctattcttttttaatgactttatgatccatttgctgtgagtcccaccagctatgtaggaataccctatcttctctataagagctttgatacatgcaaaatattggaaaacaatgtccgaacatatagttttccccccgtaatatagcaaagatcacgaaaaggcccgaaaaggtacatttagttcaaaatttggagtagaagaaaaaacaatagaagaattccatttcccttcctcagtcatcggagagctctctttgggctttccaaaaaggtatcacatgccaagtttggcctcacggtctaaaagttatagagtcatacatttttaacaatacaaaatagagaaaaaccgaaaaaaaagagggatgcaacacgaggactttccgggaggtaatccatcctagtactactctcgcccaagcacccttaactgcggagttctgatgggatccgatgcattagtgctggtatgatcgcatgtgttactacatgcaatgtaatcgtatctattcttttttaaagactttatgatccatttgccgtgggtcccaccagctatgtaggattagcctatcttgtttataagagctttgatacatgcaaaatattggaaaccaatgtccaaacatataattttcaccccgtaatatagcaaagatcacgaaaagtcccgaaaaagtacatttaggtcaaaatttggaatagaaaaaaaaaaaataggagtattccattttccttcctcattcatcggagagctctctttgagctttctgaaaaggtatcacatgccaagtttggcctcacggtctaaaagttatagagtcatacatttttaaaaatacaaaatagagaaaaaccgaagaaaagagggatgcaacacgaggactttccgggaggtaatccatcctagtactactctcgcccaagcacccttaactgcgaagttctaatggaatccggtacattagtgctggtatgatcgcatctgttactatatgcaatgtaatcgtatctattcttttttaaagactttatgatccatttgccgtgggtctcaccagctatgtaggaataccctatcttctttataagagctttgatatatgcaaaatattggaacaccatgtccgaacatataatttttcccgtgtaatatagcaaagatcaagaaaaagccaaaaaagtacatttaggtcaaaatttgagtagaaaaaaacaaatagaagaattctatattccttcctcattcgtcggagagctctctttgggctttccgaaaaggtatcatatgccaagtttggcctcgcggtctaaaagttacggagtctaacatttttaacaaaacaaaatagagaaaaaccgaaaaaagagggatgcaacacgaggactttccgggaggtcacccatcctagtactactctcgcccaagcacccttaactgcggagttctgatgggatccggtgcattagtgctggtatgatcgcatgtgttactacatgcaatgtaatcgtatctattctttcttaaagactttatgatccatttgccgtgagtcccaccagctatgtaggaataccctatcttctttataagagctttgatacatgcaaaatattggaaaacaatgtccgaacatatagttttccccccgtaatatagcaaagatcacgaaaaggcccgaaaaagtacatttagttcaaaatttggagtagaaaaaaaaacaatagaagaattccattttccttcctcagtcatcggagagctctctttgggctttccgaaaaagtatcacatgccaagtttggcctcacggtctaaacgttatagagtcatacatttttaacaatacaaaatagagaaaaaccgaaaaaagagggatgctacacgaagactttccgggaggtaatccatcctagtactactcttgcccaagcacccttaactgcggagttctgatggaatctggtgcattagtgctggtatgatcgcatgtgttactacatgcaatgtaatcgtatctattcttttttaaagactttatgatccatttgccgtgggtcccaccagctatgtaggaataccctattttctttataagagctttgatacatgcaaaatatatgaaaaaaacgttcgaacatataattttccccccgtaatatagcaaagatcacgaaaaggctcgaaaaattacatttagttcaaaatttttagtagaaaaaacccaatagaagaattccattttccttcctcagtcatcggagagctctctttgggctttccgaaaaggtatcacatgccaagtttggcctcacggtctaaaagttatagagtcatacatttttaacaaaacaaaattgagaaaaaccgaaaaaaagagggatgcaacacgaggactctccaaaaggtaacccatcttagtactactctcgcccaagcacccttaactgcggagttctgatgggacccggtgcatttgtgctggtatgatcgcatgtgtcactacatgcaatgtaatcgtatctattcttttttaaagactttatgatccatttgcagtgggtcctaccagctatgtaggaataccctaccttctttataagagctttcatacatgcataatattggaaaacaatgtccgaagatataattttccccccataatatagcaaagatcacgaaaaggcccgaaaaagtacattatgttcaaaatttggagtcgaaaaaaaaccaatagaagaattccattttacttccttagtcatcggagagctctctttgggctttccgaaaaggtatcacatgccaagtttggcctcacggtctaaaagttatagagtcatacatttttaacaaaacaaaatagagaaaaacgggaaaaaagagggatgtaacacgaggacattccgggaggtcacccatcctagtactactcttgcccaagcacccttaactgcggagttcttatgggatccggtgcattagtgttggtatgatcgcatgtgttactacatgcaatgtaatcgtatctattctttttaaagactttatgatccatttgccgtgggtcccaccagctatgtaggaataccctatcttctttataagagctttgatacatgtaaaatattggaaaacaatgtccgaagatataattttcccccgtaatatagcaaagatcacgaaaaggcccgaaaatgtacattaagttcaaaatttggagtagaaaaaaaaaacaatagaagaattccattttccttcctcattcatcggagagctctctttgggctttccgaaaaggtatgacattccaagtttggcctcatggtctcaaatttataaagtcatacatttttcacaaaaaaaaaataaagaaaaaccaaaaaaaaaaaagagggatgtaacacgaggacttttttgggaggtcacccatcctagtactactctcgcccaagcacgcttaactgcggagttctgatgggatccggttcattagtgctggtatgatcacatgtgttactacatgcaatgtaatcgtatctattcttttttaaagactttatgatccatttgccgtgagtcccaccagctatgtaggaataccctatcttctctataagagctttgatacatgcaaaatattggaaaacaatgtccgaacatatagttttccccccgtaatatagcaaagatcacgaaaaggcccgaaaaagtacatttagttcaaaatttggagtagaaaaaaaaacaataaaagaatttcatttcccttcctcagtcatcggagagctctctttgggctttccaaaaaggtatcacatgccaagtttggcctcacggtctaaaagttatagagtcatacatttttaacaatacaaaatagagaaaaaccgaaaaaaaagagggatgcaacacgaggactttccgggaggtaatcaatcctagtactactctagcccaagcacccttaactgcggagttctaatggaatccagtgcattagtgcgggtatgatcgcatgtgttactacatgcaatgtaatcgtatctattcttttttaaagactttatgatccatttgccgtgggtcccaccagctatgtaggaatacactatcttctttataagagctttgatacatgcaaaatattggaaaaaaacgtccgaacatataattttccccacgtaatatagcaaagatcacgaaaatgccccaaaaagtacatttagttcaaaatttggagtagaaaaaaaaacaatagaagaattacattttccttcctcactcatcggagagctctctttgggcttttcgaaaaggtaccacatgccaagtttggcctcacggtctaaaagttatagagtcatacatttttaacaaaataaaattgagaaaaaccgaaaaaaagagggatgcaacacgaggactctccagaaggtaacccatcttagtactactctcgctcttgcacccttaactatggagttctgatgggacccggtgcattagtgctggtatgatcgcatctgttactatatgcaatgtaatcgtatctattcttttttaaagactttatgatccatttgccgtgggtcccaccagctatgtaggaataccctatcttctttataagagctttgatatatgcaaaatattggattaccatgtccgaacatataatttttcccgtgtaatatagcaaagatcaagaaaaagccaaaaaagtacatttaggtcaaaatttgagtagaaaaaaacaaatagaagaattccattttccttcctcattcaccgtagagctctcattgggctttccgaaaaggtatcatatgccaagtttggcctcacggtctaaaagttatagagtctaacattcttaacaaaacaaaatagagaaaaaccgaaaaaagagggatgcaacacgaggactttccgggaggtcacccatcctagtactactctcgcccaaggacccttaactgcggagttctgatgggatccgttgcattagtgctggtatgatcgcatgtgttactacatgcaatgtaatcgtatctattctttcttaaagactttatgatccatttgccgtgcgtcccaccagctatgtaggaataccctatcttctttataagagctttgatacatgcaaaatattggaaaacaatgtccgaacatatagttttccccccgtaatatagcaaagatcacgaaaaggcccgaaaaagtacatttagttcaaaatttggagtagaaaaaaaaacaatagaagaattccattttccttcctcagtcatcggagagctctctttgggctttccgaaaaggtatcacatgccaagtttggcctcacggtctaaacgttatagagtcatacatttttaacaatacaaaatagagaaaaaccgaaaaaaagagggatgcaacacgaagactttccgggaggtaatccatcctagtactactcttgccaaagcacccttaactgcggagttctgatggaatctggtgcattagtgctggtatgatcgcatgtgttactacatgcaatgtaatcgtatctattcttttttaaagactttatgatccatttgccgtgggtcccaccagctatgtacgaataccctatcttctttataagagctttgatacatgcaaaatatatgaaaaaaacgtccgaacatataattttccccccgtaatatagcaaagatcatgaaaaggcccaaaaaagtacattaaggtcaaaatttggcgtagaaaaaaaaccaatagacatattccattggccttcgtcattcattggagagctctctttgggctttccgaaaaggtatcacatgccaagtttggcctcacggtctaaaagttatagagtcatacatttttaacaatacaaaatagagaaaaaccgaaaaaaagagggatgcaacacgaggactttccgggaggtaatccatcctagtactactctcgcccaagcacccttaactgcggagttctaatggaatccggtgcattagtgctggtatgatcgcatctgttactatatgcaatgtaatcgtatctattcttttttaaagactttatgatccatttgccgtgggtcccaccagctatgtaggaataccctatcttctttataagagctttgatatatgcaaaatattggattaccatgtccgaacatataatttttcccgtgtaatatagcaaagatcaagaaaaagccaaaaaagtacatttaggtcaaaatttgagtagaaaaaaacaaatagaagaattccattttccttcctcattcaccgcagagctctctttgggctttccgaaaaggtatcatatgccaagtttggcctcacggtctaaaagttatagagtctaacatttttaacaaaacaaaatagagaaaaaccgaaaaaagagggatgcaacacgaggactttccgggaggtcacccatcctagtactactctcgcccaaggacccttaactgcggagttctgatgggatccgttgcattagtgctggtatgatcgcatgtgttactacatgcaatgtaatcgtatctattctttcttaaagactttatgatccatttgccgtgcgtcccaccagctatgtaggaataccctatcttctttataagagctttgatacatgcaaaatattggaaaacaatgtccgaacatatagttttccccccgtaatatagcaaagatcacgaaaaggcccgaaaaagtacatttagttcaaaatttggagtagaaaaaaaaacaatagaagaattccattttccttcctcagtcatcggagagctctctttgggctttccgaaaaggtnnnnnnnnnnnnnnnnnnnnnnnnnnnnnnnnnnnnnnnnnnnnnnnnnngagaaaaaccgaaaaaagagggatgcaacacgaggactttccgggaggtcacccatcctagtactactctcgcccaaggacccttaactgcggagttctgatgggatccgttgcattagtgctggtatgatcgcatgtgttactacatgcaatgtaatcgtatctattctttcttaaagactttatgatccatttgccgtgcgtcccaccagctatgtaggaataccctatcttctttataagagctttgatacatgcaaaatattggaaaacaatgtccgaacatatagttttccccccgtaatatagcaaagatcacgaaaaggcccgaaaaagtacatttagttcaaaatttggagtagaaaaaaaaacaatagaagaattccattttccttcctcagtcatcggagagctctcttagggctttccgaaaaggtatcacatgccaagtttggcctcacggtctaaacgttatagagtcatacatttttaacaatacaaaatagagaaaaaccgaaaaaaagagggatgcaacacgaagactttccgggaggtaatccatcctagtactactcttgccaaagcacccttaactgcggagttctgatggaatctggtgcattagtgctggtatgatcgcatgtgttactacatgcaatgtaatcgtatctattcttttttaaagactttatgatccatttgccgtgggtcccaccagctatgtacgaataccctatcttctttataagagctttgatacatgcaaaatatatgaaaaaaacgtccgaacatataattttccccccgtaatatagcaaagatcatgaaaaggcccaaaaaagtacattaaggtcaaaatttggcgtagaaaaaaaaccaatagacatattccattggccttcgtcattcattggagagctctctttgggctttccgaaaaggtatcacatgccaagtttggcctcacggtctaaaagttatagagtcatacatttttaacaatacaaaatagagaaaaaccgaaaaaaagagggatgcaacacgaggactttccgggaggtaatccatcctagtactactctcgcccaagcacccttaactgcggagttctaatggaatccggtgcattagtgctggtatgatcgcatctgttactatatgcaatgtaatcgtatctattcttttttaaagactttatgatccatttgccgtgggtcccaccagctatgtaggaataccctatcttctttataagagctttgatatatgcaaaatattggattaccatgtccgaacatataatttttcccgtgtaatatagcaaagatcaagaaaaagccaaaaaagtacatttaggtcaaaatttgagtagaaaaaaacaaatagaagaattccattttccttcctcattcaccgcagagctctctttgggctttccgaaaaggtatcatatgccaagtttggcctcacggtctaaaagttatagagtctaacatttttaacaaaacaaaatagagaaaaaccgaaaaaagagggatgcaacacgaggactttccgggaggtcacccatcctagtactactctcgcccaaggacccttaactgcggagttctgatgggatccgttgcattagtgctggtatgatcgcatgtgttactacatgcaatgtaatcgtatctattctttcttaaagactttatgatccatttgccgtgcgtcccaccagctatgtaggaataccctatcttctttataagagctttgatacatgcaaaatattggaaaacaatgtccgaacatatagttttccccccgtaatatagcaaagatcacgaaaaggcccgaaaaagtacatttagttcaaaatttggagtagaaaaaaaaacaatagaagaattccattttccttcctcagtcatcggagagctctctttgggctttccgaaaaggtatcacatgccaagtttggcctcacggtctaaacgttatagagtcatacatttttaacaatacaaaatagagaaaaaccgaaaaaaagagggatgcaacacgaagactttccgggaggtaatccatcctagtactactcttgccaaagcacccttaactgcggagttctgatggaatctggtgcattagtgctggtatgatcgcatgtgttactacatgcaatgtaatcgtatctatacttttttaaagactttatgatccatttgccgtgggtcccaccagctatgtacgaataccctatcttctttataagagctttgatacatgcaaaatatatgaaaaaaacgtccgaacatataattttccccccgtaatatagcaaagatcacgaaaaggctcgaaaaattacatttagttcaaaatttggagtagaaaaaccccaatagaagaattccattttacttccttagtcatcggagagctctctttgggctttccgaaaaggtatcacatgccaagtttggcctcacggtctaaaagttatagagtcatacatttttaacaaaacataatagagaaaaacgggaaaaagagggatgtaacacgaggactttccgggaggtcacccatcctagtactactcttgcccaagcacccttaactgcggagttctgatgggatccggtgcattagtgttggtatgatcgcatgtgttactacatgcaatgtaatcgtatctattctttttaaagactttatgatccatttgccgtgggtcccaccagctatgtaggaataccctatcttctttataagagctttgatacatgcaaaatattggaaaacaatgtccgaacatattattttccccccgtaatatagcaaagatcacgaaaaggcccgaaaatgtacattaagttcaaaatttggagtagaaaaaaaaaacaatagaagaattccattttccttcctcattcatcggagagctctctttgggctttccgaaaaggtataacattccaagtttggcctcatggtctcaaagttataaagtcatacatttttcacaaaaaaaaataaagaaaaacaaaaaaaaaaaagagggatgtaacacgaggacttttttgggaggtcacccatcctagtactactctcgcccaagcacccttaactgcggagttctgatgggatccgttgcattagtgctggtatgatcgcatgtgttactacatgcaatgtaatcgtatctattctttcttaaagactttatgatccatttgccgtgagtcccaccagctatgtaggaacaccctatcttctttataagagctttgatacatgcaaaatattggaaaaaaacgtccgaacatataattttccccacgtaatatagcaaagatcacgaaaaggccccaaaaagtacatttagttcaaaatttggagtagaaaaaaaaacaatagaagaattccattttccttcctcagtcatcggagagctctctttgggctttccgaaaaggtatcacatgccaagtttggcctcacggtctaaacgttatagagtcatacatttttaacaatacaaaatagagaaaaaccgaaaaaaagagggatgcaacacgaagactttccgggaggtaatccatcctagtactactctttccaaagcacccttaactgcggagttctgatggaatctggtgcattagtgctggtatgatcgcatgtgttactacatgcaatgtaatcgtatctattcttttttaaagactttatgatccatttgccgtgggtcccaccagctatgtacgaataccctatcttctttataagagctttgatacatgcaaaatatatgaaaaaaacgtccgaacatataattttccccccgtaatatagcaaagatcacgaaaaggctcgaaaaattacatttagttcaaaatttggagtagaaaaacccctatagaagaattccattttccttcctcagtcatcggagagctctctttgggctttccgaaaaggtatcacatgccaagtttggcctcacagtctaaaagttatagagtcatacatttttaacaaaacaaaattgagaaaaaccgaaaaaaagagggatgcaacacgaggactctccagaaggtaacccatcttagtactactctcgcccaagcacccttaactgcggagttctgatgggacccggtgcattagtgctggtatgatcgcatgtgttactacatgcaatgtaatcgtatctgttcttttttaaagactttatgatccatttgccgtgggtcctaccagctatgtaggaataccctaccttctttataagagttttgatacatgcataatattggaaaacaatgtccgaagatataattttccccccgtaatatagcaaagatcacgaaaaggcccggaagagtacattaagttcaaaatttggagtataaaaaaaaccaatagaagaattccattttacttccttagtcatcggagagctctctttgggctttccgaaaaggtatcacatgccaagtttggcctcacggtctaaaagttatagagtcaaacattttaaacaaaacataatagagaaaaacgggaaaaaagagggatgtaacacgaggactttccgggaggtcacccatcctagtactactcttgcccaagcacccttaactgcggagttctgatgggatccggtgcattagtgttggtatgatcgcatgtgttactacatgcaatgtaatcgtatctattctttttaaagactttatgatccatttgccgtgggtcccaccagctatgtaggaataccctatcttctttataagagctttgatacatgcaaaatattggaaaacaatgtccgaacatattattttccccccgtaatatagcaaagatcacgaaaaggcccgaaaatgtacattaagttcaaaatttggagtagaaaaaaaaaacaatagaagaattccattttccttcctcattcatcggagagctctctttgggctttccgaaaaggtataacattccaagtttggcctcatggtctcaaagttataaagacatacatttttcacaaaaaaaaataaagaaaaaccaaaaaaaaaaaagaggaatgtaacacgaggacttttttgggaggtcacccatcctagtactactctcgcccaagcacccttaactgcggagttctgatgggatccgttgcattagtgctggtatgatcgcatgtgttactacatgcaatgtaatcgtatctattctttcttaaagactttatgatccatttgccgtgagtcccaccagctatgtaggaataccctatcttctttataagagctttgatacatgcaaaatattggaaaaaaacgtccgaacatatagttttccccccgtaatatagtaaagatcacgaaaaggctcgaaaaagtacatttagttcaaaatttggagtagaaaaaaaaacattagtagaattccatttcccttcctcagtcatcggagagctctctctgggctttccaaaaaggtatcacatgccaagtttggcctcacggtctaaaagttatagagtcatacatttttaacaatacaaaatagagaaaaaccgaaaaaaaagagggatgcaacacgaggactttccgggaggtaatccatcctagtactactctcgcctaagcacccttaactgcggagttctaatggaatccagtgcattagtgcgggtatgatcgcatgtgttactacatgcaatgtaatcgtatctattcttttttaaagactttatgatccatttgccgtgggtcccaccagctatgtaggaatacactatcttctttataagagctttgatagaggcaaaatattggaaaaaaacgtccgaacatataattttccccacgtaatatagcaaagatcacgaaaatgccccaaaaagtacatttagttcaaaatttggagtagaaaaaaaaacaatagaagaattacattttccttcctcactcatcggagagctctctttgggctttccgaaaaggtatcacatgccaagtttggtctcacggtctaagagttatagagtcatacatttttaacaatacaaaatagagaaaaaccgaaaaaaagagggatgcaacacgaagactttccgggaggtaatccatcctagtactactcttgcccaagcacccttaactgtggagttctgatggaatctggtgcattagtgctgatatgatcgcatgtgttactacatgcaatgtaatcgtatctattcttttttaaagactttatgatccatttgccgtgggtcccaccagctatgtaggaataccctatcttctttataagagctttgatacatgcaaaatatatgaaaaaaacgtccgaacatataattttccccccgtaatatagcaaagatcacgaaaaggctcgaaaaattacatttagttcaaaagtcccccgtatgatgtcatttgttactacatgcaatgcaatcatatctattcttatttaaagactttatgatccatttgtcgtgggtcccacctgtaggaataccctatcttgtttataaaagatttgatacatgcaaaatactcgaaaacaatgtccgaacatataattttcaccccgtaatatagcaaagatcacgaaaaggcccgaaaaagtacattaaagtcaaaatttggagtagaaaaaaacccaatagaagtattccattctccttcgtcattcatcggagagctctctttaggctttccgaaaagatatcacatgccaagtttggcctcacggtttaaaagttatagagtcatagatttttaacaaaacaaaaagagaaaaaccgaaaaaaattgggatgcaacacgaggactttcctggaggtcacccatcctagtactactctcgcccaagcacccttaactgcgtagttctgatgggatccgatgctttagtgctggtatgatcgcatctgttactacatgcaatgtaatcgtatctattcttttttaaagactttatgatccatttgccgtgggtcccaccagctatgtaggaataccctatcttctttataagagctttgataaatgcaaaatattggaaaccaatgtccgaacatataatttcgcccccgtaatatagcaaagatcacgaaaaagcccaaaaaagttcatttaggtcaaaatttgagcagaagaaaaagaaatagaagaattccattttccttcctcatttattggagagctctctttgggctttccgaaaaggtatcacatgccaagtttggcctcacggtctaaaagttatagagtcatacatttttaacaaaatgaaatagagaaaaaccgaaaaaaagagggatgtaacacgaggactttccgggaggtaatctatcctactactactctcggccaagcacccttaactgcggagttctaatgggatccggtgcattagtgctggtatgatcgcatgtgttactacatgcaatgtaatcgtatctattcttttttaaagactttatgatccatttgccgtgggtcccaccagctatgtaggaatacnnnnnnnnnnnnnnnnnnnnnnnnnnnnnnnnnnnnnnnnnnnnnnnnnnatataatgtttgccccaaaatatagcanagaccacgaaaatgccataaaaagtacattaaggtcaaaatttggagtaggaaaaaaaatcaataggagaattccattttccttcctcattcattggagagctctctttgggcattccaaaaaggtatcacatgccaagtttggcctcacggtctaaaagttatagagtaatacatttttaacaaaaaaaaaagagaaaaaccgaaaaaaagagggatgcaacacgaagacttttctggaggtcacccatcctagtactactctcccccaagcacgcttaactgtggtgttctgataggatcaagtgcattagtgctggtatgatcgcatcagttactacatgcaatgcaatcatatatattcttttttgaagactttatgatccattgtcgtaggtcccaccagctatgtaggaataccctttcttgtttataagagctttgatacatgcaaaatattcgaaaacaatgtccgaacatataatttttgtcccgtaatatagcaaagatcacgaaaaggccagaaaaaatacatttcggtcaaaatttggagtagaaaaaaagcccttcctcattcattggacagctctctttgggctttccgaaaaggtatcacatgccaagtttggcctcacggtctaaaccttatagactcatacatttttcacaaaaaaaagaagagaaaagccaaaaaaaaagagtgattaaacacgaggactttcctggaggtcacccatcctagtactactctcgcccaagcacgcttaactgcgaagttctgatgggatctggtgcattagtgctggtatgatcgcatctgttactacatgcaatgaaatcgtatctattcttttttgaagattttatgattcatttaccgtgggtcccaccagctatgtaggaataacctatcttatttataagatctttgatacatgcaaaatattggaaaacaatgtccgaacatataatgttcgccccaaaatatagcaaagaccacaaaaatgccataaaaagtacattaaggtcaaaatttggagtaggaaaaaaaccaataagagaattccattttccttccctcattcatcggagatctctctttgggcattccaaaaaggtatcacatgccaagtttggcctcacggtctaaaagttatagagtaatacatttttaacaaaaaaaaaagagaaaaaccgaaaaaaagagggatgcaacacgaagacttttctggaggtcacccatcctagtactactctcccccaagcacgcttaactgtggtgttctgataggatcaagtgcattagtgctggtatgatcgcatcagttactacatgtaatgcaatcatatatattcttttttgaagactttatgatccatttgccgtaggtcccaccagctatgtaggaataccctatctcgtttataagagctttgatacatgcaaaatattcgaaaacaatgtccgaacatataatgtttgccccaaaatatagcaaagaccacgaaaatgccataaaaagtacattaaggtcaaaatttggagtaggaaaaaaaatcaataggagaattccattttccttcctcattcatcggagagctctctttgggcattccaaaaaggtatgacatgccaagtttggcctcacggtctaaaagttatagagtaatacatttttaacaaaaaaaaaagagaaaaaccgaaaaaaagagggatgcaacacgaagacttttctggaggtcatccatcctagtactactctcccccaagcacgcttaactgtggtgttctgataggatcaagtgcattagtgctggtatgatcgcatcagttactacatgcaatgcaatcatatatattcttttttgaagacgttatgatccatttgccgtaggtcccaccagctatgtaggaataccctatcttgtttataagagctttgatacatgcaaaatattcgaaaacaatgtccgaacatataatttttgtcccgtaatatagcaaagatcacgaaaaggccagaaaaaatacattttggtcaaaatttggagtagaaaaaaaacccttcctcattcattggacagctctctttgggctttccgaaaaggtatcacatgccaagtttggcctcacggtctaaaagttatagagtcatacatttttcacaaaaaaaagaagagaaaaaccaaaaaaaagagtgatgaaacacgaggactttcctggaggtcacccatcctagtactactctcgcccaagcacgcttcactgcgaagttctgatgggatctggtgcattagtgctggtatgatcgcatctgttactacatgcaatgcaatcatatctattcttttttgaagattttatgattcatttaccgtgggtcccaccagctatgtaggaataacctatcttatttataagagctttgatacatgcaaaatattggaaaacaatgtccgaacatataatgttcgccccaaaatatagcaaagacaacaaaaatgccataaaaagaaaattaaggtcaaaattttgagtaggaaaaaaatcaataagagaattccattttccttccctcattcatcggagatctctctttgggcattccaaaaaggtatcacatgccaagtttggcctcacggtctaaaagttatagagtaatacatttttaacaaaaaaagaagagaaaaaccgaaaaaaagagggatgcaacacgaagacttttctggaggtcacccatcctagtactactctcccccaagcacgcttaactgtggtgttctgataggatcaagtgcattagtgctggtatgatcgcatcagttactacatgtaatgcaatcatatatattcttttttgaagactttatgatccatttgccgtacgtcccaccagctatgtaggaataccctatctcgtttattagagctttgatacatgcaaaatattcgaaaacaatgtccgaacatataatgtttgccccaaaatatagaaaagaccacgaaaatgccataaaaagtacattaaggtcaaaatttggagtaggaaaaaaaatcaataggagaattccattttccttcctcattcatcggagagctctctttgggcattccataaaggtatcacatgccaagtttggcctcacggtctaaaagttatagagtaatacatttttaacaaaaaaaaaagagaaaaaccgaaaaaaagagggatgcaacacgaagacttttctggaggtcacccatcctagtactactctcccacaagcacgcttaactgtggtgttctgataggatcaagtgcattagtgctggtatgatcgcatcagttactacatgtaatgcaatcatatatattcttttttgaagactttatgatccatttgccgtaggtcccaccagttatgtaggaataccctatctcgtttataagagctttgatacatgcaaaatattcgaaaacaatgtccgaacatataatgtttgccccaaaatatagcaaagaccacgaaaatgccataaaaagtacattaaggtcaaaatttggagtaggaaaaaaaatcaataggagaattccattttccttcctcattcatgggagagctctctttgggcattccaaaaaggtatcacatgccaagtttggcctcacggtctaaaagttatagagtaatacatttttaacaaaaaaaaaagagaaaaaccgaaaaaaagagggatgcaacacgaagacttttctggaggtcacccatcctagtactactctcccccaagcacgcttaactgtggtgttctgataggatcaagtgcattagtgctggtatgatcgcatcagttactacatgcaatgcaatcatatatattcttttttgaagacgttatgatccatttgccgtaggtcccaccagctatgtaggaataccctatcctgtttataagagctttgatatatgcaaaatattcaaaaacaatgtccgaacatataatttttgtcccgtaatatagcaaagatcacgaaaaggccagaaaaaataaatttcggtcaaaatttggagtagaaaaaaaacccttcctcattcattggacagctctctttgggctttccgaaaaggtatcacatgccaagtttggcctcacggtctaaaccttatagactcatacattttttacaaaaaaaagaagagaaaaaccaaaaaaaagagtgattaaacacgaggactttcctggaggtcacccatcctagtactactctcgcccaagcacgcttaactgcgaagttcttatgggatctggtgcattagtgctggtatgatcgcatctgttactacatgcaatgcaattgtatctattcttttttgaagattttatgattcatttaccgtgggtcccaccagctatgtaggaataacctatctgatttataaaagctttgatacatgcaaaatattcgaaaacaatgtccgaacatataatgttcgccccaaaatatagcaaagaccgtaaaaatgccataaaaagtacattaaggtcaaaatttggagtaggaaaaaaaatcaataggagaattccattttccttccctcattcatcgaagagctctctttgggcattccaaaaaggtatcacatgccaagtttggcctcacggtctaaaagttatagagtattacatttttaacaaaaaaaaaagagaaaaaccgataaaaagagggatgcaacacgaagacttttctggaggtcaccaatcctagtactactctcccccaagcacgcttaactgtggtgttctgataggatcaagtgcattagtgctggtatgatcgcatcagttactacatgcaatgcaatcatatatattctgttttgaagactttatgatccatttgtcgtaggtcccaccagctatgtaggaataccctttcttgtttataagagctttgatacatgcaaaatattcgaaaacaatgtccgaacatataatttttgtcccgtaatatagcaaagatcacgaaaaggccagaaaaaatacatttcggtcaaaatttggagtagaaaaaaagcccttcctcattcattggacagctctctttgggctttccgaaaaggtatcacatgccaagtttggcctcacggtctaaaccttatagactcatacatttttcacaaaaaaaagaagagaaaaaccaaaaaaaaagagtgattaaacacgaggactttcctggaggtcacccatcctagtactactctcgcccaagcacgcttaactgcgaagttctgatgggatctggtgcattagtgctggtatgatcgcatctgttactacatgcaatgaaatcgtatctattcttttttgaagattttatgattcatttaccgtgggtcccaccagctatgtaggaataacctatctcgtttataagagctttgatacatgcaaaatattcgaaaacaatgtccgaacatataatgtttgccccaaaatatagaaaagaccacgaaaatgccataaaaagtacattaaggtcaaaatttggagtaggaaaaaaaatcaataggagaattccattttccttcctcattcatcggagagctctctttgggcattccataaaggtatcacatgccaagtttggcctcacggtctaaaagttatagagtaatacatttttaacaaaaaaaaaagagaaaaaccgaaaaaaagagggatgcaacacgaagacttttctggaggtcacccatcctagtactactctcccacaagcacgcttaactgtggtgttctgataggatcaagtgcattagtgctggtatgatcgcatcagttactacatgtaatgcaatcatatatattcttttttgaagactttatgatccatttgccgtaggtcccaccagttatgtaggaataccctatctcgtttataagagctttgatacatgcaaaatattcgaaaacaatgtccgaacatataatgtttgccccaaaatatagcaaagaccacgaaaatgccataaaaagtacattaaggtcaaaatttggagtaggaaaaaaaatcaataggagaattccattttccttcctcattcatgggagagctctctttgggcattccaaaaaggtatcacatgccaagtttggcctcacggtctaaaagttatagagtaatacatttttaacaaaaaaaaaagagaaaaaccgaaaagaagagggatgcaacacgaagacttttctggaggtcatccatcctagtactactctcgcccaagcacacttaactgcggtgttctgataggatcaagtgcattagtgctggtatgatcgcatcagttactacatgcaatgcaatcttatatattcttttttgaagactttatgatccatttgccgtcggtcccaccagctatgtaggaataccctatcttgtttataagagctttgatatatgcaaaatattcaaaaataatgtccgaacatataatttttgtcccgtaatatagcaaagatcacgaaaaggccagaaaaaataaatttcggtcaaaatttggagtagaaaaaaaacccttcctcattcattggacagctctctttgggctttccgaaaaggtatcacatgccaagtttggcctcacggtctaaaccttatagactcatacattttttacaaaaaaaagaagagaaaaaccaaaaaaaagagtgattaaacacgaggactttcctggaggtcacccatcctagtactactttcgcccaagcacgcttaactgcgaagttcttatgggatctggtgcattagtgctggtatgatcgcatctgttactacatgcaatgcaattgtatctattcttttttgaagattttatgattcatttaccgtgggtcccaccagctatgtaggaataacctatctgatttataaaagctttgatacatgcaaaatattcgaaaacaatgtccgaacatataatgttcgccccaaaatatagcaaagaccgtaaaaatgccataaaaagtacattaaggtcaaaatttggagtaggaaaaaaatcaataggagaattccattttccttccctcattcatcggagagctctctttgggcattccaaaaaggtatcacatgccaagtttggcctcacggtctaaaagttatagagtattacatttttaacaaaaaaaaaagagaaaagccgataaaaagagggatgctacacgaagacttttctggaggtcaccaatcctagtactactctcccccaagcacgcttaactgtggtgttctgataggatcaagtgcattagtgctggtatgatcgcatcagttactacatgcaatgcaatcatatatattctgttttgaagactttatgatccatttgtcgtaggtcccaccagctatgtaggaataccctttcttgtttataagagctttgatacatgcaaaatattcgaaaacaatgtccgaacatataatttttgtcccgtaatatagcaaagatcacgaaaaggccagaaaaaatacatttcggtcaaaatttggagtagaaaaaaagcccttcctcattcattggacagctctctttgggctttccgaaaaggtatcacatgccaagtttggcctcacggtctaaaccttatagactcatacatttttcacaaaaaaaagaagagaaaaaccaaaaaaaaagagtgattaaacacgaggactttcctggaggtcacccatcctagtaatactctcgcccaagcacgcttaactgcgaagttctgatgggatctggtgcattagtgctggtatgatcgcatctattactacatgcaatgaaatcgtatctattcttttttgaagattttatgattcatttaccgtgggtcccaccagctatgtaggaataacctatcttatttataagatctttgatacatgcaaaatattggaaaacaatgtccgaacatataatgttcgccccaaaatatagcaaagaccacaaaaatgccataaaaagtacattaaggtcaaaatttggagtaggaaaaaaaccaataagagaattccattttccttccctcattcatcggagatctctctttgggcattccaaaaaggtatcacatgccaagtttggcctcacggtctaaaagttatagagtaatacatttttaacaaaaaaaaaaagagaaaaaccgaaaaaaagagggatgcaacacgaagacttttctggaggtcacccatcctagtactactctcccccaagcacgcttaactgtggtgttctgataggatcaagtgcattagtgctggtatgatcgcatcagttactacatgtaatgcaatcatatatattcttttttgaagactttatgatccatgtgccgtaggtcccaccagctatgtaggaataccctatctcatttataagagctttgatacatgcaaaatattcgaaaacaatgtccgaacatataatgtttgccccaaaatatagcaaagaccacgaaaatgccataaaaagtacattaaggtcaaaatttggagtaggaaaaaaaatcaataggagaattccattttccttcctcattcatcggagagctctctttgggcattccaaaaaggtatcacatggcaagtttggcctcacggtctaaaagttatagagtaatacatttttaacaaaaaaaaaagagaaaaaccgaaaaaaagagggatgcaacacgaagacttttctggaggtcacccatcctagtactactctcccccaagcacgcttaactgtggtgttctgataggatcaagtgcattagtgctggtatgatcgcatcagttactacatgcaatgcaatcatatatattcttttttgaagacgttatgatccatttgccgtaggtcccaccagctatgtaggaacaccctatcttgtttataagagctttgatacatgcaaaatattcgaaaacaatgtccgaacatataatttttgtcccgtaatatagcaaagatcacgaaaaggccagaaaaaatacatttcggtcaaaatttggagtagaaaaaaaacccttcctcattcattggacagctctctttgggctttccgaaaaggtatcacatgccaagtttggcctcacggtctaaaagttatagagtcatacatttttcacaaaaaaagcaagagaaaaacaaaaaaaaagagtgatgaaacacgaggactttcctggaggtcacccatcctagtactactctcgcccaagcacgcttaactgcgaagttctgatgggatctggtgcattagtgctggtatgatcgcatctgttactacatgcaatgcaatcgtatatattcttttttgaagactttatgatccatttgtcgtaggtcccaccagttatgtaggaataccctatctcgtttataagagctttgatacatgcaaaatattcgaaaacaatgtccgaacatataatgtttgccccaaaatatagcaaagaccacgaaaatgccataaaaagtacattaaggtcaaaatttggagtaggaaaaaaaatcaataggagaattccattttccttcctcattcattggagagctctctttgggcattccaaaaaggtatcacatgccaagtttggcctcacggtctaaaagttatagagtaatacatttttaacaaaaaaaaaagagaaaaaccgaaaaaaagagnnnnnnnnnnnnnnnnnnnnnnnnnnnnnnnnnnnnnnnnnnnnnnnnnntcatacatttttaacaaaacaaatagagaaaaaccgaaaaaaagaatgatacaacacaaggactttccgggaggtcacccatcctaatactattctcgcccaagcaagcttaactgcagagtattgatgggatctgatgcataagggctgatatgatcgcatccgttactacaagcaatgcaatcgtatctattcgtttttgaagactttatgatccatttgccgtgggtcccaccagctatgtaggaataccctatcttgtttataagagctttgatacatgcaaaaaattggaaaacaatgtctgaacatataatttttgtcccgtaatatagcaaagatcacgaaaaggatagaaaaagtacattaaggtcaaaattttgagtagaaaaaaaatcaatagaaggattccaatttccttcctcattcatatagctctctttgggctttccgaaaaggtatcacatgcaaagtttggcctcgcggtctaaaagttatagaggtatacatttttaccaaaaaaaagagggattcaacacgaggactttctgggaggtcactcatcctattactactctcgcccaagcacacttaactgcggagttctgataggatccagtgcattagtgcgggtatgatcacatccgttactacatgcaatgcaatcgtatatattttttttgaagactttatgatccatttgccgtgggtctcaccagctatgtaggaataccctatcttgtttgtaagagctttgatacatgcaaaatattcgaaaacaatgtcagaacgtatgctttttgccccgtaatatagcatagatcatgaaaaggccagaaaaagtacattaaggtcaaaattttgagtagaaaaaaaaacaatagaaaaattccattgtccttcctcattcatcggagagttctctttgggctttccgaaaaggtatcacatgccaagtttggcctcacggtctaaaacttatagaatcatacattcttaacaaaaaaaaaagagaaaaaccgaaaaaaagaagaatgcaacacaaggactttccatgaggtcaaccatcctagtactactctcgcccaatcacgcttaactgcagagttttgatgggatccggtgcattagtgctggtatgatcgcatctgttactacatgcaatgcaatcgtatctattcttttttgaagactttatgatccatttgtcgtgggtcccaccaactatgtaagaataccctatcttgtttataagagctttgatacatgcaaaatattcgaaaacaatgtcagaacgtatgctttttgccccgtaatatagcatagatcatgaaaaggccagaaaaagtacattaaggtcaaaattttgagtagaaaaaaaaacaatagaaaaattccattgtccttcctcattcatcggagagttctctttgggctttccgaaaaggtatcacatgccaagtttggcctcacggtctaaaatttatagagtcatacatttttaacaaaaaaaaaagagaaaaaccgaaaaaagagggatggaacacaaggactttccgggaggtcacccattctagtactactctcacccaagcgcgcttaactgtggagttctgatgggatccagtgcattagtgatggtatgatcgcatccgttactacatgcaatgcaataatatcttttcttcttgaagactttatgatccatttgtcgtgggtcccaccagctatgtaggaataccctatcttgtttataagagctttgatacatgcaaaatattcaaaaacaatgtccgaacatataattttcgccccgtaatatagcaaagatcgcgaaaacgccaaaagagtacattaaggtcaaaatttggagtagaaaaaaaacccaatagaagaattccattttccttcatcattcaccagagagctctcttttggctttttgaaaaggtatcacatgccaagtttggcctcacggtctaaaagttatagagtcattcattttaaaaaaaaaaatagagaaaaaccaaaaaaaaaaagagggatgaaacacgaggactttccgggaggtcacccatcctagtactactctcgcccaagcacacttaactgcggagttcttatgggatctggtgcattagtgctgctatgatcgcatccgttactacatgcaatgcaatcgtatctattcttttttgaagactttatgatccatttgctgtgggtcctgatatgtctataatttacatcttttcagtgtccattcatcaccgttttgagtccagttttgtatcattcatcgctgttttatatcatttctcatcattcttgcatactttgcatgattaggatagttttgcatacatattgcatttctaagttgttttcaggtgatttggagctgtttgcgagcaaattggaagaaacgagccagaaccagaagacatactcgaccaccaggtcgtgtgcatccagcaccatactcgaccccctggtcgagtgactttggagccattcttcccatctactcgaccccctagtcgagtatcctcagctcaggctactcgatgacgccatcgaccccctggtcgagtatcacttcgccacaccacctgaccacactcggccattcactctaccaagttagtcgaccccctggtcgagtatcatcactcaccaccatcaccatcactcgaccggacactcgatcacgtcttcacagtctactcaaatccgcactcaaccagacaagctgagcacaaggaagagaagaggagaagacaaagtgtttggaagcggcctggacctccatcggatcacaaagcccatctcggcccattatcactctattggtcgggcgattaggttattggcccgtctactatcattttgttttgtataaatagatgtcttagggttctttcctgagacatctagtcgacattgagtttttgtttcagttttattttctattttactcttctgcgccgcttttgcttctacaacctataattcgagatttttccaagttattcagattctgcatttgattttatctatcatcctgtttctctactctttatctctttacttatgcaatattatcatttatctgcgtttatgtctttgagcatgttgtctgagtagtgacatagaattcttagggatgggatagagtagttgtggaatccgtagtctgtagaatggttaagttttagaattgattgaatcccttcaggactagttgcgtttactgcttatttctttctgatcaactggaattcgatcccaagcattctcgcacccagaaggtgttcgatggaatgcttgatccactagttcctgagatattcgtctctatcccaagggattgggcgtttagagcgtttattgactttatcagtctgttcttattgcctgcatagttagattgcgttaatgggaattagtctgggctagctttgcttgaggatttctatcacagaagtgaattgatttgttgttgaacctattgtctagggatagcttgattgcgcttgttaaccattcgaatatgctaggatatgataaggtctgaccctatcgaagacaagaaaaagactaagagtgataaaataacaagataataggaaatgcaccttgaacggcggagagtgtagatgagagagagaatttcaagattaatgttgttgattgtttattttgataacaaaaccctaaaagggaaggttccttaaatagcatctactgagactcaatacaaaacgcagcatttcgataacccaaaagtaaaacgacacagttggcgagctgtctttctgtgccgagctggcgagctgtctttctgtgccttagccacttttaaatagaagcttcctcaggaacttctcacgagctctgcctttccttccatttgatttcgcccttcttctcacaccagccaacgtcacctgtaacctatcaatgctcccgcgcagaagactgaccttgtcctcaaggtcgaagtccgggtactgctgcaccaaagtgaggagcggctcccaagttgattccaaggttgataatccagaccactgtaccagcacctctggtcctgaatttgtgttgctctgtcggatatctagcagcttctcaggtcctgtgttccattccagtgtgggtgatagtatcttgggaagttcctgcggggtgaatgacggaggtacagcccttttcagttgagagacatggaacaccgggtgaattgtgctgtgttcgggtagttggagcttgtaagcgacctgacctatgcggtgcagcactttaaatggaccgaagtagcgctgggacagcttttcattcttcctatgagccacagaactttgcctataaggacgcagcttcaagtaaacccattcatcaatttcaaacgctacatcacgtcgacttttatcagcagcctttttcatttgagcttgagctatctccaagttctctcttaattcaaccagcattccatccttatccttaagtaactcctctacattcgcattattggttggaatatcgccatacctgagcagaactggtggttctctaccatagactgcttgaaagggagtggttttggtggctgaatggtacgaggtgttgtaccagtattctgcccaaggtaaccactgaaaccacgatgtaggcctcctccctgcaaagcatcgcaaataagactcaagacatctgttaacaacctcggtctgcccatcagtttgtgggtgataggctgtactcttctgtagccccgtgccctgcagcttaaacaactcagaccagaatccgctcaggaaaatcctgtccctgtccgaaaccagtgtgtttgggaagccatgtagcttgactacatctcttatgaaggcctcaactacagtcttggcagtgaatggatgtttaagtggaatgaaatgactatacttacttaatctatccaccactaccaatatacagttaaacctgttagagcttggcaacccttctacaaagtccaagctgacatcactccaaatctgttgtggaatagggagaggtgatagtaaaccggctggagagagggtagagtatttattctcttgacagatttggcatcccttgatgtagttaaccacgtctttccgcaaccctctccagtatacttcacttgtgagtcgtttgaatgtcttaagggcaccttcatgacctccaataggactggtgtggaacttctctagcatctttggaatgaagggagatcctacaggaattaccaaacagccttttctgtaaatcaagccatctgccacagtgaagtcagaatcatggtggtccccttgtgcccagttcttaagtatctggctcaactcatgatcctgctgaatttctgcctttagtgcagtcaagtcgatagtaggaggaccagttatagtgagctgtgagagagcctcagttggaggtctccttgagagtgcatcagctaccttattgtcaactcctggtttatattcgatcctatacttcagtccactcaacttagacgcccatctctgctgtattgtggacaccgacttctgttccaacaaatgtctgaggctgcgttgatctgtcttgataatgaattctttacttgataggtaatgcttccactttgtgacagctttcactatggctaacagttcacgttcataaactgaccttattctgccttgactggagaaggcttggctgagaaatgcaataagcctcttattctgtgacagtactgctccaatccccatccctgatgcatccgtttccacagtaaactcctgctggaaatctggtaacactagcacaggtagtgctgaaacagctgctttgagagcctgaaatgcagaagtagctgcctcattccaatcaaaactgttcttttttaactgatctctgagtggtctggcgatttggccgtaattcttgacaaatcggcgatagtagccagtgaatcctaggaagcctcttaactcagtcacagatttaggtaaaggccactggagcattgcttccaccttttctggatctgttgcgactccttgctcagagataatgtgtcccaaatatgagatcctagtgcttccaaatgtgcactttttaaaattggcatagaactgatgaagatgcagtagctgtaagacggtttccaaatgcttcaaatgtgtcttcatatcaggactataaactagtatatcatcgaagaaaaccaagacgaactttcgcaagtatggcctgaataggtcattcatgacgctttgaaaggtggagggggcgttggtcaagccaaatggcattaccagaaattcataatggccctcatgtgtcttgaaggcagtcttctccacatcactcagtttcatccttatctggaaatagcctgatttaagatccaactttgaaaacactgtggctcctttcagttcatccaatagctcttctataacaggaatcggatacttatcgggtattgtagcttcattcaatgctcgataatcaacgcagaagcgccatcctccatctttctttttcactaggagaactggacttgaatatggactcacgctaggtcttataatctgagcattcaacatttcacgcacaagcttctctatctcattcttttgagcaaaagaatacctgtatggtcggatattgactggtgaagacccttcttgtaaggtaatggcgtgttctctgttgcgaactggtggcaatagctgtggagtttgaaaaaccccttggtactgatccaaaagcctctggattgcaggctgcaaggctgtttgctcttcctgtttcttgctttcaaacaaagatgctagttccaagagatatgcagttccagtgtatttgataactctttccatagacctcatcgaaatttgtcctctacatagatccgggtcgccgtataaggatacccatgtgcgacctatctgccaactgatcctcaaatctctccagttggctcttgtttctcctagtcctgccaaccaagaaaatcccagaaccaaatccaaatctcccaagtcaaataagtagtagtcttgtacaaactcaattccttggacctctagtggtatatcgacacacttcccactacttttgatgattctgcctccaccaactttaactccaaaactgcgagtttgagtcactaaccatcctttctctcttaccaaagcctcactaatgaagttgcaagttgctcctgaatcaaccaataacaccactttggtgttgccaatgtatcccctcattttcattgactgctcttgagactcatcattcaaggagctgagtgtcattaccttgaaaccttctgcaggttctggatccccttcttcttctgtcagtggttcattcaactcttcaattagaggactctcctcttcaacctcttctgttatggctagacccttgagcttttgtggtttgcatttatggccttgaaaccatctatctccacagtagcggcacgggtttgagttcctggcttccccactgcctgaagcacgagttgtatccctactaggaatgaagggttgtctcgttggagcacggtctaccactctagatcctgtggagacctgattgttgaatggagctgtgttggttctagcttgatttcgcacttggtaactaacagcattccgctcttgtgactcaatgagtttagctatctcaacaatatctgcaagattcactggcctacagcgaactacctggtctcgaagacttcttctcagtccattgaggaatgcagattccaatatgtcagatgtgacatggggtaagtcgactgtgagctcttcaaaacgttctctgtattcctccacggttcctgtttgtctcacgttgaggagatgatccacagcagaactgcctctgcttggtcgaaaacgtaacatgaacttttcttgaaattccctccaggtatagatttgttctctgtccttagagcagcgccaccatgtaactgatgctcctgttaaacaagacacagccttttccagtttttcttcctctagggtgcgattggataagaagcactgttctagccggaacaaccaatcgtcggcattgcctccttcataagccggataatccacagtcctacgcggggctgcttcaaaccgaggttgatgtggcgcagattgaggcggaaacgtttgtgtttggaaggttggagtagtctgaaaccccgtggaaggattagatggaaaacctgaagatgatggaagacccgtggaggcattcagctgaaaccctggtggttctaatggtgacgagtgaaagcgacgcggttcgaagggtgaagctggaagtcgaggtatctctgaagtcgacgcctggtatcgcgactggtcaaagagtaagggccgagggtgtgtgtcccgttgatttgtgccggaaaacagagtctctctgttctgtacctccaagtgttgaggatgagaggtgtagactggtaacgccggagctggagaagaaaaacggactcctctattcggtccttccagatgttgtgggtatgaagcttgcatgcctgcaggtcgactctagaggatccccgggtaccgagctcgaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaannnnnnnnnnnnnnnnnnnnnnnnnnnnnnnnnnnnnnnnnnnnnnnnnnagctctctttgggctttccgaaaaggtatcacatgccaagtttggcttcacggtctaaaccttatagactcatacatttttcacaaaaaaaagaagagaaaaacaaaaaaaaagagtgattaaacacgaggactttcctggaggtcacccatcctagtactactctcgcccaagcactcttaactgcgaagttctgatgggatctggtgcattagtgctggtatgaacgcatctgttactacatgcaatgcaatcgtatgtattcttttttgaagattttatgattcatttaccgtgggtcccaccagctatgtaggaataacctatcttatttataaaagctttgatacatgcaaaatattcgaaaacaatgtccgaacatataatgttcgccccaaaatatagcaaagaccacaaaaatgccataaaaagtacattaaggtcaaaatttggagtaggaaaaaaatcaataggagaattccattttccttccctcattcatcggagagctctctttgggcattccaaaaaggtatcacatgccaagtttggcctcacggtctaaaagttatagagtattacatttttaacaaaaaaaaaaagagaaaaaccgaaaaaaagagggatgcaacacgaagacttttctggaggtcacccatcctagtactactctcccccaagcacgcttaactgtggtgttctgataggatcaagtgcattagtgctggtatgatcgcatcagttactacatgcaatgcaatcatatatattcttttttgaagactttatgatccatttgccgtaggtcccaccagctatgtaggaataccctatcttgtttataagagctttgatacatgcaaaatattcgaaaacaatgtccgaacatataatttttgtcccgtaatatagcaaagatcacgaaaaggtcagaaaaaatatatttcggtcaaaatttggagtagaaaaaaagcccttcctcattcattggacagctctctttgggctttccgaaaaggtatcacatgccaagtttggcctcacggtctaaaccttatagactcatacatttttcataaaaaaaagaagagaaaaacaaaaaaaaaaagagtgattaaacacgaggactttcctggaggtcacccatcctagtactactctcgcccaagcacgcttaactacgaagttccgatgggatctgatgcattagtgctggtatgatcgcatctgttactacatgcaatgcaatcgtatctattcttttttgaagattttatgattcatttactgtgggtcccaccagctatgtaggaataacctatcttatttataaaagctttgatacatgcaaaatattggaaaacaatgtccgaacatataatgttcgccccaaaatatagcaaagaccacaaaaatgccataaaaagtacattaaggtcaaaatttggagtaggaaaaaaatcaataggagaattccattttccttccctcattcatcggagagctctctttgggcattccaaaaaggtatcacatgccaagtttggcctcacggtctaaaagttatagagtaatacatttttaacaaaaaaaaaaaagaaaaaaaccgaaaacaaagagggatgcaacacgaagactttcctggaggtcacccatcctagtactactctcacccaagcacacttaactgtggtgttctgataggatcaagtgcattagtgctggtatgatcgcatcagttactacatgcaatgcaatcgtatctattattttttgaagactttatgatccatttgccgtgggtcccaccagctatgtaggaataccctatcttgtttataagagctttgatacatccaaaatattcgaaaacaatgttggaacgtataagttttgcccagtaatatagcaaagatcacgaaaaggccacaaaaagtacattaaggtaaaaatttagagtaggaaacaaaaacaataggagaattccattttccttcctcaatcatcggagagttctttttgggctttccaaaaaggtatcacatgccaagtttggcctcacggtctaaaagttatagagtaatacatttttaacaaaaaaaaaaagaaaaaaaccgaaaacaaagagggatgcaacacgaagactttcctggaggtcacctatcctagtactactctcgcccaagcacacttaactgtggtgttctgataggatcaagtgcattagtgctggtatgatcgcatcagttactacatgcaatgcaatcgtatctattattttttgaagactttatgatccatttgccgtgggtcccaccagctatgtaggaatacccaatcttgtttataagagctttgatacatccaaaatattcgaaaacaatgttggaacgtataagttttgcccagtaatatagcaaagatcacgaaaaggccacaaaaagtacattaaggtaaaaatttagagtaggaaacaaaaacaataggagaattccattttccttcctcaatcatcggagagttctttttgggctttccaaaaaggtatcacatgccaagtttggcctcacggtctaaaagttatagagtcatacatttttaacaaaaaagagggatttaacacgaggactttccgagaggtaacccatcctagtagtacactcgcccaagcacccttaactacggagttctaatgggatacggtgcattagtgctcgtatgatcgcatgtgttactacatgcaatgtaatcgtatctattcttttttaaagactttatgatccatttgccgtgggtcccaccagctatgtaggaatatcctatattctttataagagctttgatacatgcaaaatattcgaaaacaatgtccgaacatataatttcccccccgtaatatagcaaagatcacgaaaaggcccaaaaaagtacattaagtttaaaatttggagtagaaaaaaaaccaatagaaaaattccattttccttcctcagtcatcgaagagctctctttgggctttctgaaaaggtatcacatgccaagtttggcctcacggtctaaaagttatagagtcatacatttttaacaaaacaaaaagagaaaaaccgaaaaaaacagggatgcaacacgaggactttcctggaggtctcccatcctagtactactctcgcccaagcacccttaactgcgtagttctgatgggatccgatgcattagtgctggtatgatcgcatctgttactacatgcaatgtaatcgtatctattcttttttaaagactttatgatccatttgccgtgggtcccaccagctatgtaggaataccctatcttcttaataagagccttgataaatgcaaaatattggaaaacaatgtccgaacatataatgcccccccccccgtaatatagcaaagatcacgaaaatgcccaaaaaagtacatttaggtcaaaatttgagtagaaaaaaaaacaatagaagaattccattttccttcctcatttatcggagagctctctttgggctttccgaaaaggtatcacatgacaagtttggcctcacggtctaaaagatatagagtcatacattattaacaaaacaaaatagagaaaaaccgaaaaaaaagagggatgcaacgcgaggactttccgggaggtaatctatcctagtactactctcgcccaagcacccttacctgcggagttctgatgggatccggtgcagtagtgctggtatgatcgcatgtgttactacatgcaatgcaatcatatatattcttttttgaagactttatgatccatttgccgtaggtcccaccagctatgtaggaataccctatcttgtttataagagctttgatacatgcaaaatattcgaaaacaatgtccgaacatataatttttgtcccgtaatatagcaaagatcacgaaaaggccagaaaaaatacatttcggtcaaaatttggagtagaaaaaaaccccttcctcattcattggacagctctctttgggctttccgaaaaggtatcacatgccaagtttggtctcacggtttaaaagttatagagtcatacatttttcacaaaaaaaagaagagaaaaaacaaaaaaaagagtgatgaaacacgaggactttcctagaggtcacccatcctagtactactctcgcccaagcacgcgtaactgcgaagttctgatgggatctggtgcattagtgctggtatgatcgcatctgttactacatgcaatgcaatcgtatctattcttttttgaagattttatgatccatttgcagtgggtcccaccagctatgtaggaataccctatcttgtttataagagctttgatacatgcaaaatcttcgaaaacaatgtccgaacatataattttcgccccgtaatatagcaaagatcacgaaaatgccaaaatagtacattaaggtcaaaatttggagtaggaaaaaaaacccttcatcattcattggagagctctctctgggctttccgaaaaggtatcacatgccaagtttggcctcacggtctaaaagttataaagtcatacatttttaacaaaaaaaaaagagaaaaaccgaaaaaaagagttatgtaacacgaggactttcctggaggtcacccgtcctagtactactctcgcccaaacacgcttaactgtggtgttctgataggatcaagtgcattagtgctggtatgatcgcatcagttactacatgcaatgcaatcatatatattcttttttgaaaactttatgatccatttgccgtaggtcccaccagctatgtcggaataccctatcttgtttataagagctttgatacatgcaaaatattcgaaaacaatgtccgaacatataatttttgtcccgtaatatagcaaagatcacgaaaaggccaaaaaaaatacatttcggtcaaaatttggagtagaaaaaaaccccttcctcattcattcgacaactctctttgggctttccgaaaaggtatcacatgccaagtttggtctcacggtctaaaagttatagagtcatacatttttcacaaaaaaaagaagagaaaaaaccaaaaaanagagtgatgaaacacgaggactttcctggaggtcactcatgctagtactactctcgcccaagcacgcttaactgcgaagttctgatgggatcnnnnnnnnnnnnnnnnnnnnnnnnnnnnnnnnnnnnnnnnnnnnnnnnnncactcaatacggggcaacctcatgtccgagctcgcgagctcgtcgacagcgacacacttgcatcggatgcagcccggttaacgtgccggcacggcctgggtaaccaggtattttgtccacataaccgtgcgcaaaatgttgtggataagcaggacacagcagcaatccacagcaggcatacaaccgcacaccgaggttactccgttctacaggttacgacgacatgtcaatacttgcccttgacaggcattgatggaatcgtagtctcacgctgatagtctgatcgacaatacaagtgggaccgtggtcccagaccgataatcagaccgacaacacgagtgggatcgtggtcccagactaataatcagaccgacgatacgagtgggaccgtggtcccagactaataatcagaccgacgatacgagtgggaccgtggttccagactaataatcagaccgacgatacgagtgggaccgtggtcccagactaataatcagaccgacgatacgagtgggaccatggtcccagactaataatcagaccgacgatacgagtgggaccgtggtcccagtctgattatcagaccgacgatacgagtgggaccgtggtcccagactaataatcagaccgacgatacgagtgggaccgtggtcccagactaataatcagaccgacgatacgagtgggaccgtggtcccagtctgattatcagaccgacgatacaagtggaacagtgggcccagagagaatattcaggccagttatgctttctggcctgtaacaaaggacattaagtaaagacagataaacgtagactaaaacgtggtcgcatcagggtgctggcttttcaagttccttaagaatggcctcaattttctctatacactcagttggaacacgagacctgtccaggttaagcaccattttatcgcccttatacaatactgtcgctccaggagcaaactgatgtcgtgagcttaaactagttcttgatgcagatgacgttttaagcacagaagttaaaagagtgataacttcttcagcttcaaatatcaccccagcttttttctgctcatgaaggttagatgcctgctgcttaagtaattcctctttatctgtaaaggctttttgaagtgcatcacctgaccgggcagatagttcaccggggtgagaaaaaagagcaacaactgatttaggcaatttggcggtgttgatacagcgggtaataatcttacgtgaaatattttccgcatcagccagcgcagaaatatttccagcaaattcattctgcaatcggcttgcataacgctgaccacgttcataagcacttgttgggcgataatcgttacccaatctggataatgcagccatctgctcatcatccagctcgccaaccagaacacgataatcactttcggtaagtgcagcagctttacgacggcgactcccatcggcaatttctatgacaccagatactcttcgaccgaacgccggtgtctgttgaccagtcagtagaaaagaagggatgagatcatccagtgcgtcctcagtaagcagctcctggtcacgttcattacctgaccatacccgagaggtcttctcaacactatcaccccggagcacttcaagagtaaacttcacatcccgaccacatacaggcaaagtaatggcattaccgcgagccattactcctacgcgcgcaattaacgaatccaccatcggggcagctggtgtcgataacgaagtatcttcaaccggttgagtattgagcgtatgttttggaataacaggcgcacgcttcattatctaatctcccagcgtggtttaatcagacgatcgaaaatttcattgcagacaggttcccaaatagaaagagcatttctccaggcaccagttgaagagcgttgatcaatggcctgttcaaaaacagttctcatccggatctgacctttaccaacttcatccgtttcacgtacaacattttttagaaccatgcttccccaggcatcccgaatttgctcctccatccacggggactgagagccattactattgctgtatttggtaagcaaaatacgtacatcaggctcgaaccctttaagatcaacgttcttgagcagatcacgaagcatatcgaaaaactgcagtgcggaggtgtagtcaaacaactcagcaggcgtgggaacaatcagcacatcagcagcacatacgacattaatcgtgccgatacccaggttaggcgcgctgtcaataactatgacatcatagtcatgagcaacagtttcaatggccagtcggagcatcaggtgtggatcggtgggcagtttaccttcatcaaatttgcccattaactcagtttcaatacggtgcagagccagacaggaaggaataatgtcaagccccggccagcaagtgggctttattgcataagtgacatcgtccttttccccaagatagaaaggcaggagagtgtcttctgcatgaatatgaagatctggtacccatccgtgatacattgaggctgttccctgggggtcgttaccttccacgagcaaaacacgtagccccttcagagccagatcctgagcaagatgaacagaaactgaggttttgtaaacgccacctttatgggcagcaaccccgatcaccggtggaaatacgtcttcagcacgtcgcaatcgcgtaccaaacacatcacgcatatgattaatttgttcaattgtataaccaacacgttgctcaacccgtcctcgaatttccatatccgggtgcggtagtcgccctgctttctcggcatctctgatagcctgagaagaaaccccaactaaatccgctgcttcacctattctccagcgccgggttattttcctcgcttccgggctgtcatcattaaactgtgcaatggcgatagccttcgtcatttcatgaccagcgtttatgcactggttaagtgtttccatgagtttcattctgaacatcctttaatcattgctttgcgtttttttattaaatcttgcaatttactgcaaagcaacaacaaaatcgcaaagtcatcaaaaaaccgcaaagttgtttaaaataagagcaacactacaaaaggagataagaagagcacatacctcagtcacttattatcactagcgctcgccgcagccgtgtaaccgagcatagcgagcgaactggcgaggaagcaaagaagaactgttctgtcagatagctcttacgctcagcgcaagaagaaatatccaccgtgggaaaaactccaggtagaggtacacacgcggatagccaattcagagtaataaactgtgataatcaaccctcatcaatgatgacgaactaacccccgatatcaggtcacatgacgaagggaaagagaaggaaatcaactgtgacaaactgccctcaaatttggcttccttaaaaattacagttcaaaaagtatgagaaaatccatgcaggctgaaggaaacagcaaaactgtgacaaattaccctcagtaggtcagaacaaatgtgacgaaccaccctcaaatctgtgacagataaccctcagactatcctgtcgtcatggaagtgatatcgcggaaggaaaatacgatatgagtcgtctggcggcctttctttttctcaatgtatgagaggcgcattggagttctgctgttgatctcattaacacagacctgcaggaagcggcggcggaagtcaggcatacgctggtaactttgaggcagctggtaacgctctatgatccagtcgattttcagagagacgatgcctgagccatccggcttacgatactgacacagggattcgtataaacgcatggcatacggattggtgatttcttttgtttcactaagccgaaactgcgtaaaccggttctgtaacccgataaagaagggaatgagatatgggttgatatgtacactgtaaagccctctggatggactgtgcgcacgtttgataaaccaaggaaaagattcatagcctttttcatcgccggcatcctcttcagggcgataaaaaaccacttccttccccgcgaaactcttcaatgcctgccgtatatccttactggcttccgcagaggtcaatccgaatatttcagcatatttagcaacatggatctcgcagataccgtcatgttcctgtagggtgccatcagattttctgatctggtcaacgaacagatacagcatacgtttttgatcccgggagagactatatgccgcctcagtgaggtcgtttgactggacgattcgcgggctatttttacgtttcttgtgattgataaccgctgtttccgccatgacagatccatgtgaagtgtgacaagtttttagattgtcacactaaataaaaaagagtcaataagcagggataactttgtgaaaaaacagcttcttctgagggcaatttgtcacagggttaagggcaatttgtcacagacaggactgtcatttgagggtgatttgtcacactgaaagggcaatttgtcacaacaccttctctagaaccagcatggataaaggcctacaaggcgctctaaaaaagaagatctaaaaactataaaaaaaataattataaaaatatccccgtggataagtggataaccccaagggaagttttttcaggcatcgtgtgtaagcagaatatataagtgctgttccctggtgcttcctcgctcactcgagggcttcgccctgtcgctcgactgcggcgagcactactggctgtaaaaggacagaccacatcatggttctgtgttcattaggttgttctgtccattgctgacataatccgctccacttcaacgtaacaccgcacgaagatttctattgttcctgaaggcatattcaaatcgttttcgttaccgcttgcaggcatcatgacagaacactacttcctataaacgctacacaggctcctgagattaataatgcggatctctacgataatgggagattttcccgactgtttcgttcgcttctcagtggataacagccagcttctctgtttaacagacaaaaacagcatatccactcagttccacatttccatataaaggccaaggcatttattctcaggataattgtttcagcatcgcaaccgcatcagactccggcatcgcaaactgcacccggtgccgggcagccacatccagcgcaaaaaccttcgtgtagacttccgttgaactgatggacttatgtcccatcaggctttgcagaactttcagcggtataccggcatacagcatgtgcatcgcataggaatggcggaacgtatgtggtgtgaccggaacagagaacgtcacaccgtcagcagcagcggcggcaaccgcctccccaatccaggtcctgaccgttctgtccgtcacttcccagatccgcgctttctctgtccttcctgtgcgacggttacgccgctccatgagcttatcgcgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacatgagaattggtcgacggcccgggcggccgcaaggggttcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagcttttatgatccatttgccgtgggtcccaccagctatgtaggaataccctatcttctttataagagctttgatacatggaaaatattggaaaacaatgtccgaacatataatttcccccccgtaatatagcaaagatcacgaaaaggcccgaaaaagtacatttagtttaaaatttggagtagaaaaaaaaacaatagaaaaaatccaatttcctccctcgttcatcggagagctctctttgggctttccaaaaaggtatcacaagacaagtttggcctcaccgtctaaaagttatagagtcatacatttttaacaaaacaaaatagagaaaaacggaaaaaagagggatgcaacatgaggactttccgggaggtcacccatcctagtactactctcgtccaaggacccttaactgcgaagttctgatgggatccgttgcattagtgctggtatgatcgcatgtgttactacatgcaatgtaatcgtatctattcttttttaaagactttatgatccatttgccgtgggtcccaccagctatgtaggaaaacccaatcttctttataagagctttgatacatgcaaaatattggaaaacaatgtccgaacatataattttcccccataatatagcaaagatcacgaaaaggcccgaaaaagtacatttagttcaaaatttggagtagaaaaaaaggcagtaaaagaattccattttccttcctcagtgatcggagagctctctttggactttccgaaaaggtatcacatgccaagtttggcctcacggtctaaaagttatagagtcatacatttttaacaaaacaaaatagagaaaaacggaaaaaagagggatgcaacacgaggactttccgggaggtcacccatcctagtactactttcgcccaagcacccttaactgcggagttctgatgggatccggtgcattagtgctggtatgatcgcatgtgttactacatgcaatgtaatcatatttcttgttatttaaagattttatgatccatttgccgtgggtcccaccagctatgtaggaataccttatcttctttataggagctttgatacatgcaaaatattggaaaacaatatccgaacatatatctttccccccgtaatatagcaaagatcgcgaaaaggcccgaaaaagtacatttaggtcaaaatttggagtagaaaaaaaaagcaatagaagaattccattttccttcctcagtcatcggagagctctctttgggctttccgaaaaggtatcacatgccaagtttggcctcatggtctaaaagttatagagccatacatttttaacaaaacaaaatagagaaaaaccaaaaaaagagagggatgcaacacgaggactttccgggaggtcacccatcctagtactactctcgcccaagcacccttaactgcggagttctgatgggatccagtgcattagtgctggtatgatcgcatgtgttactacatgcaatgtaatcgtatctattcttttttaaagattatatgatccatttgccgtgggtcccaccagctatgtaggaataccctatcttctttataagagctttgatacatgcaaaatattggaaaacaatgtccgaacatataattttccccccgtaatatagcaaagatcacgaaaaggcccaaaaaagtacatttaggtcaaaatttggagttgaaaaaaaacaaaaagaagaattccattttccttcctcattcattggagagctctctttgggctttccgaaaaggtatcacatgccatgtttagcctcacggtctaaaagttatagagtcatacatttttaacaaaacaaaatagagaaaaaccaaaaaaacgagggatgcaacacgaggactttctgggaagtcacctatcctagtactactctcgcccaagcacccttaactgcggagttctgatgggatccggtgcattagtgctggtatgattgcatgtgttactacatgcaatgtaatcgtatctaatgcttttaaagactttatgatccatttgccgtgggtccccacaagctaagtaggaataccctatcttctttataagagttttcatacatgcaaaatatggaaaacaatgtccgaacatatattttccccccgtaatatagcaaagatcacgaaaaggcccacaaaaagtacatttagttcaaaatttggagtagaaaaaaaaacaatagaaaagttccaatttcnnnnnnnnnnnnnnnnnnnnnnnnnnnnnnnnnnnnnnnnnnnnnnnnnngggtcccaccagctacgtaggaataccctatcttgtttataagagctttgatacatgcaaaatattcgaaaacaatgtccgaacatataattttcgtcccgtaatatagcaaagatcacaaaaaggccagaaagagtacatttacgtcaaaatttggatagaaaaaaaacgaatagaagaattccattttgacttcctcattcatcggaaagctctctttgggctttccgaaaaggtatcacatgccaagtttggaatcacggtttaaaagttatagagtcatacatttttaacaaaaaataaagagaaaacccgaaaaatgagggatgcaacacgaggacttttcgggaggtcacccatcgtagtactactctcgcccaagcacgcttaactgtagagttctgatgggatccggttcattattgctggtatgatcgcatccgttactacatgcaatgcaatcgtatctattcttttttgaagactttatgatccatttgccgtgggtcccaccagctatgttggaataccctatcttgtttataagagctttgttacatgcaaaatattcgaaaacaatgtccgaacatataatatttgccccgtaatatagcaaagatcacgaaaaggccagaaaacctatattaagttcaaaatttggagtagaaaaaaaccaatagaagaattccattttccttcctcactcatcggagagctctctttggggctttccgaaaaggtatcacatgcaaagtttggcctcacaggctaaaagttatagagtcgtacatttttaacaaaaaaaaaaagagaaaagccgaaaaaaagaaggatgcaacacaaggactttccgggaggtcagccatcctaatattactctcgcccaagcacgcttaactgtagagttctgatgggatccggtgcattagtgctggtatgatcgcatctgttactacatgcaatgcaatcgtatctattctttttttaagactttatgatccatttaccgtgggtcccaccagctacgtaggaataacctatcttatttataagagctttgatacatgcaaaatattcgaaaacaatgtccgaacatataattttcgtcccgtaatatagcaaagatcacaaaaaggccagaaagagtacattaaggtcaaaattttggagtagaaaaaaaaacccttcctcattcattaaagagctctctttggcatttccgaaaaggtgtcacatgccaagttcggcctcacggtctaaaagttatagagtcatacattgttaacaaaaaaaaagagaaaaaccgattaaaagagttatgcaacacaaggactttcctggaggtcacccgtcctagtactactctcgcccaagcacgcttaaatgcggagttctgatgggatccggtccatgagtggtggtatgatcacatccgttactacatgcaatgcaatcgtatctattattttttgaagactttatgatccatttgccgtgggtcccaccagctatgtaggaataccctatcttgtttataagagctttgatacatccaaaatattcgaaaacaatgttggaacgtataagtttcgctcagtaatatagcaaagatcacgaaaaggccacaaaaagtacattaaggtaaaaatttagagtaggaaaaaaaaacaataggagaattccatgttccttcctcaatcatcggagagctctctttgggctttccaaaaaggtatcacatgccaagtttggcctcacggtctaaaagttatagagtcatacatttttaacaaaaaaaaatagagaaaaaccaaaaaaaagagggatgcaacacgaagactttcctggaggtcacccatcctagtactactctcgcccaagcacgcttaactgcggtgttctgataggatcaagtgcattagtgctggtaggatcgcattcgttactacatgcaatgcaattatatatattcttttttgaagactttatgatccatttgcggtaggtcccaccagctatgtaggaataccctatcttgcttataagagttttgatacatgcaaaaatattcgaaaacaatgtccgaacatataatttttgtcccgtaatataacaaagatcacgaaaaggccaaaaatagtacatttcggtcaaaacatggagcagaaaaaaaaccccttcctcattcatcggagagctctcattgggctttccgaaaagatatcacatgcaaagtttggcctcacggtttaaaagttatagagtcaaatatttttaacaaaaaaaagagagaaaaaccgaaaacaaagagggatgcaacacgaggactttccggaaggtcacccatcctagtactactctagcccaagcacgcttaaccgcggagttctgataggatccggtgcattagtgctggtatgatcgcatcagttactacatgcaatgcaatcatatatattttttttgaagactttatgatccatttgccgtgggtcccaccagctatgtaggaatacctatcttgtttataagagctttgatacatgcaaaatatttgaaaacaatgtccgaacgtataatcttcgtcccgtaatatagcaaagatcacgaaaaggccagaaaaagtacattaaggtcaaaattttgactagaaaaaaaaaacaatagaaaaattccattgtccttcctcattcatcggagagttctctttgggctttccgaaaaggtatcacatgccaagtttggcctcacggtctaaaacttatagaatcatacattcttaacaaaaaaaaaaaaaaaaccgaaaaaaagaagaatgcaacacaaggactttccaggaggtcaaccatcctagtagtactctcgcccaatcacgcttaactgcagagttctgatgggatccggtgcattagtgctggtatgatcgcatctgttactacatgcaatgcaatcgtatctattcttttttgaagactttatgatccatttgccgtgggtcccaccagctatgtaggaataccttatcttgtttataagagctttgatacatgcaaaatattcgaatacaatgtctgaacgtataactttcgccccgtaatatagcgaagatcacgaaaaggcccgaaaaagtacattaaggtcaaaatttcgagtagaaataaaaaccaatagaagaattccaatttccttcctcattcattggagagctctctttgggctttccgaaaaggtatcacatgcgaagtttcgcctcacaatctaaaagttatatagtcatacatttttaacaaaacaaatagagaaaaaccgaaaaaaagaatgatacaacacaacgactttcccggaggtcacccatcctaatactattctcgcccaagcaagcttaactgcagagtattgatgggatctgatgcataagtgctgatatgatcgcatccgttactacatgcaatgcaatcgtatctattcgtttttgaagactttatgatccatttgccgtgggtcccaccagctatgtaggaataccctatcttgtttataagagctttgatacatgcaaaaaattggaaaacaatgtctgaacatataatttttgtcccgtaatatagcaaagatcacgaaaaggatagaaaaagtacattaaggtcaaaattttgagtagaaaaaaaatcaatagaaggattccaatttccttgctcattcatatagctctctttgggctttccgaaaaggtatcacatgcaaagtttggcctcgcggtctaaaagttatagaggtatacttttttaccaaaaaaaaagaagaaaaaaaccaaaaaaaagagggattcaacacgaggactttctgggaggtcactcatcctattactactctcgcccaagcacgcttaactgcggagttctgataggatccagtgcattagtgcgggtatgatcacatccgttactacatgcaatgcaatcgtatatattttttttgaagactttatgatccatttgccgtgggtctcaccagctatataggaataccctatcttgtttataagagctttgatacatgcaaaatatttgaaaacaatgtccgaacgtataatcttcgtcccgtaatatagcaaagatcactaaaaggctagaaaaagtacattaagatcaaaattttgagtagaaaaataaacaatagaaaaattccattgtccttcctcattcatcggagagttctctttgggctttccgaaaaggtatcacatgccaagtttggcctcacggtctaaaacttatagaatcatacattcttaacaaaaaaaaaagagaaaaaccgaaaaaaagaagaatttaacacaaggactttccaggaggtcaaccatcctagtagtactctcgcccaatcacgcttaactgcagagttctgatgggatccggtgcattagtgctggtatgatcgcatctgttactacatgcaatgcaatcgtatctgttactacatgcaatgcaatcgtatctgttactacatgcaatgcaatcgtatctattcttttttgaagactttatgatccatttgccgtgggtcccaccagctatgtaggaataccctatcttgtttataagagctttgatacatgcaaaatattcgaatacaatgtctaaacgtataagtttcgccccgtaatatagcgaagatcacgaaaaggcccgaaaaagtacattaaggtcaaaatttggagtagaaataaaaaccaatagaagaattccaatttccttcctcattcattggagagctctctttgggctttccgaaaaggtatcacatgcgaagtttggcctcacaatctaaaagttatatagtcatacatttttaacaaaacaaatagagaaaaaccgaaaaaaagaatgatacaacacaaggactttccgggaggtcacccatcctaatactattctcgcccaagcaagcttaactgcagagtattgatgggatctgatgcataagggctgatatgatcgcatccgttactacaagcaatgcaatcgtatctattcgtttttgaagactttatgatccatttgccgtgggtcccaccagctatgtaggaataccctatcttgtttataagagctttgatacatgcaaaaaattggaaaacaatgtctgaacatataatttttgtcccgtaatatagcaaagatcacgaaaaggatagaaaaagtacattaaggtcaaaattttgagtagaaaaaaaatcaatagaaggattccaatttccttcctcattcatatagctctctttgggctttccgaaaaggtatcacatgcaaagtttggccccgcggtctaaaagttatagaggtatacatttttaccaaaaaaaagagggattcaacacgaggacttttttnnnnnnnnnnnnnnnnnnnnnnnnnnnnnnnnnnnnnnnnnnnnnnnnnntgctggtatgatcgcatcagttactacatgcaatgcaatcatatatattcttttttgaagactttatgatccatttgccgtaggtcccaccagctatgtaggaataccctatcttgtttataagagctttgatacatgcaaaatattcgaaaacaatgtccgaacatataatttttgtcccgtaatatagcaaagatcacgaaaaggccagaaaaaatacatttcggtcaaaatttggagtagaaaaaaagcccttcctcattcattggacagctctctttgggctttccgaaaaggtatcacatgccaagtttggcctcacggtctaaaccttatagactcatacatttttcacaaaaaaaagaagagaaaaaccaaaaaaaagagtgattaaacacgaggattttcctggaggtcacccatcctagtactactctcgcccaagcacgcttaactgcgaaggtctgatgggatatggtgcattagtgctggtatgatcgcatctgttactacatgcaatgcaatcgtatctattcttttttgaagatttgatgattcatttaccgtgggtcccaccagctatgtaggaataacctatcttatttataaaagctttgatacatgcaaaatattcgaaaacaatgtccgaacatataatgttcgccccaaaatatagcaaagaccacaaaaatgccataaaaagtacattaaggtcaaaatttggagtaggaaaaaaatcaataggagaattccattttccttccctcattcatcagagagctctctttgggcattccaaaaaggtatcacatgccaagtttggcctcacggtctaaaagttatagagtattacatttttaacaaaaaaaaaagggaaaaaccgaaaaagagggatgcaacacgaagacttttctggaggtcacccattctagtactactctcccccaagcacgcttaactgtggtgttctaataggatcaagtgcattagtgctggtatgatcgcatcagttactacatgcaatgcaatcatatatattcttttttgaagactttatgatccatttgccgtaggtcccaccagctatgtaggaataccctatcttgtttataagagctttgatacatgcaaaatattcgaaaacaatgtccgaacatataatttttgtcccgtaatatagcaaagatcacgaaaaggccagaaaaaatacatttcggtcaaaatttggagtagaaaaaaagcccttcctcattcattggacagctctctttgggctttccgaaaaggtatcatatgccaagtttggcctcacggtctaaaccttatagactcatacatttttcacaaaaaaaagaagagaaaaaccaaaaaaaagagtgattaaacacgaggactttcctggaggtcatccatcctagtactactctcgcccaagcacgcttaattgcgaagttctgatgggatctggtgcattagtgctggtatgatcgcatatgttactacatgcaatgcaatcgtatctattcttttttgaagattttatgattcatttaccgtgggtaccaccagctatgtaggaataacctatcttatttataagagctttgatacatgcaaaatattcgaaaacaatgtccgaacatataatttttgtcccgtaatatagcaaagatcacgaaaaggccagaaaaaatacatttcggtcaaaatttggagtagaaaaaaacccttcctcattcattggacagctctgtttgagctttccgaaaaggtatcacatgccaagtttggcctcacggtctaaaagttatagagtcatacatttttcacaaaaaaaagaagagaaaaaccaaaaaaaagagtgatgaaacacgaggactttcctggaggtcacccatcctagtactactctcgcccaagcacgcgtaactgcgaagttctgatgggatctggtgcattagtgctggtatgatcgcatctgttactacatgcaatgcaatcgtatctattcttttttgaagattttatgattcatttaccgtgggtcccaccagctatgtaggaataacctatcttatttataagagctttgatacatgcaaaatattggaaaacaatgtccgaacatataatgttcgccccaaaatatagcaaagacaacaaaaatcccataaaaagtacattaaggtcaaaatttggagtaggaaaaaaatcaataagagaattccattttccttccctcattcatcggagaggtctctttgggcattccaaaaaggtatcacatgccaagtttggcctcacggtctaaaagttatagagtaatacatttttaacaaaaaaaaaagagaaaaaccgaaaaaaagagggatgcaacacgaagacttttctggaggtcacccatcctagtactactctcccaaagcacgcttaactgtggtgttctgataggatcaagtgcattagtgcgggtatgatcgcatcagttactacatgcaatgcaatcatatatattcttttttgaagactttatgatccatttgccgtaggtcccaccagctatgtaggaataccctatcttgtttataagagctttgatacatgcaaaatattcgaaaacaatgtccgaacatataatttttgtcccgtaatatagcaaagatcacgaaaaggccaggaaaaatacatttcggtcaaaatttggagtagaaaaaaaacccttcctcattcattggacagctctctttgggctttccgaaaaggtatcacatgccaagtttggcctcacggtctaaaagttatagattcatacatttttcacaaaaaaaagaagagaaaaaccaaaaaaaagagggatgaaacacgaggactttcccagaggtcacccatcctagtactactctcgcccaagcacgcttaactgcgaagttctgatgggatctggtgcattagtgctggtatgatcgcatctgttactacatgcaatgcaatcgtatctattcttttttgaagattttatgattcatttaccgtgggtcccaccagctatgtaggaaaacctatcttatttataagatctttgatacatgcaaaatattggaaaacaatgtccgaacatataatgttcgccccaaaatatagcgaagaccacaaaaatgccataaaaagtacattaaggtcaaaatttggagtaggaaaaaaatcaataggagaattccattttccttccctcattcatcggagagctctctttgggcattccaaaaaggtatcacatgccaagtttggcctcacggtctaaaagttatagaatattacatttttaacaaaaaaaaagagaaaaaccaaaaaaaagagggatgcaacacgaagacttttctggaggtcacccatcctactactactctcgcccaagcacacttaactgcggtgttctgataggatcaagtgcattagtgctggtatgatcgcatcagttactacatgcaatgcaatcatatatattcttttttgaagactttatgatccatttgccgtaggtcccaccagctatgtaggaataccctatcttgtttataagagctttgatacatgcaaaatattcgaaaacaatgtccgaacatataatttttgtcccgtaatatagcaaagatcacgaaaaggccagaaaaaatacattttggtcaaaatttggagtagaaaaaaagcccttcctcattcattggacagctctctttgggctttccgaaaaggtatcacatgccaagtttggcctcacggtctaaaccttatagactcatacatttttcacaaaaaaaagaagagaaaaaccaaaaaaaagagtgattaaacacgaggattttcctggaggtcacccatcctagtactactctcgcccaagcacgcttaactgcgaaggtctgatgggatatggtgcattagtgctggtatgatcgcatctgttactacatgcaatgcaatcgtatctattcttttttgaagatttgatgattcatttaccgtgggtcccaccagctatgtaggaataacctatcttatttataaaagctttgatacatgcaaaatattcgaaaacaatgtccgaacatataatgttcgccccaaaatatagcaaagatcacaaaaatgccataaaaagtacattaaggtcaaaatttggagtaggaaaaaaatcaataggagaattccattttccttccctcattcatcggagagctctctttgggcattccaaaaaggtatcacatgccaagtttggcctcacggtctaaaagttatagagtattacatttttaacaaaaaaaaaagggaaaaaccgaaaaagagggatgcaacacgaagacttttctggaggtcacccatcctagtactactctcccccaagcacgcttaactgtggtgttctaataggatcatgtgcattagtgctggtatgatcgcatcagttactacatgcaatgcaatcatatatattcttttttgaagactttatgatccatttgccgtaggtcccaccagctatgtaggaataccctatcttgtttataagagctttgatacatgcaaaatattcgaaaacaatgtccgaacatataatttttgtcccgtaatatagcaaagatcacgaaaaggccagaaaaaatacatttcggtcaaaatttggagtagaaaaaaagcccttcctcattcattggacagctctctttgggctttccgaaaaggtatcatatgccaagtttggcctcacggtctaaaccttatagactcatacatttttcacaaaaaaaagaagagaaaaaccaaaaaaaagagtgattaaacacgaggactttcttggaggtcatccatcctagtactactctcgcccaagcacgcttaactgcgaagttctgatgggatctggtgcattagtgctggtatgatcgcatctgttactacatgcaatgcaatcgtatctattcttttttgaagattttatgattcatttaccgtgggtaccaccagctatgtaggaataacctatcttatttataagagctttgatacatgcaaaatattcgaaaacaatgtccgaacatataatttttgtcccgtaatatagcaaagatcacgaaaaggccagaaaaaatacattttggtcaaaatttggagtagaaaaaaacccttcctcattcattggacagctctgtttgagctttccgaaaaggtatcacatgccaagtttggcctcacggtctaaaagttatagagtcatacatttttcacaaaaaaaaagaagagaaaaaccaaaaaaaagagtgatgaaacacgaggactttcctggaggtcacccatcctagtactactctcgcccaagcacgcgtaactacgaagttctgatgggatctggtgcattagtgctggtatgatcgcatctgttactacatgcaatgcaatcgtatctattcttttttgaagattttatgattcatttaccgtgggtcccaccagctatgtaggaataacctatcttatttataagagctttgatacatgcaaaatattggaaaacaatgtccgaacatataatgttcgccccaaaatatagcaaagacaacaaaaatgccataaaaagtacattaaggtcaaaatttggagtaggaaaaaaatcaataagagaattccattttccttccctcattcatcggagagctctctttgggcattccaaaaaggtatcacatgccaagtttggcctcacggtctaaaagttatagagtagtacatttttaacaaaaaaaaaagagagaaaccgaaaaaaagagggatgcaacacgaagacttttctggaggtcacccatcctagtactactctcccaaagcacgcttaactgtggtgttctgataggatcaagtgcattagtgcgggtatgatcgcatcagttactacatgcaatgcaatcatatatattcttttttgaagactttatgatccatttgccgtaggtcccaccagctatgtaggaataccctatcttgtttataagagctttgatacatgcaaaatattcgaaaacaatgtccgaacatataatttttgtcccgtaatatagcaaagatcacgaaaaggccaggaaaaatacatttcggtcaaaatttggagtagaaaaaaaacccttcctcattcattggacagctctctttgggctttccgaaaaggtatcacatgccaagtttggcctcacggtctaaaagttatagattcatacatttttcacaaaaaaaagaagagaaaaaccaaaaaaaagagggatgaaacacgaggactttcccagaggtcacccatcctagtactactctcgcccaagcacgcttaactgcgaagttctgatgggatctggtgcattagtgctggtatgatcgcatctgttactacatgcaatgcaatcgtatctattcttttttgaagattttatgattcatttaccgtgggtcccaccagctatgtaggaaaacctatcttatttataagatctttgatacatgcaaaatattggaaaacaatgtccgaacatataatgttcgccccaaaatatagcgaagaccacaaaaatgccataaaaagtacattaaggtcaaaatttggagtaggaaaaaaatcaataggagaattccattttccttccctcattcatcggagagctctctttgggcattccaaaaaggtatcacatgccaagtttggcctcacggtctaaaagttatagaatattacatttttaacaaaaaaaaagagaaaaaccgaaaaaaagagggatgcaacacgaagacttttctggaggtcacccatcctactactactctcgcccaagcacacttaactgcggtgttctgataggatcaagtgcattagtgctggtatgatcgcatcagttactacatgcaatacaatcatatatattcttttttgaagactttatgatccatttgccgtaggtcccaccagctatgtaggaataccttatcttgtttataagagctttgatacatgcaaaatattcgaaaacaatgtccgaacatataatttttgtcccgtaatatagcaaagatcacgaaaaggccagaaaaaatacatttcggtcaaaatttggagtagaaaaaaaacccttcctcattcattggacagctctctttgggctttccgaaaaggtatcacatgccaagtttggcttcacggtctaaaccttatagactcatacatttttcacaaaaaaaagaagagaaaaacaaaaaaaaagagtgattaaacacgaggactttcctggaggtcacccatcctagtactactctcgcccaagcactcttaactgcgaagttctgatgggatctggtgcattagtgctggtatgaacgcatctgttactacatgcaatgcaatcgtatgtattcttttttgaagattttatgattcatttaccgtgggtcccaccagctatgtaggaataacctatcttatttataaaagctttgatacatgcaaaatattcgaaaacaatgtccgaacatataatgttcgccccaaaatatagcaaagaccacaaaaatgccataaaaagtacattaaggtcaaaatttggagtaggaaaaaaatcaataggagaattccattttccttccctcattcatcggagagctctctttgggcattccaaaaaggtatcacatgccaagtttggcctcacggtctaaaagttatagagtattacatttttaacaaaaaaaaaaagagaaaaaccgaaaaaaagagggatgcaacacgaagacttttctggaggtcacccatcctagtactactctcccccaagcacgcttaactgtggtgttctgataggatcaagtgcattagtgctggtatgatcgcatcagttactacatgcaatgcaatcatatatattcttttttgaagactttatgatccatttgccgtaggtcccaccagctatgtaggaataccctatcttgtttataagagctttgatacatgcaaaatattcgaaaacaatgtccgaacatataatttttgtcccgtaatatagcaaagatcacgaaaaggtcagaaaaaatatatttcggtcaaaatttggagtagaaaaaaagcccttcctcattcattggacagctctctttgggctttccgaaaaggtatcacatgccaagtttggcctcacggtctaaaccttatagactcatacatttttcataaaaaaaagaagagaaaaacaaaaaaaaaaagagtgattaaacacgaggactttcctggaggtcacccatcctagtactactctcgcccaagcacgcttaactacgaagttccgatgggatctgatgcattagtgctggtatgatcgcatctgttactacatgcaatgcaatcgtatctattcttttttgaagattttatgattcatttactgtgggtcccaccagctatgtaggaataacctatcttatttataaaagctttgatacatgcaaaatattggaaaacaatgtccgaacatataatgttcgccccaaaatatagcaaagaccacaaaaatgccataaaaagtacattaaggtcaaaatttggagtaggaaaaaaatcaataggagaattccattttccttccctcattcatcggagagctctctttgggcattccaaaaaggtatcacatgccaagtttggcctcacggtctaaaagttatagagtaatacatttttaacaaaaaaaaaaaagaaaaaaaccgaaaacaaagagggatgcaacacgaagactttcctggaggtcacccatcctagtactactctcacccaagcacacnttaactgtggtgttctgataggatcaagtgcattagtgctggtatgatcgcatcagttactacatgcaatgcaatcnnnnnnnnnnnnnnnnnnnnnnnnnnnnnnnnnnnnnnnnnnnnnnnnnnctcctcagtcatctttgagctctctttgggctttccgaaaaggtatcacatgcccagtttggcctcacggtctaaaagttataaagtcatacatttttaacaaaaaaaaaagagaaaaaccgaaaaaaagagggatgcaatacgaggactttccacgaggtcacccatcctagtacaactctcgccaaagcatgcttaactgcggagtttagatgggatctggtgcattagtgctggtatgatcgcatctgttactacatgcaatgcaatcgtatctattcttatttaaagactttatcatccatttgccatgggtcccacctgtaggaatacccaatcttgtttataagagctttgatacatgcaaaatattcgaaaacaacgtccgaacatataattttcgccccgtaatatagcaaagatcacgaaaaggcccgaaaaagtacattaaggtcaaaatttggaatagaaaaaaaaaccaaaagaagtattccattgtcctttgtcattcatcgaagagctctctttgggctttccgaaaaggtatcgcaagccaagtttggcctcacggtttaaaagttataaagtcatacatttttaacaaaaaaaaaaagagaaaaaaccgaaaaaaagagggatgcaacacgaggacttttctggaggtcacccatcctagtactactctcgcccgatcacccttaactgcgtagttttgatgggattcgatgcattagtgctggtatgatcgcatctgttactacatgcaatgtaatcgtatctattcttttttaaagactttatgatccatttgccgtgggtcccaccagctatgtaggaataccctatcttctttataagagctttgatatatgcaaaatagtggaaaaccatgtccgaacatataatttttcccctgtaatatagcaaagatcaagaaaaagccaaaaaaagtatatttaggtcaaaatttggagtagaaaaaaaaacaatagaagaattccattttccttcctcagtcatcggagagctctctttcggctttccgaaaaggtatcaaatgccaagtttggcctcacggtctaaaagttatagagtcatacatttttaacaatacaaagtagagaaaaccggaaaaaagagggatgcaacatgaggactttccgggaggtaatccatcctagtacaactcttgcccaagcacccttaactgcggagttctgatggaatccggtgcattagtgctggtatgatcgcatgtgttactacatgcaatgtaatcgtatctatttttttttaaagactttatgatccatttgccgtgggtcccaccagctatgtaggaataccctatcttctttataagagctttgatacatgcaaaatatatgaaaaaacgttcgaacatataatttttccccccgtaatatagcaaagatcacgaaaaggcccgaaaaagtacatttagttcaaaatttggagtagaaaaacccaatagaagaattccattttccttcgtcattcatcggagagctctctttgggctttccgaaaaggtatcacatgccaagtttggcctcacggtctaaaagttatagagtcatacatttttaacaaaacaaaattgagaaaaaccgaaaaaagagggatgcaacacgaggactctccagaaggtaacccatcttagtactactttcgcccaagcacccttaactgcggagttctgataggacccggtgcattagtgctggtatgatcgcatgtgttactacatgcaatgtaatcgtatatattcatttttaaagactttatgatccatttgccgtgggtcctaccagctatgtagaaataccctatcttctttataagagctttcattcacgcaaaataatggaaaacaatgtccgaagatataattcccccccccccccccccgtaatatagcaaagatcacgaaaaggcccgaaaaagtacattaagttcaaaatttggagtagaaaaaaaaacaatagaagaattccattttccttcctcagtcatcggagagctctctttgggctttccgaaaaggtatcacatgccaagtttggcctcacggtctaaaggttatagagtcatacatttttaacaaaaaaaaatagaaaaacagaaaaaagagggatgcaatacgaggactttccaggaggtcacccatcctagtacaactctcgccgaagcacgcttaactacggtgttcagatggaatctggtgcattagtgctggtatgatgtcatttgttactacatgcaatgcaatcatatctattcttatttaaagactttatgatccatttgccgtgggtcccacctgtaggaataccctatcttgtttataaaagatttgatacatgcaaaatactcgaaaacaatgtccgaacatataattttcaccccgtaatatagcaaagatcacgaaaaggcccgaaaaagtacattaaagtcaaaatttggagtagaaaaaaacccaatagaagtattccattctccttcgtcattcatcggagagctctctttaggctttccgaaaagatatcacatgccaagtttggcctcacggtttaaaagttatagagtcatagatttttaacaaaacaaaaagagaaaaaccgaaaaaaaattgggatgcaacacgaggactttcctggaggtcacccatcctagtactactcttgcccaagcacccttaactgcgtagttctgatgggatccgatgctttagggctggtatgatcgcatctgttactacatgcaatgtaatcgtatctattcttttttaaagactttatgatccatttgccgtgggtcccaccagctatgtaggaataccctatcttctttataagagctttgataaatgcaaaatattggaaagcaatgtccgaacatataatttcgcccccgtaatatagcaaagatcacgaaaaagcccaaaaaagttcatttaggtcaaaatttgagcagaagaaaaagaaatagaagaattccattttccttcctcatttattggagagctctctttgggctttccgaaaaggtatcacatgccaagtttggcctcacggtctaaaagttatagagtcatacagttttaacaaaatgaaatagagaaaaaccgaaaaaaagagggatgtaacacgaggactttccgggaggtaatctatcctactactactctcggccaagcacccttaactgcggagttctaatgggatccggtgcattagtgctagtatgatcgcatgtgttactacatgcaatgtaatcgtatctattcttttttaaagactttatgatccatttgccgtgggtcccaccagctatgtaggaataccctatcttctttataagagctttgatacatgcaaaatatatgaaaaaaacgtccgaacatataattttccccccgtaatatagcaaagatcatgaaaaggcccaaaaaagtacattaatgtcaaaatttggcgtagaaaaaaaaccaatagacatattccattgtccttcatcattcattgaagagctctctttgggctttccgaaaaggtatcacatgccaagtttggcctcacggtctaaaagttatagagtcatacatttttaacaatacaaaatagagaaaaaccgaaaaaaagagggatgcaacacgaggactttccgggaggtaatccatcctagtactactctcgcccaagcacccttaactgcggagttctgatgggacccggtgcattagtgctggtatgatcgcatctgttactatatgcaatgtaatcgtatctattcttttttaaagactttatgatccatttgccgtgggtcccaccagctatgtaggaataccctatcttctttataagagctttgatatatgcaaaatattggaacaccatgtccgaacatataatttttcccgtgtaatatagcaaagatcaagaaaaagacaaaagagtacatttaggtcaaaatttgagtagaaaaaaacaaatagaagaattccattttccttcctcattcagctgagagctctctttgggctttccgaaaaggtatcatatgccaagtttggcctcacagtgtaaaagttatagagtctaacatttttaacaaaacaaaatagagaaaaaccaaaaaaagagggatgcaacacgaggactttctgggaggtcacccatcctagtactactctcgcccaagcacccttaactgcggagttctgatgggatccggtgcattagtgcaggtatgatcgcatgtgttactacatgcaatgtaatcctatctattctttcttaaagactttatgatccatttgccgtgagtcccaccagctatgtaggaataccctatcttctttataagagctttgatacatgcaaaatattggaaaacaatatccgaacatatagttttccccccgtaatatagcaaagatcacgaaaaggcccgaaaaagtacatttagttcaaaattgggagtagaaaaaaaaacaatagaagaattccattttacttcctcagtcatcggagagctctctttgggctttccgaaaaggtatcacatgcccagtttggcctcacggtctaaaagttataaagtcatacatttttaacaaaaacaaaagagaaaaaccgaaaaaaaagagggatgcaatacgaggactttccacgaggtcacccatcctagtacaactctcgccgaagcatgcttaactgcggagtttagatgggatctggtgcattagtgctggtatgatcgcatctgttactacatgcaatgcaatcgtatctattcttatttaaagactttatcatccatttgccatgggtcccacctgtaggaatacccaatcttgtttataagagctttgatacatgcaaaatattcgaaaacaacgtccgaacatataattttcgccccgtaatatagcaaagatcacgaaaaggcccgaaaaagtacattaaggtcaaaatttggaatagaaaaaaaaaccaatagaagtattccattgtcctttgtcattcatcgaagagctctctttgggctttccgaaaaggtatcgcaagccaagtttggcctcacggtttaaaagttataaagtcatacatttttaacaaaaaaaaaaagagaaaaaaccgaaaaaaagagggatgcaacacgaggacttttctggaggtcacccatcctaatacttctctcgcccgatcacccttaactacgtagttttgatgggattcgatgcattagtgctggtatgatcgcatctgttactacatgcaatgtaatcgtatctattcttttttaaagactttatgatccatttgccgtgggtcccaccagctatgtaggaataccctatcttctttataagagctttgatatatgcaaaatattggaaaaccatgtccgaacatataatttttcccctgtaatatagcaaagatcaagaaaaagccaaaaaagtatatttaggtcaaaatttggagtagaaaaaaaaacaatagaagaattccattttccttcctcagtcatcggagagctctctttgggctttccgaaaaggtatcaaatgccaagtttggcctcacggtctaaaagttatagagtcatacatttttaacaatacaaagtagagaaaaccggaaaaaagagggatgcaacatgaggactttccgggaggtaatccatcctagtacaactcttgcccaagcacccttaactgcggagttctgatggaatccggtgcattagtgctggtatgatcgcatgtgttactacatgcaatgtaatcgtatctattcttttttaaagactttatgatccatttgccgtgggtcccaccagctatgtaggaataccctatcttctttataagagctttgatacatgcaaaatatatgaaaaaacgttcgaacatataatttttccccccgtaatatagcaaagatcacgaaaaggcccgaaaaagtacatttagttcaaaatttggagtagaaaaacccaatagaagaattccattttccttcgtcattcatcggagagctctctttgggctttccgaaaaggtatcacatgccaagtttggcctcacggtctaaacgttatagagtcatacatttttaacaaaacaaaattgagaaaaaccgaaaaaaagagggatgcaacacgaggactctccagaaggtaacccatcttagtactactttcgcccaagcacccttaactgcggagttctgataggacccggtgcattagtgctggtatgatcgcatgtgttactacatgcaatgtaatcgtatatattcatttttaaagactttatgatccatttgccgtgggtcctaccagctatgtagaaataccctatcttctttataagagctttcattcacgcaaaataatggaaaacaatgtccgaagatataatttccccccccccccgtaatatagcaaagatcacgaaaaggcccgaaaaagtacattaagttcaaaatttggagtagaaaaaaaaacaatagaagaattccattttccttcctcagtcatcggagagctctctttgggctttccgaaaaggtatcacatgccaagcttggcctcacggtctaaaggttatagagtcatacatttttaacaaaaaaaaaatagaaaaacagaaaaaagagggatgcaatacgaggactttccaggaggtcacccatcctagtacaactctcgccgaagcacgcttaactacggtgttcagatggaatctggtgcattagtgctggtatgatgtcatttgttactacatgcaatgcaatcatatctattcttatttaaagactttatgatccatttgccgtgggtcccacctgtaggaataccctatcttgtttataaaagatttgatacatgcaaaatactcgaaaacaatgtccgaacatataattttcaccccgtaatatagcaaagatcacgaaaaggcccgaaaaagtacattaaagtcaaaatttggagtagaaaaaaacccaatagaagtattccattctccttcgtcattcatcggagagctctctttaggctttccgaaaagatatcacatgccaagtttggcctcacggtttaaaagttatagagtcatagatttttaacaaaacaaaaagagaaaaaccgaaaaaaattgggatgcaacacgaggactttcctggaggtcacccatcctagtactactctcgcccaagcacccttaactgcgtagttctgatgggatccgatgctttagtgctggtatgatcgcatctgttactacatgcaatgtaatcgtatctattcttttttaaagactttatgatccatttgccgtgggtcccaccagctatgtaggaataccctatcttctttataagagctttgataaatgcaaaatattggaaaccaatgtccgaacatataatttcgcccccgtaatatagcaaagatcacgaaaaagcccaaaaaagttcatttaggtcaaaatttgagcagaagaaaaagaaatagaagaattccattttccttcctcatttattggagagctctctttgggctttccgaaaaggtatcacatgccaagtttggcctcacggtctaaaagttatagagtcatacatttttaacaaaatgaaatagagaaaaaccgaaaaaaagagggatgtaacacgaggactttccgggaggtaatctatcctactactactctcggccaagcacccttaactgcggagttctaatgggatccggtgcattagtgctggtatgatcgcatgtgttactacatgcaatgtaatcgtatctattcttttttaaagactttatgatccatttgccgtgggtcccaccagctatgtaggaataccctattttctttataagagctttgatacatgcaaaatattggaaaacaatgtccgaacatattattttccccccgtaatatagcaaagatcacgaaaaggcccgaaaaagtacatttagttcaaaatgtggagtagaaaaaaaaacaatagaagaattccattttccttcgtcattcatcggagagctctctttaggctttccgaaaaggtatcacatgccaagtttggcctcacggtctaaaagttatagaatcatacatttttaacaaaacaaaatagagaaaaaccgaaaaagagggatttaacacgaggactttccgagaggtaacccatcctagtactactctcgtccaagcacccttaactgcggagttctgatgggatccggtgtattagtgctggtatgatcgcatgtgttactacatgcaatgtaatcgtatctattcttttttaaagactttataatccatttgccgtgggtcccaccagctatgtaggaataccctattttctttataagagctttgatacatgcaaaatattagaaaacaatgtccgaacatattattttccccccgttatatagcaaagatcacgaaaaggcccgaaaaagtacatttagttcaaaatttggagtagaaaaaaaaacaatagaagaattccattttccttcgtcattcatcggagagctctctttaggctttccgaaaaggtatcacatgccaagtttggcctcacggtctaaaagttatagagtcatacatttttaacaaaacaaaatagagaaaaaccgaaaaaagagggatttaacacgaggactttctgagaggtaacccatccgagtactacactcgcccaagcacccttaactacggagttctgatgggatacggtgcattagtgctggtttgatcgcatctgttactacatgcaatgtaatcgtatctattcttttttaaagactttatgatccatttgccgtgggtgccaccaactatgtaggattatcctatattctttataagagctttgatacatgcaaaatattcgaaaacaatgtccgaacatataatttccacccgtaatatagcaaagatcacgaaaaggcccaaaaaagtacattaagtttaaaatttggagtagaaaaaaaaccaatagaagaattccattttccttcctcagtcatcggagagctctctttgggctttccgaaaaggtatcacatgccaagtttgacctcacggtctaaaggttatagagtcatacatttttaacaaaaaaaaatagaaaaacaggaaaaaagagggatgcaatacgaggactttccaggaggtcacccatcctagtacaactctcgccgaagcacgcttaactgcggtgttcagatgggatctggtgcattagtgctcgtatgatggcatttgttactacatgcaatgcaatcgtatctactcttatttaaagactttatgatccatttgccgtgggtgccaccaactatgtaggattatcctatattctttataagagctttgatacatgcaaaatattcgaaagcaatgtccgaacatataatttcccccccgtaatatagcaaagatcacgaaaaggcccgaaaaagtacatttagttcaaaatttggagtagaaaaaaaaacaatagaagaattccattttccttcgtcattcatcggagagctctctttaggctttccgaaaaggtatcacatgccaagtttggcctcacggtctaaaagttatagagtcatacattttcaacaaaacaaaatagagaaacaccgaaaaaagagggatttaacacgaggactttccgagaggtaacccatcctagtactactctcgtccaagcacccttaactgcggagttctgatgggatccggtgcattagtgctggtatgatcgcatgtgttactacatgcaatgtaatcatatctattctttttttaaagactttatgattcatttgccgtgggtcccaccagctatgtaggaataccctattttctttataacagctttgatacatgcaaaatattggaaaacaatgtccgaacatattattttcctcccgtaatatagcaaagatcacgaaaaggcccgaaaaagtacatttagttcaaaatttggagtagaaaaaaaaacaatagaagaattccattttccttcgtcattcatcggagagctctctttaggctttccgaaaaggtatcacatgccaagtttggcctcacggtctaaaagtatagagtcatacatttttaaaaaaacaaaatagagaaaaaccgaaaaaagagggatttaacacgaggactttccgagaggtaacccatcctagtactactctcgtccaagcacccttaactgcggagttctaatgggatctggtgcattagtgctggtatgatcgcatgtgttactacatgcaatgtaatcgtatctattcttttttaaagactttatgatccatttgccgtgggtcccaccagctatgtaggaataccctattttctttataagagctttgatacatgcaaaatattggaaaacaatgtccgaacatattattttccccccgttatatagcaaagatcacgaaaaggcccgaaaaagtacatttagttcaaaatttggagtagaaagaaaaacaatagaagaattccattttccttcgtcattcatctgagagctctctttaggctttccgaaaaggtatcacatgccaagtttggcctcacggtctaaaagttatagagtcatacatttttaacaaaacaaaatagagaaaaaccgaaaaagagggatttaagacgaggactttctgagaggtaacccatccgagtactacactcgcccaagcacccttaactacggagttctgatgggatacggtgcattagtgctggtttgatcgcatgtgttactacatgcaatgtaatcgtatctattcttttttaaagactttatgatccatttgccgtgggtgccaccaactatgtaggattatcctatattctttataagatctttgatacttgcaaaatattcgaaaaaaatgtccgaacatataatttcccccccgtaatatagcaaagatcacgaaaaggcccaaaaaagtacattaagtttaaaatttggagtagaaaaaaaaccaatagaagaattccattttccttcctcagtcatcggagagctctctttgggctttccgaaaagttatcacatgccaagtttgacctcacggtctaaaggttatagagtcatacatttttaacaaaaaaaaatagaaaaacaggaaaaaagagggatgcaatacgaggactttccagcaggtcacccatcctagtacaactctcgccaaagcacgcttaactgcggtgttcagatgggatctggtgcattagtgcttgtatgatggcatttgttactacatgcaatgcaatcgtatcgattcttatttaaagactttatgatccatttgtcgtgggtgccacctgtaggaataccctatcttgtttataagagatttgatacatgcaaaatattcgaaaacaatgtccgaacatataatttttgccccgtaatatagaaaagatcacaaaaaagtccaaaaaagtacatttaggtcaaaatttgagcagaaaaaaaagaaatagaagaattccattttccttcgtcattcatcggagagctctctttaggctttccgaaaagatatcacatgccaagtttggcctcacggtctaaaagttatagagtcatacatttttcacaaaacaaaaagagaaaaaccgaaaaaaatagggatgcaacacgaggactttcctggaggtcacccatcctagtactaatctcgcccaagcacccttaactgcgtagttctgatgggatccgatgcattagtcctggtatgatcgcatctgttactatatgcaatataatcgtatctattcttttttaaagactttatgatccatttgccgtgggtcccaccagctatgtaggataccctatcttcataataagagctttgataaatgcaaaatattggaaaacaatgtccgaacatataatttccccccccccccccgtaatatagcaaagatcacgaaaaagcccaaaaaagtacatttaggtcaaaatttgagtagaaaaaaaaacaaatagaggaattccattttccgtcctcattcatcggagagctctctttcggctttccgaaaaggtatcacatgccaagtttggcctcacggtctaaaagttatagagtcatacatttttaacaaaacaaaatagagaaaaaccgaaaaaaagaaggatgcaacacgaggactttccgggaggtcacccatcctagtactactctcgcctaagcacccttaactgcggagttctgatgggatcaggtgcattagtgctggtatgatcgcatgtggtactacatgcaatgtaatcgtatctattccttttgaaagactttatgatccatttgccgtgggtcccaccagctatgtaggaataccctatcttctttataagagctttgatacatgcaaaatatttgaaaacaatgtccgaacatataattttccccccgttatatagcaaagatcacgaaaaggcccaaaaaagtacaattagttcaaaatttggagtagaaaaaaaaacaatagaagaattccattttccttcctcagtcatcggagagctctctttgggctttccaaaaaggtatcacatgccaagtttggcctcacagtctaaaagttatagagtcatacatttttaacaaaacaaaatagagaaaaaccgaaaaaaagagggatgcaacacgaggactttccgggaggtaacccatcctagtactactctcgcccaagcacccttaactgcggagttttgatgggatccggtgcattagtgttggtatgatcgcatgtgttactacatgcaatgtaatcgtatctattccttttgaaagactttatgatccatttgccgtgggtcccaccagctatgtaggaataccctatcttctttataagagctttgatacatacaaaatattggatcacaatgtcataacatataattttccccccttaatatagcaaagatcacgaaaaggcccgaaaaaatacatttagttcaaaatttggagtagaaaaaaaaaatataagaattccattttccttcctctgttatcggagagctctctttgggctttccgaaaaggtatcacatgccaagtttggcctcacggtctaaaagatataaagtcatacattattaacaaaacaaaatagagaaaaaccgaaaaaaagaaggatgcaacacgaggactttccgggaggtaatctatcctagtactactctcgcccaagcacccttaactgcggagttctgatgggatccggtgcattagtgttggtatgatcgcatgtgttactacatgcaatgtaaccgtatctattcttttttaaagactttatgatccatttgccgtgggtcccaccagctatgtaggaatattctatcttctttataagagctttgatacatgcaaaatattggaaaacaacgtccgaacatataatttccccccccccccgtaatatagcaaaaatcacgaaaaggcccgaaaaagtacatttagttcaaaatttgcagtagaaaaaaaaacaatagaagaatttcattttccttcctcagtcatcggagagctctctttgggctttccaaaaaggtatcacatgccaagtttggcctcacagtctaaaagttatagagtcatacatttttaacaaaacaaaatagagaaaaaccgaaaaaagagggatgcaacacgaggactttcccggaggtaatctatcctagtactactctcgcccaagcacccttaactgcggagttctgatgggatccggtgcagtagtgctggtatgatcgcatgtgttactacatgcaatgtaatcgtatctattcttttttaaagactttatgatccatttgccgtgagtcccaccagctatgtaggaatattctatcttctttataagagctttgatacatgcaaaatactggaaaacaatgtccgaacatataattttccccacgtaatatagcaaagatcacgaaaaggcccgaaaaagtacatttagttcaaaatttggagtagaaaaaaaaacaatagaagaatttcattttccttccctagtcatcggagagctctctttgggctttccaaaaaggtatcacatgccaagtttggcctcacagtctaaaagttatagagtcatacatttttaacaaaacaaaatagagaaaaaccgaaaaaaaagagggatgcaacacgaggactttctgggaggtaatctatcctagtactactctcgcccaagcacccttaactgcggagttctgatgggatccggtgcagtagtgctggtatgatcgcatgtgttactacatgcaatgtaatcgtatctattcttttttaaagactttatgatccatttgccgtgagtcccaccagctatgtaggaatattctatcttctttataagagctttgatacatgcaaaatactggaaaacaatgtccgaacatataattttccccccgtaatatagcaaagatcacgaaaaggcccagaaaagtacatttagttcaaaatttggagtagaaaaaaaaacaatagaagaattccattttccttcctcaatcatcggagagctctctttgggctttccgaaaaggtatctcatgccaagtttggcctcacgaactaaaagttatagagtcatacatttttaacaaaacaaaatagagaaaaaccgaaaaaagagggatgcaacacaaggactttccgggaggtcacccatcctagtactactctcgcccaagcacccttaactgcggagttctgatgggatccagtgcattagtgctggtatgatcgcatgtgttactacatgcaatgtaatcgtatctattcttttttaaagattttatgatccatttgccgtgggtcccaccagctatgtaggaataccctatcttctttataagagctttgatacatacaaaatattggatcacaatgtcagaacatataattttccccccttaatatagcaaagttcactaaaaggcccgaaaaaatacatttagttcaaaatttggagtagaaaaaaaaacaatagaagaatttcattttccttcctcagtcatcggagagctctctttgggctttccaaaaaggtatcacatgccaagtttggcctcacagtctaaaagttatagagtcatacatttttaacaaaacaaaatagagaaaaaccgaaaaaagagggatgcaacacgaggactttcccggaggtaatctatcctagtactactctcgcccaagcacccttaactgcggagttctgatgggatccggtgcagtagtgctggtatgatcgcatgtgttactacatgcaatgtaatcgtatctattcttttttaaagactttatgatccatttgccgtgagtcccaccagctatgtaggaatattctatcttctttataagagctttgatacatgcaaaatactggaaaacaatgtccgaacatataattttccccacgtaatatagcaaagatcacgaaaaggcccgaaaaagtacatttagttcaaaatttggagtagaaaaaaaaacaatagaagaatttcattttccttcctcagtcatcggagagctctctttgggctttccaaaaaggtatcacatgccaagtttggcctcacagtctaaaagttatagagtcatacatttttaacaaaacaaaatagagaaaaaccgaaaaaaaagagggatgcaacacgaggactttctgggaggtaatctatcctagtactactctcgcccaagcacccttaactgcggagttctgatgggatccggtgcagtagtgctggtatgatcgcatgtgttactacatgcaatgtaatcgtatctattcttttttaaagactttatgatccatttgccgtgagtcccaccagctatgtaggaatattctatcttctttataagatctttgatacatgcaaaatactggaaaacaatgtccgaacatataattttccccccgtaatatagcaaagatcacgaaaaggcccagaaaagtacatttagttcaaaatttggagtagaaaaaaaaacaatagaagaattccattttccttcctcaatcatcggagagctctctttgggctttccgaaaaggtatctcatgccaagtttggcctcacgaactaaaagttatagagtcatacatttttaacaaaacaaaatagagaaaaaccgaaaaaagagggatgcaacacaaggactttccgggaggtcacccatcctagtactactctcgcccaagcacccttaactgcggagttctgatgggatccagtgcattagtgctggtatgatcgcatgtgttactacatgcaatgtaatcgtatctattcttttttaaagattttatgatccatttgccgtgggtcccaccagctatgtaggaataccctatcttctttataagagctttgatacatacaaaatattggatcacaatgtcagaacatataattttccccccttaatatagcaaagttcactaaaaggcccgaaaaaatacatttagttcaaaatttggagtagaaaaaaaaacaatagaagaatttcattttccttcctcagtcatcggagagctctctttgggctttccaaaaaggtatcacatgccaagtttggcctcacagtctaaaagttatagagtcatacatttttaacaaaacaaaatagagaaaaaccgaaaaaaagagggatgcaacacgaggactttctgggaggtaatctatcctagtactactctcgcccaagcacccttaactgcggagttctgatgggatccggtgcagtagtgctggtatgatcgcatgtgttactacatgcaatgtaatcgtatctattcttttttaaagactttatgatccatttgccgtgagtcccaccagctatgtaggaatattctatcttctttataagagctttgatacatgcaaaatactggaaaacaatgtccgaacatataattttccccccgtaatatagcaaagatcacgaaaaggcccgaaaaagtacatttagttcaaaatttggagtagaaaaaaaaacaatagaagaattccattttccttcctcaatcatcggagagctctctttgggctttccgaaaaggtatctcatgccaagtttggcctcacgaactaaaagttatagagtcatacatttttaacaaaacaaaatagagaaaaaccgaaaaaagagggatgcaacacaaggactttccgggaggtcacccatcctagtactactctcgcccaagcacccttaactgcggagttctgatgggatccagtgcattagtgctggtatgatcgcatgtgttactacatgcaatgtaatcgtatctattcttttttaaagattttatgatccatttgccgtgggtcccaccagctatgtaggaataccctatcttctttataagagctttgatacatacaaaatattggatcacaatgtcagaacatataattttccccccttaatatagcaaagttcactaaaaggcccgaaaaaatacatttagttcaaaatttggagtagaaaaaaaaacaatagaagaatttcattttccttcctcagtcatcggagagctctctttgggctttccaaaaaggtatcacatgccaagtttggcctcacagtctaaaagttatagagtcatacatttttaacaaaacaaaatagagaaaaaccgaaaaaaagagggatgcaacacgaggactttctgggaggtaatctatcctagtactactctcgcccaagcacccttaactgcggagttctgatgggatccggtgcagtagtgctggtatgatcgcatgtgttactacatgcaatgtaatcgtatctattcttttttaaagactttatgatccatttgccgtgagtcccaccagctatgtaggaatattctatcttctttataagagctttgatacatgcaaaatactggaaaacaatgtccgaacatataattttccccccgtaatatagcaaagatcacgaaaaggcccgaaaaagtacatttagttcaaaatttggagtagaaaaaaaaacaatagaagaattccattttccttcctcaatcatcggagagctctctttgggctttccgaaaaggtatctcatgccaagtttggcctcacgaactaaaagttatagagtcatacatttttaacaaaacaaaatagagaaaaaccgaaaaaagagggatgcaacacaaggactttccgggaggtcacccatcctagtactactctcgcccaagcacccttaactgcggagttctgatgggatccggtgcattagtgctggtatgatcgcccgtgttactacatgcaatgcaatcgtatctattcttttttaaagattttatgatccatttgccgtgggtcccaccagctatgtaggaataccctatcttctttataagaggtttgatacatacaaaatattggatcacaatgtcagaacatataattttccccccttaatatagcaaagatcactaaaaggcccgaaaaaatacatttagttcaaaatttggagtagaaaaaaaaacaatagaagaattccattttccttcctcagttatcggagaactctctttgggctttccgaaaaggtatcacatgccaagtttggcctcacggtctaaaagatatagagtcatacattattaacaaaacaaaatagagaaaaaccgaaaaaaagaaggatgcaacacgaggactttgcgggaggtaatctatcctagtactactctcgcccaagcacccttaactgcggagttctgatgggatccggtgcattagtgctggtatgatcgcatgtgttactacatgcaatgtaatcgtatctattcttttttaaagactttatgatccatttgccgtgggtccnnnnnnnnnnnnnnnnnnnnnnnnnnnnnnnnnnnnnnnnnnnnnnnnnnacatgccaagtttggccttacggtctaaaagttatagagtaatacantttttaacaaaaaaaaaagaaaaaaaccgaaaacaaagagggatgcaacacgaagactttcctggaggtcacccatcctagtactactctcgcccaagcacacttaactgcggtgttctgataggatcaagtgcattagtgctggtatgatcgcatcagttactacatgcaatgcaatcatatatattcttttttgaagactttatgatccatttgccgtaggtcccaccagctatgtaggaataccctatctcgtttataagagctttgatacatgcaaaatattcgaaaacaatgtccgaacatataatttttgtcccgtaatatagcaaagatcgcgaaaaggccataaaaaatacatttcggtcaaaatttggagtagaaaaaaaacccttcctcattcattggacagctctctttgggctttccgaaaaggtatcacatgccaagtttggcctcacggtctaaaccttatagactcatacatttttcacaaaaaaaagaagagaaaaaccaaaaaaaagagtgattaaacacgaggactttcctggaggtcacccatcctagtactactctcgcccaagcacgcttaactgcgaagttctgatgggatctggtgcattagtgctggtatgatcgcatctgttactacatgcaatgcaatcgtatttattcttttttgaagattttatgattcatttaccgtgggtcccaccagctatgtaggaataacctatcttatttataaaagctttgatacatgcaaaatattagaaaacaatgtccgaacatataatgttcgccccaaaatatagcaaagaccacaaaaatgccataaaaagtacattaaggtcaaaatttggagtaggaaaaaaatcaataggagaattccattttccttccttcattcatcggagagctctctttgggcattccaaaaaggtatcacatgccaagtttggcctcacggtctaaaagttatagagtaatacatttttaacaaaaaaaaaagaaaaaaaccgaaaacaaagagggatgcaacacgaagactttcctggaggtcacccatcctagtactactctcgcccaagcacacttaactgcggtgttctgataggatcaagtgcattagtgctggtatgatcgcatcagttactacatgcaatgcaatcatatatattcttttttgaagactttatgatccatttgccgtaggtcccaccagctatgtaggaataccctatctcgtttataagagctttgatacatgcaaaatattcgaaaacaatgtccgaacatataatttttgtcccgtaatatagcaaagatcacgaaaaggccagaaaaaatacatttcggtcaaaatttggagtagaaaaaaaacccttcctcattcattggacagctctttttgggctttccgaaaaggtatcacatgccaagtttggcctcacggtctaaaccttatagactcatacatttttcacaaaaaaaagaagagaaaaaccaaaaaaaagagtgattaaacacgaggactttcctggaggtcacccatcctagtactactctcgcccaagcacgcttaactgcgaagttctgatgggatctggtgcattagtgctggtatgatcgcatctgttactacatgcaatgcaatcgtatctattcttttttgaagattttatgattcatttaccgtgggtcccaccagctatgtaggaataacctatcttatttataaaagctttgatacatgcaaaatattcgaaaacaatgtccgaacatataatgttcgccccaaaatatagcaaagaccacaaaaatgccataaaaagtacattaaggtcaaaatttggagtaggaaaaaaatcaataggagaattccattttccttccctcattcatcggagagctctctttgggcattccaaaaaggtatcacatgccaagtttggcctcacggtctaaaagttatagagtaatacatttttaacaaaaacaaaagaaaaaaaccgaaaacaaagagggatgcaacacgaagactttcctggaggtcacccatcctagtactactctcgcccaagtacacttaactgcggtgttctgataggatcaagtgcattagtgctggtatgatcgcatcagttactacatgcaatgcaatcatatatattcttttttgaagactttatgatccatttgccgtaggtcccaccagctatgtaggaataccctatcttgtttataagagctttcatacatgcaaaatattcaaaaacaatgtccgaacatataatttttgtcccgtaatatagcaaagatcacgaaaaggccagaaaaaatacatttcggtcaaaatttggagtagaaaaaaaacccttcctcattcattggacagctctctttgggctttctgaaaaggtatcacatgccaagtttggcctcacggtctaaaccttatagactcatacatttttcacaaaaaaaagaagagaaaaaccaaaaaaaagagtgattaaacacgaggactttcctggaggtcacccatcctagtactactctcgcccaagcacgcttcactgcgaagttctgatgggatctggtgcattagtgctggtatgatcgcatctgttactacatgcaatgcaatcgtatctattcttttttgaagattttatgattcatttaccgtgggtcccaccagataggaataacctatcttatttataaaagctttgatacatgcaaaatattcgaaaacaatgtccgaacatataatgttcgccccaaaatatagcaaagaccacaaaaatgcaataaaaagtacattaaggtcaaaatttggagtaggaaaaaaatcaataggagaattccattttccttccctcatttatcggagagctctctttgggcattccaaaaaggtatcacatgccaagtttggcctcacggtctaaaagttatagagtaatacatttttaacaaaacaaaaaagaaaaaaaccgaaaacaaagagggatgcaacacgaagactttcctggaggtcacccatcctagtactactctcgcccaagcacacttaactgcggtgttctgataggatcaagtgcattagtgctggtatgatcgcatcagttactacatgcaatgcaatcatatatattcttttttgaagactttatgatccatttgccgtaggtcccaccagctatgtaggaataccctatcttgtttataagagctttgatacatgcaaaatatacgaaaacaatgtccgaacatataatttttgtcccgtaatatagcaaaaaggccagaaaaaatacatttcggtcaaaatttggagtagaaaaaaaacccttcctcattcattggacagctctctttgggctttccgaaaaggtatcacatgccaagtttggcctcacggtctaaaccttataggctcatacatttttcacaaaaaaaagaaaagaaaaaccaaaaaaaagagtgattaaacacgaggactttcctggaggtcacccatcctagtactactctcgccgaagcacgcttaactgcgaagttctgatgggatctggtgcattagtgctggtatgatcgcatctgttactacatgcaatgcaatcgtatctattcttttttgaagattttatgattcatttaccgtgggtcccaccagctatgtaggaataacctatcttatttataaaagctttgatacatgcaaaatattcgaaaacaatgtccgaacatataatgttcgccccaaaatatagcaaagaccacaaaaatgccataaaaagtacattaaggtcaaaatttggagtaggaaaaaaatcaataggagaattccattttccttccctcattcatcggagagctctctttgggcattccaaaaaggtatcacatgccaagtttggcctcacggtctaanagttatagagtaatacatttttaacaaaaaaaaaagaaaaaaaccgaaaacaaagagggatgcaacacgaagactttcctggaggtcacccatcctagtactactctcgcccaagtacacttaactgcggtgttctgataggatcaagtgcattagtgctggtatgatcgcatcagttactacatgcaatgcaatcatatatattcttttttgaagactttatgatccatttgccgtaggtcccaccagctatgtaggaataccctatcttgtttataagagctttgatacatgcaaaatattcgaaaacaatgtccgaacatataatttttgtcccgtaatatagcaaagatcacgaaaaggccagaaaaaatacatttcggtcaaaatttggagtagaaaaaaagcccttcctcattcattggacagctctctttgggctttccgaaaaggtatcacatgccaagtttggcctcacggtctaaaccttatagactcatacatttttcacaaaaaaaagaagagaaaaaccaaaaaaaagagtgattaaacacgaggattttcctggaggtcacccatcctagtactactctcgcccaagcacgcttaactgcgaannnnnnnnnnnnnnnnnnnnnnnnnnnnnnnnnnnnnnnnnnnnnnnnnngtgttactacatgcaatgtaatcgtatctattcttttttaaagactttatgatccatttgccgtgggtcccaccagctatgtaggaatatcctatattctttataagagctttgatacatgcaaaatattcgaaaacaatgtccgaacatataatttcccccccgtaatatagcaaagatcacgaaaaggcccaaaaaagtacattaagtttaaaatttggagtagaaaaaaaaccaatagaaaaattccattttccttcctcagtcatcgaagagctctctttgggctttctgaaaaggtatcacatgccaagtttggcctcacggtctaaaagttatagagtcatacatttttaacaaaacaaaaagagaaaaaccgaaaaaaacagggatgcaacacgaggactttcctggaggtctcccatcctagtactactctcgcccaagcacccttaactgcgtagttctgatgggatccgatgcattagtgctggtatgatcgcatctgttactacatgcaatgtaatcgtatctattcttttttaaagacntttatgatccatttgccgtgggtcccaccagctatgtaggaataccctatcttcttaataagagccttgataaatgcaaaatattggaaaacaatgtccgaacatataatgcccccccccccgtaatatagcaaagatcacgaaaatgcccaaaaaagtacatttaggtcaaaatttgagtagaaaaaaaaacaatagaagaattccattttccttcctcatttatcggagagctctctttgggctttccgaaaaggtatcacatgacaagtttggcctcacggtctaaaagatatagagtcatacattattaacaaaacaaaatagagaaaaaccgaaaaaaaagagggatgcaacgcgaggactttccgggaggtaatctatcctagtactactctcgcccaagcacccttacctgcggagttctgatgggatccggtgcagtagtgctggtatgatcgcatgtgttactacatgcaatgcaatcatatatattcttttttgaagactttatgatccatttgccgtaggtcccaccagctatgtaggaataccctatcttgtttataagagctttgatacatgcaaaatattcgaaaacaatgtccgaacatataatttttgtcccgtaatatagcaaagatcacgaaaaggccagaaaaaatacatttcggtcaaaatttggagtagaaaaaaaccccttcctcattcattggacagctctctttgggctttccgaaaaggtatcacatgccaagtttggtctcacggtttaaaagttatagagtcatacatttttcacaaaaaaaagaagagaaaaaacaaaaaaaagagtgatgaaacacgaggactttcctagaggtcacccatcctagtactactctcgcccaagcacgcgtaactgcgaagttctgatgggatctggtgcattagtgctggtatgatcgcatctgttactacatgcaatgcaatcgtatctattcttttttgaagattttatgatccatttgcagtgggtcccaccagctatgtaggaataccctatcttgtttataagagctttgatacatgcaaaatcttcgaaaacaatgtccgaacatataattttcgccccgtaatatagcaaagatcacgaaaatgccaaaatagtacattaaggtcaaaatttggagtaggaaaaaaaacccttcatcattcattggagagctctctctgggctttccgaaaaggtatcacatgccaagtttggcctcacggtctaaaagttataaagtcatacatttttaacaaaaaaaaaagagaaaaaccgaaaaaaagagttatgtaacacgaggactttcctggaggtcacccgtcctagtactactctcgcccaaacacgcttaactgtggtgttctgataggatcaagtgcattagtgctggtatgatcgcatcagttactacatgcaatgcaatcatatatattcttttttgaaaactttatgatccatttgccgtaggtcccaccagctatgtcggaataccctatcttgtttataagagctttgatacatgcaaaatattcgaaaacaatgtccgaacatataatttttgtcccgtaatatagcaaagatcacgaaaaggccaaaaaaaatacatttcggtcaaaatttggagtagaaaaaaaccccttcctcattcattcgacaactctctttgggctttccgaaaaggtatcacatgccaagtttggtctcacggtctaaaagttatagagtcatacatttttcacaaaaaaaagaagagaaaaaaccaaaaaaagagtgatgaaacacgaggactttcctggaggtcactcatgctagtactactctcgcccaagcacgcttaactgcgaagttctgatgggatctggtgcattggtgatggtatgatcgcatctgttactacatgcaatgcaatcgtatctatttttttttgaagattttatgatccatttgcagtgtgtcccaccagctatgtaggaataccctatcttgtttataagagctttgatacatgcaaaatattcgaaaacaatgtccgaacatataatttttgtcccgtaatatagcaaagatcacgaaaagaccagaaaaaatacatttcggtcaaaatttggagtagaaaaaaaacccttcctcattcattggacagctctctttgggctttccgaaaaggtatcacatgccaagtttggtctcacggtttaaaagttatagagtcatacatttttcacaaaaaaaagaagagaaaaaacaaaaaaaagagtgatgaaccacgaggactttcctggaggtcacccatcctagtactactctcgcccaagcacgcgtaactgcgaagttctgatgggatctggtgcattagtgctggtatgatcacatctgttactacatgcaatgcaatcgtatctattcttttttgaagattttatgatccatttgcagtgggtcccaccagctatgtaggaataccctatcttgtttataagagctttgatacatgcaaaatcttcgaaaacaatgtccgaacatataattttcgccccgtaatatagcaaagatcacgaaaatgccaaaatagtacatttaggtcaaaatttggagtaggaaaaaaaaaccttcatcattcattggatagctctctctgggcttttcgaaaaggtatcacatgccaagtttggcctcacggtctaaaagttataaagtcatacatttttaacaaaaaaaaaagagaaaaaccgaaaaaaagagttatgaaccacgaggactttcctggaggtcacccgtcctagtactactctcgcccaaacacgcttaactgcggtgttctgataggatcaagtgcattagtgctggtatgatcgcatcagttactacatgcaatgcaatcatatatattcttttttgaagactttatgatccatttgccgtaggtcccaccagctatgtaggaataccctatcttgtttataagagctttgatacatgcaaaatattcgaaaacaatgtccgaacatataatttttgtcccgtaatatagcaaagatcacgaaaaggccaaaaaaaatacatttcggtcaaaatttggagtagaaaaaaaccccttcctcattcattggacagctctctttgggctttccgaaaaggtatcacatgccaagtttggtctcacggtctaaaagttatagagtcatacatttttcagaaaaaaaagaagagaaaaaaccaaaaaaagagtgatgaaacacgaggactttcttggaggccacccatcctagtactactctcgcccaagcacgcttaactgcgaagttctgatgggatctggtgcattagtgatggtatgatcgcatctgttactacatgcaatgcaatcgtatctattcttttttgaagattttatgatccatttgcagtgggtcccaccagctatgtaggaataccctatcttgtttataagagctttgatacatgcaaaatattcgaaaacaatgtccgaacatataattttcgccccgtaatatagcaaagatcacgaaaatgccgaaatagtacattaaggtcaaaatttggagtaggaaaaaaaaaccttcctcattcattggagagctctctttgggttttccgaaaaggtatcacatgccaagtttggcctcacggtctaaaagttataaagtcatacatttttaacaaaaaaaaaaagagaaaaaccgaaaaaaagagttatgcaacacgaggactttcctggaggtcacccgtcctagtactactctcgcccaaacacgcttaactacggtgttctgataggatcaagtgcattagtgctggtatgatcgcatcagttactacatgcaatgcaatcatatatattcttttttgaagacttcatgatccatttgccgtaggtcccaccagctatgtaggaataccctatcttgtttataagagctttgatacatgcaaaatattcgaaaacaatgtccgaacatataatttttgtcccgtaatatagcaaagatcacgaaaaggccagaaaaaataaatttcggtcaaaatttagagtagaaaaaaaccccttcctcattcattggacaactctctttgggctttccgaaaaggtatcacatgccaagtttggcctcacggtctaaaagttatagagtcatacatttttcacaaaaaaaagaagagaaaaaccaaaaaaaagagtgatgaaacacgaggactttcctggaggtcacccatcctagtactactctcgcccaagcacgcttaacggcggtgttctgataggatcaattacatttgtgctggtatgatcgcatcagttactacatgcaatgcgatcatatatattcttttttgaagactttacaatccatttgtcgtaggtcccaccagctatgtaggaatcccctatcttgtttataagagctttgatacatgcaaaatattcgaaaacaatgttcgaacatataatttttcgccccgtaatatagcaaagatcacgaaaaggccagaaaaagtacatttaggtcaaaatttggagtagaaaaaacccccccttcctcattcattggagagctctctttgggctttccggaaaggtatcacatgccaagtttggcctcacggtctaaaccttatagactcatacatttttaacaaaaaaaagaagagaaaaaacgaaaaaaagaaggatacaacacgaggactttccgagaggttacccatcttcgtactactctcgcacaagtacgcttaactgcggagttctgatgggatctggtgcattagtgctggtatgatcgcatctgttattacatgcaatgcaatcgtatctattcttttttcaagactttatgatccatttgccgtgggtcccaccagctacgtaggaataccctatcttgtttataagagctttgatacatgcaaaatattcgaaaacaatgtccgaacatataattttcgtcccgtaatatagcaaagatcacaaaaaggccagaaagagtacatttacgtcaaaatttggatagaaaaaaaacaaatagaagaattccattttgacttcctcattcatcggaaagctctctttgggctttccgaaaaggtatcacatgccaagtttggaatcacggtttaaaagttatagagtcatacatttttaacaaaaaataaagagaaaacccgaaaaatgagggatgcaacacgaggacttttcgggaggtcacccatcgtagtactactctcgcccaagcacgcttaactgtagagttctgatgggatccggttcattattgctggtatgatcgcatccgttactacatgcaatgcaatcgtatctattcttttttgaagactttatgatccatttgccgtgggtcccaccagctatgttggaataccctatcttgtttataagagctttgttacatgcaaaatattcgaaaacaatgtccgaacatataatatttgccccgtaatatagcaaagatcacgaaaaggccagaaaacctatattaagttcaaaatttggagtagaaaaaaaccaatagaagaattccattttccttcctcactcatcggagagctctctttggggctttccgaaaaggtatcacatgcaaagtttggcctcacaggctaaaagttatagagtcgtacatttttaacaaaaaaaaaaagagaaaagccgaaaaaaagaaggatgcaacacaaggactttccgggaggtcagccatcctaatattactctcgcccaagcacgcttaactgtagagttctgatgggatccggtgcattagtgctggtatgatcgcatctgttactacatgcaatgcaatcgtatctattctttttttaagactttatgatccatttaccgtgggtcccaccagctacgtaggaataacctatcttatttataagagctttgatacatgcaaaatattcgaaaacaatgtccgaacatataattttcgtcccgtaatatagcaaagatcacaaaaaggccagaaagagtacattaaggtcaaaattttggagtagaaaaaaaaacccttcctcattcattaaagagctctctttggcatttccgaaaaggtgtcacatgccaagttcggcctcacggtctaaaagttatagagtcatacattgttaacaaaaaaaaagagaaaaaccgattaaaagagttatgcaacacaaggactttcctggaggtcacccgtcctagtactactctcgcccaagcacgcttaaatgcggagttctgatgggatccggtccatgagtggtggtatgatcacatccgttactacatgcaatgcaatcgtatctattattttttgaagactttatgatccatttgccgtgggtcccaccagctatgtaggaataccctatcttgtttataagagctttgatacatccaaaatattcgaaaacaatgttggaacgtataagtttcgctcagtaatatagcaaagatcacgaaaaggccacaaaaagtacattaaggtaaaaatttagagtaggaaaaaaaaacaataggagaattccatgttccttcctcaatcatcggagagctctctttgggctttccaaaaaggtatcacatgccaagtttggcctcacggtctaaaagttatagagtcatacatttttaacaaaaaaaaatagagaaaaaccaaaaaaaagagggatgcaacacgaagactttcctggaggtcacccatcctagtactactctcgcccaagcacgcttaactgcggtgttctgataggatcaagtgcattagtgctggtaggatcgcattcgttactacatgcaatgcaattatatatattcttttttgaagactttatgatccatttgcggtaggtcccaccagctatgtaggaataccctatcttgcttataagagttttgatacatgcaaaaatattcgaaaacaatgtccgaacatataatttttgtcccgtaatataacaaagatcacgaaaaggccaaaaatagtacatttcggtcaaaacatggagcagaaaaaaaaccccttcctcattcatcggagagctctcattgggctttccgaaaagatatcacatgcaaagtttggcctcacggtttaaaagttatagagtcaaatatttttaacaaaaaaaagagagaaaaaccgaaaacaaagagggatgcaacacgaggactttccggaaggtcacccatcctagtactactctagcccaagcacgcttaaccgcggagttctgataggatccggtgcattagtgctggtatgatcgcatcagttactacatgcaatgcaatcatatatattttttttgaagactttatgatccatttgccgtgggtcccaccagctatgtaggaatacctatcttgtttataagagctttgatacatgcaaaatatttgaaaacaatgtccgaacgtataatcttcgtcccgtaatatagcaaagatcacgaaaaggccagaaaaagtacattaaggtcaaaattttgactagaaaaaaaaaacaatagaaaaattccattgtccttcctcattcatcggagagttctctttgggctttccgaaaaggtatcacatgccaagtttggcctcacggtctaaaacttatagaatcatacattcttaacaaaaaaaaaaaaaaaaccgaaaaaaagaagaatgcaacacaaggactttccaggaggtcaaccatcctagtagtactctcgcccaatcacgcttaactgcagagttctgatgggatccggtgcattagtgctggtatgatcgcatctgttactacatgcaatgcaatcgtatctattcttttttgaagactttatgatccatttgccgtgggtcccaccagctatgtaggaataccttatcttgtttataagagctttgatacatgcaaaatattcgaatacaatgtctgaacgtataactttcgcnccgtaatatagcgaagatcacgaaaaggcccgaaaaagtacattaaggtcaaaatttcgagtagaaataaaaaccaatagaagaattccaatttccttcctcattcattggagagctctctttgggctttccgaaaaggtatcacatgcgaagtttcgcctcacaatctaaaagttatatagtcatacatttttaacaaaacaaatagagaaaaaccgaaaaaaagaatgatacaacacaacgactttcccggaggtcacccatcctaatactattctcgcccaagcaagcttaactgcagagtattgatgggatctgatgcataagtgctgatatgatcgcatccgttactacatgcaaatgcaatcgtatctattcgtttttgaagactttatgatccatttgccgtgggtcccaccagctatgtaggaataccctatcttgtttataagagctttgatacatgcaaaaaattggaaaacaatgtctgaacatataatttttgtcccgtaatatagcaaagatcacgaaaaggatagaaaaagtacattaaggtcaaaattttgagtagaaaaaaaatcaatagaaggattccaatttccttgctcattcatatagctct

SEQ ID NO: 191 - DNA, 94618 bp, Arabidopsis thaliana
gaattccacaaagctctcaaatcacacaatagaccaaggttttgaattaagctaagtaagatagtaatgaaaataaaaagaaacaaaaggaagcaatagcagattgtgactttgtgaggttgtaagacaagaaagtaaaaacgttaggcttagggtattctcaggaaacaattggtttgtagatctaataatagctaggttgttatcgaaccattcttaaactcaaactctaattatagaataaccagtggtgttccgtgaaactccctatgcctatagctaagaataaccggagaagccgagagatctttaacctaaacatgcattctaaacgggttcaattgttcaccttagaagataggccgattcttattacacacctataaaccaggctcatcaaataatagatccaactaaagatacctatggtgggcataaaaatggtttggattcaagttctaggtgatcaatgtagatctagcatttagaacaattaaagataaagaattctacagataacctaacaaagggggatctactaaacaatatgaatccctaatgagaaaccctacacctaacaagtggattactcagacatgatcaaagaaacacaaatcatagtatgaataagaaatcaataataacaagagaaagagtaaagaagatcttctccaaagggagtctccatagggttttgctcccaaagtacaaaagagatgaggaaaatagtctctacaagcttaggtctaaacaatgacctttaaaactatatatatgacctaaaaagtgatgggccttctttagaaataaaagaaagttctgggccaaatttagaaatcttcaaaacatcaataagttgcgtcttcgaattgccgtcaggtattggtgtcactcaacaccaggggtggtgtcgttcaacacctacgtgcattttagtttccggatttcttcagcagtataaattctctgttttcctccagaatgctccattatctcctaatgaatcccaaacatgtaaagacctgaaaacgactagaaaagactctaaaacctatacctaaatcatagttaaaaacagtaaaaatagggatatattaactccccagacttagcttttgcttgccctcaagcaaaacacaaaagccgaacctgtggaagaggttttaaaacacaggaactcccaacattctctagcttattgccttgataatcctaaccaaattcgtctagcagttctaatcaaatcctaaccaacatgtatttctctgcaaggttacacaacattctagattccatacctaagttctattactatatctaccacgctttcatcgatgggtctcatcaaacaagctaacattcaaaatccttctagactcattcttgtactataccatgataaatcgaccattatttatatatttttttctttggtgttctttctcttcccagacttattctttttagagagtaaacaaaggggaactcgcatagtagatcgacactctcggcatttttcgaacctttgtaattgatcattctagataatgtataataatagggtcatagaaaacattcctacccctatacactatctgaaaatcctgtcaatctctcattttctttctctttttataatggaagaggaacacattctttttatcacattggtctcaatatcaggtatgaacaagaagtcaagatctatgaatactaactgtttgaagaggtaaaaggaagagcagtgagattaactccagccttagtggttgtgttggaaactaggatatcctcaagtctgttggtttgccatctagattttccaatagtcggattgagtcaaacttgcagcattaatcaaccagacaataatctaaagaatagagatcataattcctatcaaaattttgactcaataaaacgactcaaaaagaaaaataaaaataagaataagactcaagaaagaaaaacatagtaagtaagcgcctcccccagacttaaacgacagtgtccctagtggcattcaaatcacgagtaagcgagaaaaagaaaaaaaaaacagaaaataaaagaaaaataaagaaaaataaaccatactagtgggttgccttccactaagcacttgtttatagtcaatagcttgactttgatggagtatggggatcaggtggatcagatggtggcagcaaatatcgcggagaaggacctctcatcatccatgttggcatataagcagttagcacgtgaagtttatctaggaagagaggagcatcagcagggtgggactcatgtatgggtggaatactcctttttcctgcacaatcatgaaaagaaagaacaagagctcaacgagaaactcgtggcttgcttaaccgtaaaatagtatttgaaaattttaaggtcttattgataaaatcaggaggtttaggaggaggagatgagtaacttagccgtttaggaggtggatgaagtatgagaggtgcagtgggtgacgtgacagtagaacctggacttatagctgtgatcccagatggaaaaatagctatcggagatgattctgctttaaccagtgatgggtgtcgatcgacactagtagttgtgtcgatcgatacacgtgcaacaactcgtcttcccttagcctatcgacaagtcagctttgaaatctgttctaagacgataattgtcttccttttgtctccctgattctgtggagccttgcaacgcccctcctgaatcccttgcatatactgttgaggcgatggacaaagaattccaggcgtgtagactagttcatcaacatgtggaaagtcaaggctaagtggtgcagtttgcgtccaatatcgatcgacactaggtgagtgtcggtcgacactactatatggtattgatcctgctctgccaatctcgattgattctgctccatcaagcgtcgacacttcctgaggttggtactgatgtcgatcgacacccaggtagtgtcggtcgacactatcaatgtgtgtcgagcgactctagagatcagtgtcgagcctggtcgattttgcttcgtcacagcttgatgtctcgtatatatgccatggtgtcgatcgacactatctcttcaacttcaaaatcgccactctcgtcaatcttcactaactcatactcactttccattgaagcagcatgccaagatgtagtgaggctcctcttattccatctagagataggtttctctaagatcctctgttgaccttccagaatctgttccagcaatgattctatcttgcttctaggtgctggtggagtggggcttggtaagaagcaagatcatagttccttgtgaagctgaaactattgctattctgaagtggttgctggaactgagaattctcagtgtagctggttggaccattcccataggaaactctgtagccttgttggtgatcaaatctctgattcggaaaatctctgctacgaacataatcgacatcctccgtaagtttattgtagaccgcgttaagcttagccatgatccctgcaatcttattctcgttcatgtttctcgtttggtcttggttctatgattagacaaacacctgaaacacacaagaaaaagaaaagagaaaaactaagtaaaatcaaaaaagaaaccaaaaataaaagcttagacaaaatcctaatcctaatctaatggtgaatcatagagaacttcggcaacggcgccaactttgatatatatcaaattgccttaagaccactctctcaaataagagatcgattgtagcacttaagggtcgaattctacaaagctctcaaatcacacaatagaccaaggttttgaattaagataagtaagatagtaatgaaaataaaaagaaacaaaaggaagcaatagcagattgtgactttgtgaggttgtaagacaagaaagtaaaaacgttaggcttagggtattctcaggaaacaattggtttgtagatctaataatagctaggttgttatctaactattcttaaattccaactctaattatggaataaccagtggtgttccgggaaactccctatgcctatagctaagaaaaaccggagaagccgagagagctttaacctaaacatgcattctaaaaaagttcaattgttcaccttagtagataggccgattcttattacacacctataaactaggctcatcaaataatagatccaactacagatacctatggtgggcataaaaatggtctggattcaagttctaggtgatcaatctagatctagtattaagaacaattaaagatgaagaattctacagataacctaacaaagggggatctactaaacaatatgaatccctaatgagaaaccctacacctaacaagtggataactcagacatgatcaaagaaacacaaatcacagtctgaataagaaatcaataatagcaagagaaagagtaaagaagatcttttccaaagacagtctccacatggttttacgccctaagtacaaaagagatgagcagaatagtctctccaagcttaggtctaaacaatgacctttaaaactatatatatgacctaaaatacgtgatgtgccgtctttagaaataagagaaagttttgggccgcatttgaaaatcttcaaaacatcaataagttgcgtcttcgaattgccgtcaggtattggtgtcgctcgacaacaggggtggtgcctttcgacacctacgtgtattttagtttccggatttcttcagcagtataaattctctgttttcctacagaatgctctattatctccaaataaatcccaaacatgtaaagacctgaaaatgacaagaaaagactctagaaataacatatagactcgaaaagctatacctaaatcatagttaaaacagtaaaaatagggatatattgactagcattaagaacaaccaaagatgaagaatcctacagataacctagcaaggagaactctactaaatcatttatatccataatgagaaaccctaaacctaacaagaagactactcaaacatgatcatagaagaacaaaacatgtttgagtaagaaatcaataatgaatataagaagagaatagagtaagaaatatcttctctaaagggagtctccacaaggttttgctcccaagtacaaaaaaaagaggagaatagcctctccaaagcttaggtataaacaatgacctttaaaactatatatatatatatatatatatatatatatatatatatatatatatatatatatataacctaaaacgtgatgggtcttctttagatataaggaaaaattctggaccaaatttggaaatcttcaaaacttcaataagttgcatctttgaattgccatcaggtattggtgtcgctcgacactagaggtggtgttgttcgacacctacgcaatttttactctctgaatttcttccgcagcataaattctctgttttcctcgagaatgctccattatctccaaatgaatcctaaacatgtaaagacatgaaaagaactaacaaagactctagaaataacaaatagactctaaaactaatacctaaatcatagctaaaaccagtaaaaaatagggatatatcaactccaatacttagcttttgcttgtcctcaagcaaaacaaaaaagccaaacccgtggaagaggtttgaaaacacaggaactcccaacattctctagcctattgccttgatcatcctaacaaaatccatatgcctagcagttctattcaaatcataaccaacatgtacttttgtgcaagcttacacaacattctagattccatacctatgttctgaaactatatccaccaggctttcatcgatgggtctcatcaaggaaatcgatcattctttatatttttcttttggcattctttctctcccccatacttattatttttaaattataaacaaaggggaactagcatactgcattgacaccctcgacatatttccaacctttgtaattgattattcctaataatgtataataatggggtcataggaaacattcctacccctatacactaccgaaaatcatatcaatttcttgtttttgtttttttataagtggagaggaatacttttctttttttacattggtctcaatatcaattataaataaagaatcaagttctataaacagtaaccgttttgatgagctaaaaggaagagtagtgagattagctctagcctaaatggattgtgttggaaaccaggatatcttcaagtctgttggtttgccatctgaattttccaatagtcggattgagtcgaacctacaacattaatcaaccaggaaataatcgaaagaataaagatcataatttcaaacaaaattttgactcaataaaacgactcaaaaagaagtaaaataagagtaagaataaaactcaaaaagaaaaacgtagttagtaagcgcctcccacagagttaaatgtcactgtccccagtggcattcaaatccgaagtatgcgagaaaaataaaagaaaaacgtaaaataaaagaaaaagaaaaaaaaaaccataccagtgggttacctctcactaagcgcttgtttagagtcaatagcttgactatgatggagtttgggaatcaggtggatcagatggtggaagtaaatcgtagaacctcgcatcatccaaggtggcgtataagcagtcggtgtgtgaggtctaccaaggaagtgtggaacatcagcaaggcaggacaaaggtatgggtggtctactccttttacctgcacaattatcaaaagcaagaaaaagcgctcgacgaaaaactcgtggcttgcacgctttaccataaaacagtttttggaaatttcaaagtcttattgatgatatctggaggtttaggaggaggagatgagtacctttgctgtttcggaggtggatcaaggagtaagggtgcagtggttgacgtgactgtaatgcctggagtatcagcagtaatttcaacacgaaaacaagctctaataaggaactctatctcagcctgtgtggggtgtcgatcgacatccccaatgtgattaataaataatagataaactccaagcaagctttttattgcttctcaaagctttgatggtgtagccaaagtctgtatgagtttttggctttgtatcttctaacaaggaaacactactttagcttttgggaaccgattgcggttctacttcttatactcaatcatacacatgaaatcttgtcacatttgactccaaaacactaactaagcttcttattgcttctgaaagctttgatggtgtagacggagtccgtataagtctttggatttgcatcttttaacaagttaacactactttaacttgtaggaccggttgcggttctagttcttatactctatcataaacatgacatctagtcatatttgactccaaaacactaacaaaccttcttattgtttctcaaaggtttgatggtttagccgatgtccgtatgagtctttgcctttgtatcttctaaaaaggaaacactactttagcttttgggaaccgattgcggttctacttcttatacttaatcatacacatgacatctagtcatatttgactccaaaacagtaaccaagcttcttattgcttctcaaagctttgatagtgtagccgaagtctgtatgagtctttggctttgtattttctaataaagaaatactgctttagcttttgcgaaccagttgtggttctagttcttatactcaatcagaaacatgacatctagtcatatttgactccaaaacacttaccaattttcttattgtatctcaaaggtttgatggtttagccgatgtccgtatgagtcattggctttgtatcttctaacaaggaaacactactttagcttctgggaaccgttgccactacaacaaatgttgtcatgattagcacggaaaatttgctagtatacacataacatagcgaattcacaaatgctatgacatcgacaatcatcataggggtaacccatataatagtcttattttaacagctacaaaattgactaattctataacgaacctacaacgctattacatattctcatatagcaccacatgtgttgctatcgtatgacatgataacatagctcttctatattgtagtaatatatatttgtgtagcgtgatatttgttgctatcatacatgtttatactataggtcttgaaaaaatgttatgtattatttaattctgacatttacatatgctatactacaatatttgacaactaatattttagtgctatgatagaactagatatgctatgatagaactatagatcaattctttttttgctattgtatgtattttcatatagctattatatgtgttttcttgttttctgatacaaattaataaagccatacaatcctgaacatatagaaataaaaatcatctcacataaagtctgattccaaatctataagagtaaaagtttacataatcattctaatccaaaataacgtaacacaaattctaatccaaaataacataacacaatttctaacccaaaataacataatacaaggggaaagttattagggtgacccatatttcattcataataaccaaaaaggaatgctaaaaatatgagttatatgggtaataattatgtctaaaatgtccttattttcctttacagaaaaacaatattacagaaatgccatgactatttgattccagcatggtaataaaactacatttaaatacgaaactgccatcgtcgtttttgctaaatctatggctcttgttgtgacagatttgttttcgatcacagattttttggtcaaccacagattttttacaacatacttgttttgtaccacagactttacttgattaagttacgacagatttttattttttcgtagatttgtttatcgtgacagatttgtttcatatagtctccacagatttttctaaaatttcaaaatttagaatgttgaaaccaaatctgtcactgatttattttccataccgcaaatttttctttatggtggcagcagattttctatttgtaaccaaaaatctgttgtgttataacagatttgttaacccggaaaaatgttttatagtcatgacagagttggtttgtgtaatcacagatttaattaacttgttaacaaatctggtgttttacaacaaacttttgttaaaaaataaaattactagacagtcatatagtgataacagatttgtgtttagtgatgactgttttgtttttcagtgtcaaagcataacagatttactcatgtcaatgttatggccgatttgtttatgactagaataacctttttagtaataacagattttttgttggcagatttgcttttaaaatttcgaaattttttgttacatgagatttatttgctagccctcaagtaataacagacttttattagcgtttacaaatttttacaaaatattgtcatatttgacgtttaatgcattacatatccaattacgagtcaagcttggaaacagctaacaagctactctctctgatcctaataatatcatttgccgtcgtacaagacaaagacttgcaaacgtcacgacgcttagaagaatgtttaatacaaacacaacttctaacttaataattcagataataaaacttaattaaattcaacagtttgatgttagttttaatgagcttgttggtccgtttccggagattgttggtggtatggtggaagttgggcagttgaatgttgctcataatttgttatctgggaagattccggcgtcaacttccaaagcttgagaatttcacttatagttatagtttcgattagaaatcaaagaagaaggagaatgcaaggaagaaggttaaataagaactgaatcgagaaaataaaacgtaatgagagtttacttgttttgttttgttatttttatatttgtttatttattttaattaataatttgttttttttgttgttttttgttaaaagtatggtttttttattgattaaggttaattagtcttttaacttaaaatatgagtcattatagttaaccatcaattgagagagtcataatagttatttatgttaagattagagttagtctgagcaaatctttctaataggattcataagttgttgattagcttaattagttttaaacttaattaaaactagctaacatggaacaaagttacttcattccccctccaagaagcaatattatatcagatttgtgatatcagcaacagatcgattagaaagcacaagcaaaaccatatacataccttagtttcttaaactgatcaaaagatgaccaacttatccattggccatactcgatttcatctgatggcctccaaaccgctgcgtcatctttcttcactatatcaaccatactctagctgcatgtgaacccaagcgaacacattggaccttaacttctaggtcgagtgaatgcacacgtccttcagcgacaacttgcttccttccactaatatccatcaacttgcattttttattttctttgatgacctaagctcccattttacgctgtcatgattataatacaagtcagagagatataaaaatcagaatcacctgcataagtatactataaaagacttaccggagatctttgaggaggggatattagcatagatcgctgacttttcttgacaggagattttggaccagatgatttctgacttactacagcagatttttgacttgtttccaaagatttttgagctgatgctgtagattttccttctgaagattgctgagttgatgcagctttctaaataggagattcctgacctgttgcatcttttgtgttttcaaagacaactttgttcacaggccatgatacaaaagataatagacaatcctcaaggtatgttacatcaatagtaggtgtccagataaatgtatcaggttgatgtaccacatctacaaatatcttcactgcatttggtctgagaggtatcccatttactaaggtatcacgatcttgtgtctgccaacgtctttcagcaacatccacgtcatctgaagacaaatccagtagcttgcatttgttcatcgctgaataagtcctttggctttgtcaaacacattcatagaacatgttaatacttccatatatacattattatactcatgaagatgaatcataaactttacctcttctgcaatgtctcctggttgttgctcatatattaggttaacatacttagaggcaggccacgcaatcatcttaccgataacagattcaattgtgcatatgttaagcacaggtctccaaagatatgtgtctggtaccatagcagtgtcaaccaacactttgacatcagatgggcctaaccgacaatcattcactaagtcatctggatcagaagttattatacgcccctcaacaacagttgcatcaccattaccagtccaatcaatcaagatacacttaggttgtgatcttttgttaacgctctataaaattaataaagactaattactaaggcattcctcaaacaaataaaacatggatttgatatcaattacaaacttactctagcagctgagtttgaagcagcatcaggctattgtctctgttacaaaaataaaccaaagtcaaatctagtgttataatgcatcaagttaaagtataattaaagaagtgtctaacttggttctttattttgtcaattacatcttgtaactcattgacctttaactggagatgagcttgctttgcttccgtttcagccatacacttgtttttcatttggaaacatgctaatttggtcttattcatgtttcgacccattgccctcattcgaccaggattgtcaggtccaagtagttggctaagtgaatcttggccttcaaaacaagcagatgatggcgtatcacttttgacaatctctgatgcctctctctatcaagtacaagatacggattcacatgttatgatctaattctagcaatgaaaataatagtacaagatcttgtaactcacaatcttttcagccgcattttatttcactagtgtaccatcttttctagtacgtgacttgatccacacctgaagccttgacatttaactgggatttggactctcctttttctaattcagaccaaaaaaagtttacaaatagctagtaagtattcaaaagtagtgactgagtttaaacatgtaacataattgtagtatgattaccatatcttctgctagtctaaccattcctctacggctagtggtgtgaggaatctgtttgctccttatagtaaataaacttagttaattacaaatgattaccttaaactctttgctagttttgagcttgactagcttacgccactcaaatggagaaacattcttaggtcgcagcttcatcctcaattggttagtctaggcttttactagccgagatttccaagaccatgaagaaaagcaatcacgtatatatcatcatcacatggttctcatatcctggcaacatttcgatattgatataatattccgttagccaacaagaatctcaatatcttacattataccctaacatctacgtttgatttgaaactgactttgagatggttacgtatgcttcaagcactacaacaaatatggacattcttatcacgagaaaaatgctataatatgtctttaatagcttttcatgaacgctattttaggacactgttattatcaggagcggacccacaacaagagagggttgggcacgtgccctacactctttaaaaaaaaataaaaattcctttatataattaattcatttgctggaatatctgttgggcctaacgtgaagtaccctactctaatgttcaactcaattcaattaaaacaaatataatattttagcccaaaataattaaacaaaaaagcccataaaaatatggctctgccctaaaaaaagaagtcataacctagcttttgtgattaaacttcacgagggaaacattattgacattgatacacctagctttttttctttcgtcaattaaattttaaaaaattattctctttattggtttcttctcaatttggaatcattcagtcgcaaatgtctaaagtaagtaattttagtgattattttatgattgattaatactaaaattgtagtagatgattcaaatcattcgtatgtttttttttgtaattagatcaaaatttctaatctaaatttggtttctaatatatttattagggaggaattcatagatattacaaaagaaagttggaaccaacgcctgaagaaaatttggaagatttgctttcagaccctgcagataggaaaaaaccttcggactatcatccaaatgaaagagataaggtaagacgcaaatatctgattaaaggtccttgtcaacctcgcgggcatgattttcctaaaacactatcaggaaaaaaattgagacgattcaatctagagtggtttgatctctatggcaattggttggaatacagtgtgaaaaaagacaaagcttgttgtttggtttgctacttgtttaaagattacacagaaaataaaggtgaaagtgatacgtttgtgacgaaaggtttcgatacttggaaaaatcctcagagtttacgtgagcacgtgggattggtgaataactttcacaacaatgcattaaaaagggctgattgtttgatgaggccaggtcaatcaattgttcatgcttttcataagcaagatgaaatagtcaaaaatgaatacagaatcagattgaatgcttcaattgattgttgtagatatttagtacgacaaagattaccttttcgaggtcacgatgagtcagatgaatcagctaataggggaaatttcttagagcttgtgaaatatacagtagggcagaatgaggttataagcaaagttgtgttggagaatgctccaaaaaacaatcagatggtatgtcccaaaattcagaaagacatcgtacattgctttgcggaggaagttattgaatctataattcaagaagttgatcatgatgtatattgcttgttggtggatgataagtgtgtattttgcatgttttgagcatccatttttcatcattttagcattatattatcactgttttataccattcacatcatttgtcatcactttgcatgtttaggatagttttgcatgcatgttgcatatttgtgttgttttcaggtgatttggagctgtccacgagctaactggaagaagcggacctgatcatgacaaaccactcgacccagaggtcgagtaggagcttcaagatctcaagagaccactcgacccccaggccaagtagaagacaaaaccactcgaccacatcactcgacccccaggtcgagtgacttcctctccatcttctgacaaccactcgatcacgtcactcgatcacgtcactccagctactcactcgacctcccactcgaccacatgggtcgagtacagttcttaatccgtcccaatacttcgtcgttttgagtattagggtttcagaatatttggctataagtagcatgtacttcacattttcgcaaacaagaagtttttatctagttttattccgcagaccttgtgttctagaccttttgtaatccggatttctctttatctattcagtattcagtattcagcttttgttcttgatttcgtttactgttgttcattctattatcatcctgctgttacactgttgttatcatgttttcaacctgttcaacgtttatgcttactgttatgatgtctgagtagtgaataggtttctgaggatgggttagagtagtgtagaattctaagtatgctaggtgattgagtatttgttgatagatcccttctgaattagttgttcttaatgcctattgctttctgatcaactaaaatttgagcccagacatttccgcgctcaaaaggtgttcgatgaaatgtctgaaccactaattccagagactcgtgaccctgtaccaaggtattggttgcaaagagcgttttggctttaacttgttgattcgtaatgcctgttaggttagctctcgtcaatggtgattgagtctgggactaggttaacttgagagtctctgttgcggtggcacttagatttggttaatgaacttgttgtctaaagttaatttattgagcatgtcaatcacctgtaaactgagaaaacgaaactactcgattaccccatcctcgggaattctttatctgattgaattatttgtttactctattgttgtttactgcatcttgttatctatcgcttaatttctgcagttctttcttgttactcgacctcatactcgactacccagttgtctggcaacagactgtgcagtcgagtatccgtgttttattttctgtctgttactcgatctgtcactcgacctcacccagtgctctgcaaagagctgtgttggtcgagtgtttcactgtttctgtttgattttctgttttctgcatgttcacttaggactgctagaacacaccaaaacctgttattgcttggcttgacttagtgacttctgatcacatcttgattgttagcataacacccatttggattgacaaccttcaatactacaacgacatgatagtgttttaggtttaattgattaaaaacctattatcagtggataaatctgcagatgtttctgataaagaacaaatggcagtggtttttcgttttgttgataaacatgggacggtgaaagaaagattcattggtcttatccatgttaaagaaacatcttctgcatctctgaaatgtgctattgattcattgtttgctaaacgtggattgagtatgaaacagttaagaggacaaggctatgatggagcaaacaatatgaaaggtgaattcaattggttgagatctctgattttaagagagaatagttctgcttattacatccattgttttgctcatcagcttcagttagtggtcgtggcagttgctaaaaaacaatttgaagttggagatttctttgatatgatttctgccttgctaaatgtggttggagcttcttgtaagggaaaagataggattcgagaagaatatctaaaagagatagaggaaggaatcaatcaaggtgaaattaagacaggaaagggattgaatcaagagctttcattacagagacctggtaatactcgttggggtactcattacacaacattacaccgattagctcatttattctctgttatcattaaactgcttgagtttgttgaagaggagggaactgatagtaccaaaagacgacaagctaatggtcttctcaagtactttaatacttttgactttgcgttctacttacagttgatgttgcttcttcttggactcacaaatagtttatcagtggctctacaaaagaaagaccaagacattttgaatcctatgtcactagtgaaatctaccaagcaacaattatgcaagctcagagatgatggatgggattctttggttaatgaagttttttctttttgtaagaagcatgacattgagttggttattatggatggagaatttgttaatccaagaaacccaagaaaaagaagcaacatgaccaacttccatcattatcaagtggagtgtttttacactatattagatatgcaaattcaagagtttaatgatcgtttcgatgaggtaaacactgaattacttagttgtgttgcttctttaagccctattgattcgtttcatgagtttgatcagttgaaagttctgagattgtctgagttttatccacaagattttactcatgtcgatcggagatcactcgagcatcagcttggtctttacattgacaatattcgagaagatgaaagatttgctaattagaaaagtctaggagatcttgctcgcgttatgatcgagacaaagaaatatctttcgtatcctctggtttatcgacttttgaagctagttttgactttacctatagccactgctactgttgaaagatgcttctctgcaatgaagattgtgaagactacattgcgcaaccgtataggtgatcagtttctaaacgattgtctagtttgttttgttgaaagaaaattatttgataaagtgacaaatgagatagtgatcaaaagatttcagagtatggaaaaacgtaggataactttatagactttttttttaagaaactatttttgtattagtattttttatttaattttatttttaattatattgtgcccgaggttaaaataattcttagatccgccactagttattataggtaccccacatacagtagcgtgagtttagtatgctatgttatagttttataacatagctataaagaacagttgtattaccacgtttaattttcttaaaaaaattatatagtatttgatttttcatgctatgttatatatctctaatatagctgttgcgaaatgttattttatcttggtttgccttttttcaattggaaaataattagtcaaattatgtgctatgttatgctcttatatcaatttataagctacgatagatgattaaaacatagcattagtcatatgttaaatattctattacttgtattcttatagcattttctgagatgtgattatagtacacataacctgctttataaaatctcatacattgaccattgattaaacataagtttagatccaaaatacataagaaaagtctcaagcacaaaataaagcaatacatgagctaagtgcataagttcaggtacgtagcattacacaagaaaaccatcagtttaagacataatgaccttgttctctggccaagcaatacaggagttaagtgaatctttcataatctctatctcatctgatggcctccaaacttttacattgcccaccttcacaatatctatccacactttaactgcattaaaacctaagggagtgtggtgaaccttatgtgctggatcatttgttgcccatcgtccttcagccacaactttattctttccagttaaatccatcaacttgcacttcttattctccttggaaataattttgttaatgccctgccatgtttacaatataaaccatcagtcatcataattaacaaaaacaacttcaagtaacatatgaaagcacttactggagacttcctgagaggagactgtgctggtaaagtattccttattggagaacttggacctgttgcatcatcaataggagattcagaaccagatgcagacttagaagacatagctgcagatttggactctgacgcagcctttgaagctgttgctgaagttttggacccgtctgcagacttcgaagttgtggctgcagacttagccttcgatgcagacctagaaacttctgatgtagaattatgaccggttggaaatgagggattttcaaaatcaactttgctcaggggccaggatacaaaagccatcaaacagtcctcaagatatgacatttcagctgtaggtctccatagtgatgtatcaggctgctttactgaatccacaaatactttaactgcttttggtccaagaggaagtccattaaccaatgcacttggttcttgtgtctcccaacgcccctctgcaacaatgacttcagcattcttcaaatccagtagtttacatttgtttccttttagaccctatcaaacacaatcagtaaacaaatccaatacaaataatcagcatgatacacaggggaaatacattgataacacagtgcaacaaatttaaattaccaaaggtgcaatgtcttcaatttggatgtctgtgtctagaagtttacacttatcagctggcaatgcgattatatgtccaacagcttttttcatattaaagatcttgtgtgcaggtctccatagaaatgcatctggttgatatgcagtttcaactaacacttttaggtccgtagggcatagacggcagtcatcactatgtcatcaggatctgaagaaagaatacgaccctcaccaacattttcatcagtctcagaccaatcaacaaacacacacttacgatgtgaatttctgttaacactctgcaaaaaattatgagaaaataagagttataaacttaaataagaagaatcacatagatgatatgaaaagaataaggaatatgttactcttgcagctgagttttcacccatttcagcttctggcctctgtaacataaacaaaactaaagtcaacttatataactctaactggttgatgaatattttaaaactcttaaagtatctaacctgattcttgattctaataatttcatcttccaagtcattgacctgtttttttaatttcacttgcctctcttccatttcagccatacacttgttcttcacttgtaaacaagctaatttagtcttactcatgtctctccccattaccctcagcctaccaggattgttaggtcctaaaagcttggcgaggtgatcttcatctggatttgttgaaaatgttggaggatcatttccaacaatttcagctgcttcttgctggaaaacatgaagacagtgtcaggttttactagtcgaagacacactcaatcaacaactctatttatacttacaatcttttcagctgcattagtatctactggtgtaccatcctttttggtacgagacttgatccaaacctgtagtcttgtcacgctggaaggatctctactttcaagtttctgtacaaaaaacaacatttgagtgactgtcacaacatacaagcaataggcgtagaataataagcaacataaatgaagtagatatcttgccatttcttctgttagtctgacaatccctttacggctagtggtgtgaggtatctgtttctttcttcttgctttatatgtatcactcacagcctaacaatgaaacatgttactaatccccttttaaatacaaaactttatattcacaagtaattaccttgaatgctgcactggttttgagtttgacaaacttttgccactcaacaggattaatattagttggtctcaaattcatcctctcttggttatttgcaaccaaattaataaccttcaccctgcgcgacttgtgtgctctccacatatttcccatctggtttatcacagatatactttgccaatcttcatcaagctcaaaccttgaatgcattcacgaacaatcacaccataattatagaagtaccagatcaattacagtcaacttttttaaaaaactacttgttacctgaacagatttccacataactgttttcagatctcgagtcactttcttccagttaacaatgttgatagggacgtgttccatcactcgatcacatcatctccatcatcagaccaccactcgacctcgtcactcaacctggaagtcgagtatcttctaacaccactcgatcacatcactcgaccccaacgccgagtgacttcatcccattgccagacctctactcgacctcatcactctacctggatgtcgagtatcaccatcaccaccactcgactgcatactcgatgacaagcttcagagccttcttcattccgcactcaaccagacactcgagcacaaggaagaaaagaagactccagctattcacttgacctctcactcgaccacgtgggtcgagtacagttcttaacccatcccaatacttcgtcgttttgagtattagggtttcgggatatttggctataagtagcatgtacttctcattttcgcagacaaaaagtttttatctagttttatttccgcagaccttgtgttctagactttttgtaatccggatttctctttatctattcagtattcagtatttagtttctgttcttgaatttcgtttactgttgttcactctgttatcatcctgctgttacattgttgttatcatgttttcaattcgttcaacgtttatgctttctgttatgatgtctcagtagtgaataggtttctgaggatgggctagagtagtgtagaattctcagtatgctaggtgattgagtattggttgatggatcccttctggattagttgttcttaatgcctattgctttctgatcaactggaatttgagcccagacatttccgcgcccaaaaggtgttcgatgaaatgtctgaaccactaattccagagattcgtgaccctgtaccaaggtattggttgcagggagcgttttggatttaacttgttgattcgtaatgcttgttaggttagctctcgtcaatggtgattgagtctgggactaggttagcttgcgagtctctgttgcggtggcacttagatttggttaatgaacttgttgtctagggttaatttattgagcatgtcaatcacctgtaaaccgaggaaacgaaactactcaattaccccatccttaggaattctttatctgattgattttattgtttactctactgttgtgtactgcatcctgtaatttgttgcttagtttctgcaattctttacttttactcgacctaatactcgaccacccagttgtctggcaacagactgtgcagtcgagtatccctgttagattatctgtctgttactcgacctgtcactcgaccacacccagtgctctacacagagctgtgttggtcgagtgttttgctgtttatattatagtattattcggcatttactatatagctaaatatttatatgaataagactaatgttattaagttactatcataaagttcaaaattaagtagtgattaacgaacctttctcatactcaatagcttgctacataaagctctacaaacaacaaaatcacaaaatcaatctattaaattcgtcgcacaaacactgataaatattctatatagcaaaacatctctagagctatgcataagaaataccttggtatatgagaattctgagggatcatttggactgaggcaaattgtggttgtggtaattcttattttaatatctgtccagcttcaccttcgccatcctgtttcatagattgacaatagtgacattagattcttatactaagaaacaatgcttaagaataaagattaaaatgaaaaatattaaaaattattcaaatgaatgtataagaagagtgatagacttacttggtttgttgaattgatggagagaaaaagagaaacaactttcatcaaactcgatacatatgtgtgattttttgagttaagcatgacttgttgaaccctgtaaaaaaaaaatacacatgcaaacataaattagttcaattttaataagagactttgacaaatagaaaatatgtatgaatgctaaacgttattgcttaaactaacattcatcccattatcataaaaagtttcttatgagttggtgcacttttagtcttctgtcgtaaggttatttatagagttccttgttgatgatagaattaggtgtgatatggaatcgagtaaaaatcggtaagcaagcaaacatattttggaaaatatgacgattataaataataataaaagatctagtatttaggtaaggaatatacctttaaattctcatttaagtgtactaattagtttctaaatttttttgagtctatgtataactgtcataataaatctggatttgaattcgatataattattacattagcataaaatagtcatgttgttatcgtaatcaagggaaatcttaccaagtttatacagcatggatcatgtatattctcgattttttgtataacaaaatatagaaaatccagattaattatagaattttttatgatatgttaccgcgtaatgcttcttcccttatctactaaatataaatattaattaccattatttgattacgatattttcagttagtagttcatatttagtagatatgatcgagattataaatattaatagtatttaattttgaagatttgatttccatatgttaggatctcaaatctcgtcgtatgggattaaatcagatatggttagttatttggttgttcgaatttttagggaatattatgtcgtgtaatattgaattagtagagatttaagggattaatgtgtgcaatttatgagggtagtgcaaaataatatttttgtttaggtaagtaattagtgcaaaatgtgaatagttgatcaaaaatttggtcattgtcctaaagaagacaatcttctctgattgattttgtagggactaaacatacaatatcgaaattgaaaaaggatttttcgacacaaatcttccccaaaaaagtatatgtagataaaatgggaaaatatttgttcgaaactccaaatccatctgaaatagttttgcaagaaaaaaaaagagagaatatttattttacgtttgaccatattttacggggggaaatatcaaaaaaaataccaactttcaaatttgggacgatttaatcttgaacttcacacaataaaaataaatcgtaaagtttttgttgactttctaaataaatgacaaagtttttgttgacttgctgtgagttctgaaatccacactagagatttgattttaagattatgagaaaggacggctagatcttcactgaaaccttgagagttatattgctaagaacgaatggacttttgtattgattttgacaaagcttttacaatgagaaaagatattacaagtgtaaaagtgtgtgtgtgtgaatgtaagctagattcaatgtgtcttcctagtcgtcctagctcccttatataagtctacgcacgtggtagctccgtccgggatctgcggagatcctcctggatattcggcaggtcagttccgagatatcaggtccgctccgcgaatatctcctcgtcagttcctaggtcattattcgcttatctctcttcatcaggtgactgggcttatctggcccaaatacccattcgcgtatgtgggctcgtcagctgcgtaggtcctctacttagtgggcttggtgggcttttgtgggctggcttggtattttcgcaggtggattcctggaggggaatccaactccaacatttgccccccagcccattgaatgagtaggtgaactcgatgagcggacatataggtcaggtaagattgcgaaaatattcttgacgagaggataaatatggttagatcagtcggttttgaggataaactcaacaatttcgttttattttcagattcctttaaccaaaagatttcaaggagatacgcgagataagtcgctgctaatgtggacggccgagatggagcgtcagttcagcgcaccgcatctgacggtccagatcaggcgcagagaagagatttccgcaatctcgaaaatcgtggtgatgatggctttaaataacttcccacctctacacttgacgtcacgtcaactcacacaactctcaaggtaacttctctcctcctttattatttactgcgctttgttttgtagaagtagaaaaatctcgtttttatttttgctatctccttcgtttctctgctattccctccttctcgatctgccttctttgctttttactttcatctctctcgtccttctccgtcaaaacccaaagatgagagacttcgaagattctaagaacaagagcaaccacagttacggcaatgattcgagttcatccgagacaaggtcgacggcatcaccgccgcaagtacagagacgcgccataaccctaggcggaatgggtccaattcatccgccgtcaacctgagccgacaaacagaagaagaaaaaggctgtcaagcaagggggaggcacgccgatgacgaacgacaacctggtcgacctccggaggagatgccaggttccggtggaggtacatatgatactcccaaggccaccgctgcatcctgagaacgtgccggtcgggtggtgctgcgcctatgccaatttcttcgagaaatgcggcctatttttcgcaattccggcgtgtattctcgagatgctctactgtctcggcctcgcctttccccagatgtgttcgaacttcgtccgccatgtgctcgcgttattcacccgggctcgggaagtaaacagagaattcagctgccatgacctgcttcagctctgccaggtcaagaccaatgctaggagtgaccaagagacgtactacatcagtgcacgtcccagatctctggtcctcggcggtttgaaagcctgtcgagacaccaattggcgatccaagtatttctttttcaaagtagatcgtcattcagttggcaattttgatcccgcgaggataacaaggacctggtctaccaacctgggtcagatggagacctgagcctcttgatttttctttgttgtttgtgttgagtccttgactgcttttgctaatcgttagtactgaaactaattgcttgtttttgatgatttgtagcaaggaccaaggaagttactctcttggagacggaacttgagctgttaacccttctccgacgtggtcagactgactggtccactttcagcagaaatcgcatcgtagctgctcttgccgtagctccagcagttcccgtagctccagcagttcccgcaatcgttccttcagcagcaccgctagatccgatcaaagaggtctcgcggattgaaccagttccccaggctgatctgcctataggtacgagttccgttatatttactttggtttttagaaatgtgcgagttatcgagacagctgcgcaactcgaattgctaactaacaaatgtcgtgctctatttgttcagttcatcctgattccagctccacttcagaactcccgctcatcagaagaatgaggcgcccaagtcttcgtgttcaacgagccaacgtcggggctcctgctcgtgctggtgatctgtcggtcgcggtgaccgcggctcaaaacactctacctttttctagcgcatctgcctcagcatctcatccctcgcttcctgaggtcattgtcgggaccttagctgcagcaggtcaaccggataacaatcaggtcgctcaggtctctgggccatctgttgttcgttctgatggtgcaccgtcctctccaaagagggctcggacccagccggaggtgaatttggcggctgagtaggtcgtgagcgaccagagggtcgcctctcctagagaggagaggatggaacctgcgactgctactccggaggcagctgcgtccgcgataggcgatcctcgagcaggtcccatggcggaggacgacgctccagaggtgggggccggtcttcaaaccggtctcaggaagtgaggcagacgtccaactccagcggaggatccgcgggaagcaggcctttccactggtcttacactcacgaccgttatcaccgaatcgttgaggacgaggctgggttagcgaacctgcttcgccacgtcaaagggaggaactgccagattcctaggtgaagaacatggccgaggcggcggcctatgatgacatgatggcgaaggagggccaagtaattatcgataactttctccttctaatttatatctttttgcttagttgtgactttctgttttgcttttggtaggcgatagctgccacaaacaagctggttgctctctatgagcagcgtctaagccaggtcccctaggcgaatgagcttgaagaaggaaaggccctcatccgggagctgacgtcaagtgtgaaggctggtcaggatctcgaagtcttgttccaggtacacctcggttttgacttgtttataaatagttcgtcgatgatttgatgattctgacctgattgttatttcaggcggagatcgagaggcgcggtgcaagtcgaaggaggtatcagactttactctaagcaagttggatctcccgcaggttttagagatttcggtggtacgtccaatagacgtcgacgagcaaggaacgccaattggcttggatgagttcaggagcaataaagatgcgtttacgggaggtctcgcggagggttctggtactgtctttgctacgccagccgaagaatcgagggagtgatcactttcgctccttgtttgttttaggatttcgtgttttgtttcagacttaatgcctgtgaaggcttttatcctttcgtttattgccttttgaacttggtgcctggaaaggcttttatcctttgttcgtttaagtactcgaatgcttgggaaggcttttatcctttttaacaagtattttttatctttcgttcaagtgttgacacttcgttgattttggtgcgagaccacctcgctttgtcccggtattttcctcgaaggttaatactttgaatgagtttgagttgttttgtcttgggaacctgttgaagtgaggtcacacaagggacctgccagattttgggagctgggcttgtggtatcgccaggtcgcgaatgtaaccttcgtttcttccttgtttactatgttatgcgttgatagcgaaagagttagatttggttgtagtaggtgagctccgatgaagccgtagtgatgtgttcttataagttttagttcactgtcgactttttggaagcgagatcacaaaatggatccgccaacgttcgggtgttgggctttatgtatcataagattacgaatgagttttaaatcatagtgtaaatgattgttttttgcgaaatatgataatgactatcaaaatttccttttattcttatctcgaaattgttaagtacaaaaggaggtaaagcaagcgacgatctggcgtttggtcgtcgagcagggacctgctcgatactgaagggagattgaactgtcaggtgagcagctgatcttcgttgatgagagatgcgatatccgtttcccttgttgaagttttgtcttacaaatagaagggttgagatggtaattgcgttggcggaggtgactgcctgaatacctggttaggggattaagcccttttgatttgattgaattggtggctgcgctcttgggaggagctgcctacgtaccctgccaagggatcaagccttatcgtagttcgattgtttttgagtacctattcgtggtatttcttgagatgcatggcattccaaggccgtaactcaggtactccgttgataacttttacgagcttatagacgccgtcacgtaccaccttggtgattcgatagggaccttcccagttagttcccagttttccagcgtttagctctctcgtgttgctgaacacttttcgtaagacgagctctcccacttcgaatctccgaattttgatattggagttatagtagcgggcggcagcttgttgatagttttgaactcggatcattacctgatctctgcgttcatcgatgaagtccatgttgtcctgtaacatttgcatgttcaggtccgggttagcaggactggcggtccttctcacgcttggtactatggtttcgacagggattactgcttctaaaccataagcgagggagaacagtgtttcttgcattgatttgcgaggtgtagttcggtaggcccagagaactccgtggagcacgtcggaccacattgatttttttgaatcaagtcttttcttgatgttgctaagtatagctttgttggcggcttctgcctgtctgttaccttgtgggtaacgggggggggggggggggggtggatgtggtaagacggatctttcacttgtcgcaaaatgcgttgatttttcccgaggtgaggttagtcccattatcggtgatgatctcataaggtatgccgtgtcggcatacgatgttttcccataggaagtcctcgacttgtttctcggttacctgttggaaggctttagcctcaatccatttggtagaatagtcgatgaggaccagcaggttttttagtctcttcttcccaccggaggcttccatgggacctacgacgtccatcgaccacttcataaatgggtaaggggaagatatcgaggacatttcctcgggaggttgatgaagagtaggtgcgtgtcgttggcatttatcgcacttgagtgaatgagctacgccatcggctagcattgttggccagaagtaaccttgctttttaattctaagggcgagggtacatccactacagtggctaccacattgcccctcgtgcatgcttttcatgagatctttcgttagttgcccataggtacacaccatgtagggacctgcgacgctgcgtttcatcagtctaccttccaggatgcagtaccttgcgctctgggctttgagttttctggtctcccacttgtcgggaggtgtgatccctcgttcgatgtaatcgatgattgggattctccagttattgtacggttcaggttcgtacgaggcaggttgttcgggggttccgagctccggctcttcctccgctgcatctgcctccgcggctgatgcaagggctctagccacggcggtggtgcttcgggttactcatgtaaagttgcaagttgccgaggtttccgtcccagcgtgtttgacccttaggtcgatgctgaggtgttctattccttcaattgggataattcttttgacgaaaggatctgacgtggaggcgagagctgccaaggtatctacagaggtgttttctcctcaggggatcctggtcagttcaaacgactcgaactgttgggtcaaggttttgactagttcgaggtacgcttccatgcgctcgtctttagcttcatattccccgtggaactggctggtgacgagttgggagtcgctatgggcgtgtatatcgcggattcccattccttgagctagcttaatgccagcaatgagggcttcgtactcagactcgttatttgatgcgttgaatctgagtcggaacgattgttcgatgacttccccgataggggaggtgagttgtattcctactctggatccctgtcggttggaggagccatcaacgtggaggagccatttcttattggagttggttccatccaggtccgctaacgggagctcgattacaaagtcggctaggacctgtgctttctggctggttctggtacgatattctatatcatactcacttagttctatagcccattttgcaagtcgacctgattgagtcggactgaatggttctgattggttgagacgtcatcactacgatgggatgtgattgaaaatatggtctcagttttcgagctgacatgactacggccagtgccagtttttccatttctggataacgagtttcggtgtctatcaacgttttactaacataatagatcggtttttgtccttcgtggtcttctctcaccaggacgccgcttatcgcggttcgggagactgccgtgtacaggtacaatgttctccttcttcgggttttgcgagtatgggtggtttggacaggtacgctttcaattgtttgaaggcttgctcgcagtcctcgttccaatcgaactttttatccttttggaggagctgatagaaagggacgcatttatcggtggacctggatatgaacctgttgagtgcggcgatacggccgcttagttgttggacctcccgtgccgtttttggcgatagcatgtcgatgaaggttgcaatctccttaggattggcctcgatgcctctttcggttactaggtatccgaggaattctcctgagggaactccgaaatagcatttctcttaattgcgggacatggtcattttcgcgagctgacttgaccagcatgtcgtcaatatagacctccatcgttttacctagctggtcggtgaacattctgttcaccaatctttgttaagtagctccagcgttttctaaaccaaagggcattactttataacaataggtgcctcggtcagttataaaagctgttttttcttggtaatctgggagcataagtatttggttgtacccggagaatgcatccatgaaggacaatagttcgtgtcccgcagtggcctcaaccagtcggtcgatatgtgggagtgggaaactgtctttaggacatgccttattcatgtccgtaaagtcaatgaatactctccacttcccgtttttctttttaacgacgaccgggttggcgagccagtcagggtattttacttctcttatcgatccgatcttgagcaaccaatcgacctcatcgtgcacagctttagccctctcggtacctagcttgcgacgtttctgctttataggtcggtaggtcggatcgacgttgagttcgtgtgaggttacctcgagccttattcctcggaggttcgcatttgaccaggcaaagctgtctttgttttctttgagaaaggttatgagattctctcgtatcgctgggtagaggtcttgacctatcctaacgcatcgtttgggatctgattcgtctatgcagacctgtgttatcaatgactttcgaggtccgcgttgagaaggatcagaggatctgactgttttcatttccgcgagtttgtcttctatcattagtactacggggtcagcctttttgataaggtcgtagctgcccatatagcattttctggagctgcgttggctgccgtgcacgactattattcccttgtccgaggggaatttaatgcattggtggtaggttgatgggatggctttcatggcgtgtagccatggtcttcccagtattgcgttgaaaggagctttcttgtcgactacgaggaaactcgtgagtcgcctcactcctcgtgcgacggttgggagctggatggttcctagagaaaaggtcgtatctcggcgaacccggtaagtggcgttttcctgccctgcggctcggaatcgaggtgccccattcttttgaaggcgtcataaaagagtacgtcaactgagcttcccgtgtcgatcattatacgggagatttcgtagttgcctacatcgattcgaataacgagagtgtcatcgtgatgtttatcgaggtcggtggttttgctttcccagaatgtgatctggtggtcaggtcccatcatcgggctcttgccttttgtgtaagaatttgccttcctgtgatgagttttgatcgaattgattgagtcgttgcagagctgagaccctcccatgatgaaatgatgcgtttaggggagaggtgctcggttgcgcttctgcagaattttgagaggcgtaatggaaacctcatgtttttcttatacggggcggggggaggtgtggtgactgaccttcctgtcccgccacctagatcgagttctgcaaagactaggtctatgcgttctctcctagcaggtgggggagagtcacttccctccggtgttcgttcccgtttcttttgcttgggagtttgctcctcctcctgttcgtcggaaggaggggtttcaactttggggtttgaaccttttttagtctttcccccagctgcgattaactttttaacggcgcgacactcctccgtggaatgtcctcttttcttgaggcacttgcaatattttccgaggtcaagttctggactctagtcctcagctgcctcgtctattgcgaataaggtatgctgcccctgcgtttggttttcctttttgaagggtttcttaattgcaaggggagcgttttgcgttttagattctttgaatcgtaaggccagcacggcgagctcctcttcggctttggcgaagtggagagctttgtgaagggcatcgtctaaagagactggttgcctaacagtgagttcctcacggaacctagaggagaaccaaaggtcgttacgaagggctgctatggctacctcttcgtttaggtttgcaattttcgatttgatggctttgaatttttcgacgtaagatcgcagggattcgttctgaagttgagtgagactctagaggttggtttcagacgtcctgtgctcgataagtactgaatactgttttaagaaagcggcggcgagctggtcgaaggtatcaatggagttctcttcgaggctagcaaaccattcgagggtcttatagttatattatagtattattcggcatttactatatagctaaatatttatatgaataagactaatgttattaagttactatcataaagttcaaaattaagtagtgattaacgaacctttctcatactcaatagcttgctacataaagctctacaaacaacaaaatcacaaaatcaatccattaaattcgtcgcacaaacactgataaatattctatatagcaaaacatctctagagctatgcataagaaataccttggtatatgaaaattctgaaggatcatttggacagaggcaaattgtggttgtggtaattcttattttaatatctgtccagcttcaccttcgccatcctgtttcatagattgacaatagtgacattagattcttatactaagaaacaatgcttaagaataaagattaaaatgaaaaatattagaaattattcaaatgaatgtataagaagagtgatagacttacttggtttgttgaattgatggagagaaaaagagaaacaactttcatcaaactcgatacatatgtgtgattttttgagttaagcatgacttgttgaaccctgtaaaaaaaaatacacatgcaaacataaattagttcaattttaataagagactttgacaaatagaaaatatgtatgaatgctaaacgttattgcttaaactaacattcatcccattatcataaaaagtttcttatgagttggtgcacttttagtcttctgtcgtaaggttatttatagagttccttgttgatgatagaattaggtgtgatatggaatcgagtaaaaatcggtaagcaagcaaacatattttggaaaatatgacgattataattaagtgatatggtaataataaaagatctagtatttaggtaaggaatatacctttaaattctcatttaagtgtactaattagtttctaaattttcttgagtctatgtataactgtcataataaatctggatttgaattcgatataattattacgttagcattaaatagtcatgttgttatcgtaatcaagggaaatcttaccaagtttgtacagcatggatcatgtatattctcgattttttgtataacaaaatatagaaaatccagattaattatagaatttgttatgatatgttaccgcgtaatgcttcttcccttatctactaaatataaatattaattaccattatttgattacgattattttcagttagtagttcatatttagtagatatgatcgagattataaatattaatagtatttaattttgaatatttgatttccatatgttaggatctcaaatctcgtcgtatgggattaaatcagatatggttagttatttggttgttcgaatttttagggaatattatgtcgtgtaatattgaattagtagagatttaagggattaatgtgtgcaatttatgagggtagtgcaaaataatatttttgtttaggtaagtaattagtgcaaaatgtgaatagttgatcaaaaatttggtcattgtcctaaagaagacaattttgtctgattgattttgtagggactaaacatacaatatcgaaattgaaaaaggatttttcgacacaaatcttccccaaaaacgtatatgtagataaaatgggaaaatatttgttcgaaactccaaatccatctgaaatagttttgcaagaaaaaaaaagagagaatatatattttacgtttgaccatattttacgggggaaaatatcaaaaaaaataccaactttcaaatttgggacgatttaatcttgaacttcacacaataaaaataaatcgtaaagtttttgttgactttctaaataaatgacaaagtttttgttgacttgctgtgggttctgaaatccacactagagatttgtatttaagattatgagaaaggagggatagatcttcactgaaaccttgagagttatattgctaagaacgagtggacttttgtattgattttgacaaagcttttacaatgagaaaagagattacaagtgtaaaagtgtgtgtgtgaatgtaagctagattcaatgtgtcttccaagtcgtcctagctcccttatataggtctacgcacgtggtagctccgtccgggatctgcggagatcctcctggatattcggcaggtcagttccgagatatgaggtccgctctgccaatatctcgtcgtcagttcctaggtcattattcgcttatctcccttcatcaggtgactgggcttatctggcccaaatacccattcgcgtatgtgggctcgtcagctgcgtaggtcctctacttagtgggcttggtgggcttttgtgggctggcttggtattttcgcaggtgcattcctggaggggaatccagctccaacacttgccatttgagtcatgtcgttaaataggttaacaagattttttacgatgttaatgttctgtttatctgctctgttagaacaaaacgatatcgtttattgcagacacacacgacgtcgtttgtctgttgaaacaaatttaaactctaaatccccaagttgattttattatctcaaatccttagaagccgaatcgattcgaatcccatcaggcgaggagacgaacgatgttcctcagcccaaatcaaatcgaaagaagagaaaacgaaagaaagaagttgaagtagatgacgtcgttttgttttaacagagcaaataaacgagacattaacgccgtaaaatatttttgttaacctatttaacgacattactgaaatgccaagtcaacaataactttgtcatttattttgaaacacaacaaaaactttatgatttatttgtctttcatgaagttcaagattaaatcgttccaaatttgaaagttagtaattttttgacatgttttccatattttacgagttaattttacaaatttccatccatgtaatataaatccgtatattttgcgatctttcctattcatatcatgtacgctgtagtctctctagattgacaatcgttataagaaaagaaaaagaaagattaatactctcgcgtctcaatcatacacaacccaagtaaaaataacaaagatacttaagagcatcttcaacggatgaaaatgtaagagtttcttaaaaaacaaaaagtaataatattttaatgttatgattatattttaattttttaatacacacaaaatactaataacgttacacgtgtttttgtgttggtgataaaggctcttagataaggatttttgttcactctctctctctttttttttacagcttttgattattatataatatatttttttagagtctctgttaatagactaccgttaagggtggtctaagtaaatgacatgaaacttatctagataaattgatcaaatagtatcttaatctagtcatttgtaaaaagtcaattacacatgtgaacgcgatggagatatcggtaggagcccaaaaaccgaattgagaaacaagtacaaattttattaagataacgataacaataataaaattacaacaacaataattaaggacagaaagtaaatcacggaggcaagatatgatatctttttccttaattcaattaatcggccgtaagtactttttggacatgacgatttatgaatctcaggatacaaccgatcacgaactaatacccgagcacacaagtattagactcaatcgaacttgatctacgatatactctcgaaattattaaacaaagaacttacttttaagaggcaagagagaggagagactttagaatttagagtgttttgtgtttgagagcttgagaaataatgagaggttgggtctctttatatagtagagggagataggattttgtgaaattctcaggatatgcatgatatattttgagactatcatgagaatatgaaatattttaaaaatatttcaataagattcaactcagcaagcccaataactcacaagcatgacggtctgcaagcccgacagcccttgagccaacgacggcacgacccgacaactcgcagcccggctcagcccggttcggttcggttcggtccggaatttagcccaagtgtcccaatttacacctttatttctcattcaatacaactccatttttgacgtatgagtataccattttgtagtactctttaccagctttccaatacactaatgacccgacaattctgttcagccgtttggccggaattcggccggaaaatcaccggaaacattttatgtcaaaaaagttccaacaatcccccacatgaatagaaataagtctaaacatatgacgactttactaatcctaaggactgacccaactagctagactagacagaccttcgagagtataaacgaaaactaattgtatatgagttggtggcattttttagctttgaacctactcactattagtacctgtcaagtttactcggccagatggtgaacatgatatcttgaaccatccggagtttgatgcaaagttggacagcaggtataacacaacttcattttcttgtagaacgaggttctctgtttgtgttcattatggccttcaacatgcctggttaatcatgattgaagttggagagtatagcctcacatattctcacattgcttgtattcaaagaagtatcctgtaagtatttcacatattttacaaagctaggttcaaatcattaaaagcaaatgcttaacctttatacatataggaagcactgtacatcatttttggaactagtaagacacaacagtctctcagtgcttataagagatttagtttgatttaattgtccctttgaacctatgtcatgggatctccaatctttgtaggtggggttaccatcaaacttcctcttaggtggtcaacttgatctcgattcaaaccttttgtaaatggatccactaggttgtcagctgacttgatgtaatcgatcgtgattactccagttgagataagttgtctaatggttttatgtcatcgtctaatgagacgagatttaccattatatagggtactttgtccatgtctttagctgaatggctatcacggtgtacacgtattgcaggcacaggtttcccccacattggaatgtcttccaggaaattacggagccattcggcttccgctgcagttgtatccaatactatgaattcagattccatagttgatttcgctgccacgatttatttgctagatttccaggatactactgcacctccaagtgtaaagatgtatccacttgtggatttagagtttttggaatctgcgatccagttggcatcactgtaaccttccaaaactgcgggttctttaccatattgcaagccatgatctttggtataatgtaggtagttcaaaactctagttatagccttccaatgcttatgtcctggattacttgtgtagcgactaagtacatttatagagtgcattaaatccggtcttgtactgtttaaagtacattaaactgccaattactcttgcatattccacctgttgcacatgttcaccagagtttttgatcaggagtttttgcagtctcattagagtaatgcttgaaacgatcaagtatcttctcagaatagtgggtttgagacaaggtaagaccttcattagttctgatgatttttatacccaaaataacatctgctagacccatgtctttcatttcaaaagatcttttgagcatgtttttagtttgatttatgatatatgtgttgttccccaatatgagcatatcgtctacatataaacataacaaaatgtaccctgttggagtaattttgaaatatatgcatttgtcacattcattaatggtaaaaccattagacatcataacactgtcaaacttctcatgccactacttaggagcctgtttgagtccgtatagtgacttcacaagtttatacattttgtgttcttgtcttaggataacaaacccttcatgttgtttcatgtagatttcctcttccaaactccatttaagaaagctgtttttacatccatttgatgtatttcaagatctcgtaaggttgcaatgcttatgagcatcctgattaaagttaatctcgttactggagaatatgtattcaaagaaatctaaaccttttttttgtcgaaatccttgtatcacaagcctagccttgtacctatcaatatcaccattcgtttccttttaatagtaaaaatccatttactccccaatggtttagaaccttggggtagatctgctatctcgtaagtatgatgttgcaagatagagtctatctcaatattgactacttccttccaataagatgcatcagggatagacatggcttctgaataagttcttggtatgttttcagctaaaaacaccatcaagaaatcatcaccgaaagatttctctttgcgagctcttttgctccgcctaggttgttcttcaggttcctttactgtttcttcaacagtaatagtacccaaactattttcctcagcctccgaggttgttgaatctcgttgttcacgagtttgttttttgagttctcctacaaggaaaaatatcttcaaagaacgatgcatttcttgattccataaatgtattttcatggatatctggaatattcgattttttaacaagaaatcgataagcactgctgttgtgcgcatatccgatgaagatacaatctacggtcttaggcccaattgtgacctctttgggaggtggtacatccacttttgctagacacccccacacttttaggtatttgtacgagggtactgtacctttccaaagttcatgtggtgcctttgcagtcaccttatgtggtatcctgttgaggatgtagttagtggtaagcaaaacttcccccacatgttttgggctaacccaagttcatgcaacagtgcattcatcatttctttcagagtttgattctttcgttccgcaactccgttagattctggtgaatacggagcagttgttttgtgtataatgtctttttctctacaaaatacattgaatggctcattatattctcctcctctatcacttcaaactatttcagtagttctctgaagttggttttctacttcgagtgtaaattctttgaattttaccaaagcttcatctttgttatgcaatagatatacataacaatatcttgtgcaatcatctaggaaggtaacaaagtatttcttaccgcctctagtttgcacatattttaaatcacataagtctgtgtgaattaaacctagaggttcagttgttctttcaactcgtggtgacggagtttttgtgagttttgcccgtacgcatacttcacatttttcttggttagttttgaatatcggaattaaattcatgttttgcatttttctcattgttttataattgacatgtcctaaacgttcatgccaagtagtaaactcaacaaagtaagcaataggattttcatttatttcaacaacataagctacagttttaggaaagactgtcattacagacattttgaccagtccacccttaacaaaaccctttctcagatacaccccatgtttctaaagaactagcttatcagactcaaagttaactgcacatttttaatcctctaaaaattaattaagtaagaaaaaattttagtactatttgtgtcaatcccctagataaaaatgagagcaaacactaatttaatattaaattgaatcaatttttgaaaatatagtggaaatatataccctaaattggaaataaagaactcaaatataatactacaaactaattttaaaataaaaaaatttcttttaaatagtgaaaatatataccctaaattggaaatagaaaacccaaatataataccataaactaatattaaaaaaaatcgaaatttcttttaaatgattgaaatatataccctaaattggaaatagagaacacaaatttaatattttaaatttattttaaaattattttggttgaaaatattttatataaaattatgatattattgaaaaaataaattagtgataatacttttaggaaaaaaacttcataataaatcaaataatgctatttttggaagtttatggagggtgtgctattattgtccataaaacttgatttagtgctatttttaggaatttatattttttgtttgttgctgctcgtttttggtgaatctacttgtcgtttattgcataatctcgagctgtttctagaagaaaactcttctattattggggaatttatgccccttttcgtcattaaagttttcttaagaaataatacacagaccgggaattgaaagggtcgtttagctttttgtcttctttgttagtttcaatgatactctgttacttgcttttacccgacaagctgttgatgcatgtttcagctgctaaaatatgaagcatcaagggactaaaatgatgttactttccaaaacatgttgtctttgatgattttggcggtgccctatagtggaaactggaaactgttgtctttgatgattcaagaatgtgaactttcaataagtttcttgatcagtttttgtcttccgcaaatttttagctatgaaaactctatttttcttttgttttatattactctgaatttacattgggatgaaaaatgagtggctgaggaatatagaaatagttgacaaaggatatatatactctattcagtgttgcatgtgtgtgaaagcttaagtgttgaagaacttgtacaattcatggtttcaggtagcatttgttataacaaccggtataaacagtgcctatgtgttgggatattccaagacagtcatggttccattgggttggattggtggtgtggttggtctcattcttgctactgcaatctccctttacgcaaacactcttgatatgtatataatttgcatgtttcacacatccttttatcaccattttgagtctagtttcacccatctttcatagcattcatcaatatttttgtacattttgcgtcttaagtcgagtctaggactagtcttgcatacattatgcattttggagttgtttcaggtgctttggagctattggtgctcagaaagaggaaaaacagaacagaaagtcatatttccaccaacatactcgatcaccagtatcagagagggaagcggtcagctcagtagtccatccagacacttatactcgatcgcagaggagaggaggcagtcccaactgcagttctactcgatcacagagctgaaggagtccatcctgacttttctactcgatcgcagaggcgactaggcagtccactttgccagtccaccagttctactcgatcgcagaagagaagaaccagtccatcctgacagctgacacacatactcgatcacagaggccaagaagcagcccaaaccattcagtcaaccaacctactcaaccaccacctcgaccatctgatcaatccgcactcaaccagacaacctgagcaacggaaagagaagagaagagaaggcctattcaaagcccattcgaagcccatcaggaaatccactttgggccgacactcttgatcacgtcgtacatgggccgttaagtgggctcgaagcccgctttcttatcttagtattaataagtatctaagggtttcgccctggcacttgcactttgagagacacgaattttgcactattattcagcagccgtttttcattcctgcaactttgtatttcgatttttcttctaagttattcagattttgctttcatttgcttgttcatctttgtttcattccctttaatatttttagtatgcaatcttcaatcgtttctatgttattgtctttaagcatgttgtctgagtagtgattaagatttctgaggatgggatagagtagttgtggaacccctcgtcgaatctgttggttaagtgtatatttattgaatcccttctggattaattgtgtttactgcttattcctttctgatcaacaggaatccgatcccagacgttccagcactcagaaggcgtttaatggaacgttggatctactaattccagtgataatcgtctctatcccaagggattggccgtttagagcggttattggctttaacagtcgattcttattgtctgcttagttagagatcgctaatggaaattaggtcagtgtctagctatgcttgaggatttatatcacgggagtgaattaatctgttgttgaacctgttgtctagggatagcttaattgagatttgttaaccaactgaattgattacggagaccacactattcgataaccccatccttaggagtttctcatccatatgatttctctgtttacttacctgcttcattcacttgccattgaattttagtatttttctgttttcaaccattctactcgatcacaccagtctactaacagtgagactgcgtgatagagtaaagtggtctatttctgcattttcactctttgtcatcctgttgtactcgatcacagggtcccttctggcagtcgatcctgcgatcgagtatatcagtcatttctgtgactttttactgttttctgcatcaacactaggactgttagaaaaccaaccaaattctgcttggcttgacttagcaacttctgatcatatctcatatgtctgcatcacacccatttggattgacacctaaaatattacaacgacaggattagtgttttaggattaattgatctcaaaaacctattatcaactcttatcgccaagcttcatgagtttggtggcaaaagacacattcgttatagagatctcgcaggcttcatctatggtaaattctccatcactctctcgcaatatcaaaaaacacacttaactagaattgtatttgcttgattgattcaggtaaaaagatgtatcgtgttacatggggattgcaatatgtctatcttttcatgattaattgtgccttcatcttacttgctggttcgaccttaaaggtacaacaaccgaaacaaaccgttttgttgcgaaaatccgaaaattagctcatatggctctgcttttgcattgtgtgcaggctgtttatgtactttttagagataattgtctcatgaaactgcctcactttatcgccatcgcgggtgttgtatgtgcgattttggccatcggtattcctcatttatcagctcttggaatctggctaggagtttcaacaatccttagcataatctacattattgttgcaatagttctagcagctaaagatggtaaactttcatgttaaatcaaacctcgaaaatgatttcaaataaccacaaaaaaactactcgccattttgtttttggttcaataggagtaaacaagcctgaaagagattacaacatacaaggatcatcaataaacaaactcttaaccataacaggagcagtttgcattcaacacgggaatgctaccggaaatacaggcaagtctcatcgatctatttatggtcaatcaaatatttctctgttttgtgacttacactaatcttttgtgcaaatgattaggcgacagtgaagcaaccggtcgttaaaaacatgatgaaagctctgtattttcagttcactgttggtgttttaccgatgtatgcggttacattcatcggatattgggcttacgggtcctcgacatcgacttatctgtttaatagcgtcagtggacctctttgggtcaaagcactcgctaatatttcagcttttctccaatctgttatctctttacatgtaagtctctatctagacctcaatgatgagtctttgtgtcttaatcctaaccttaaccgtttaaattcttgtgtttttcttacgtaaatttttgcaagtccgacttatgagtatatggacacaaagtatggagtcaaatgaagaccattaggaataaaaaatctgttgtttagaacagtagcaagaggaagctacatcgcggtgagcactcttctctcggctcttttaccgtttctcggagatttcatgagcctcactggagcaataagcacgttccctctcacattcatattagcgaatcacatgtatcttgttgctatgaacgataagcttagtcttgtgcaaaagctttggcattggcttaatgtttgcttctttggattaatgtctcttgctgctgctattgctgctgttagactcatctctgtggactcccaagaacttccatgtttttgctgatgtttgattaaaatgtcttcgacattgttaacgatgtaaaaattataccaagaagaaaaaaattgtaatccttttgttgttacttttattatttcaaatgacataaattttttataacattatatataaaaatttttctgttcaacacaaatttttacttttaacaaaacaattcaagagacaaatagaagaaacaaagtaaagtgaagtcatattcttaagcaaagccatattgattaagaaaataaataatcattttcttatgcaaagccatatttgggccaagccgtattaaagtttgggccaacttgtttgagatagccacatataagcccaatagagttttgttgctgagcttatttatgaatccatataaagtcttgacctaatagcgaaaactagggtttttctctgtgaattcgctcggcggcataaaagagagtaagaagaggaagacgagagttacaaggattgaaaatgaagggacgtcaaggagagagagttaggtaattagggttttgattgtgctctctttttctcagctgaatctccgatttgaatttgttcgttactggttcactttaatctgatgaaatctttgtgttgctgttatgcagattgtatgttcgtggaacagtcctcggctacaagaggtactttcaattttcagtctttctctgtatgttcttaagttatttggatttgaatattcacctatcgtttttggatatcaacataaggtctcgatgaaagtttgtaactttgccacaactgatagatttcaatgataatgctctcatatttgtaatgttactccattgtttctgattaatggttgtgcaaaatgatgcatttttgctattgcttcctttaagattagcttttaagcagttggttgatagtttgattgcttatagaaagcagaataaagattgattactaacgattaagtaatgtttcaggtccaagtcgaaccaatatcccaacacttctctcatccagattgaaggtgtgaacactcaagaggaggtcaattggtacaagggtaagcgtttggcttacatctacaaggcaaagacaaagaagaacggttctcactaccgttgcatttggggcaaagtcactaggcctcatggtaacagcggtgttgtccgttctaagttcacttcaaacctaccacccaagtcaatggtactttatcttcttgaaacataatcatggttaattggattttttcctccagactaatcatttttgatctgctgtgtttaatctcagggagctagagtcagagtcttcatgtaccctagcaacatatgaggtaacaacaaactcatttcagttttacttttgatccaatagtcccgtttattgcattcatttcagtagaattgaacaacactgattctgtaacttgatatttaagattagttgtttcattttgcttctctaatggagaaaccatgtcaacaaggctatatctatttgaaaggttgtgcattgtaattaagagcaattagattaatcctttaagtataatagattgtccatgatatatatactttagtgaacatggatcctgattcgatttcctaatgcaggaggatagatttcaagaagtatcggaaggaatcgccattatcatttctcaggagctgtagtttatctattcacttttgttctaaactctctgttggttttgattttatctttagacgaagtaaaacatttttcttcttgagataatattaatggaacttcagaaaacctatgatcccagtcatttccttatttattgggtggataggcatttggagttgcaagtagcttctcacttattttttccactttgatagattcgtgctccttttgtttctctattttttctcttttggcttctgcaattttctcaatttcagcaaggcaatatcaaaatgtgaattctaacaagaacaagtaaaagagatatcgagatgctttagtataatggggcagatctagaaagtgacttaataatggaaagtgatggcttcaaccgcctcagctccaaacgtctcttccgctctaaatcaaaagctcccgtctccagatctgagccttcttccttcagctcaaatgcttcttcctcttcctccatcaatggttttggttttagttgttgattgcgaggggagcgaccagaagatttgaaaccgaaagatctcatgaaactctaaaaagtaatgaccttctagcttatgctatgactcttatcaatttcttcttttttgaaaccggaagatctcatgaacctctagcttcggctaagatctctttctgtcttggacatgaaaactcacaaaataaacatatgtaaagaagaagctttgactatcaaaatttccaacactaccaccacatttcgtttttttggtcttggcatggttggatttactatatcgactccactcgttctagccaagtctagatcctctataatggagagaaatttctaatcagtcaccaatgtctatttggcagatcggaactcaagcttctccgatatggatatgaactgagttttattaaccataacaatgtttctagagatctattcgagatcctctcttcctgccaccgtgagttatctttccggagcagagaatttttcttgtaccgcataaccgccacaccaacatcgcctctctttgctacatcatagctaaccctaaaattttcatgggctcggtccattttcttttttgtgatctctggccattttgctaagcccaactttagtttagtttttgtattgcctgtcctttatgcaagttgtttcgctgactcatatgtttcgatttctttctgtaaggagagacttttcccacattccttttttttttggaaagatcatgtctacaattctacaatactttggattgtttcttgaattcaaaaacgagagtttctaaaacgtcaacaaatatccctcataatgaggtgtcccttttcaaaaaaattaagattatctctttattttttagtacggtgggatatcaatctccctccggaactaataaatgaggatcctagcatggaattgtcaaggggtgggtgcggatcttaccactcatcgactggaagagatgtgtcgtatgtactctccaggttttctgtttctatcggaaacgaagaatgatcttattcatcttcaggatatgcaagtatcattaggatttgattctcttcaaactgttgaacctataggtaatagtggtgtcttgctcttatgtattcgaaagattatccggttaagttgttttcgttagtgatcggctaattgatattgaaacaattattgatggaaaccgagtttttattacctttgtttatggcgatccggtagttcaataccgagaattagtttgggagcggttgactcgtattggtcttactcgttcggagccatggtttatgatcggtgagtttaatgaaattgttggaaatcatgaaaagaagagtggaaaaagtagatcagaatcttcttttctcccatttcaatgcatgattgaaaattgtgggatgattgagattccatctcatggtagcttattttcatgggtgggtcgacgtcgctgcggagttacgtgtcggagagtctgtaggatcattaaatcatggctagatagagccatggcgaatgaggattggcattctattttttcccactcaaacgtgaagtatttgaacacagacctcttctagcttcaatccagaatagcccaaaaacgtaaataaaagaaaataaataaaaagaaaaatcatactagtgggttgcctcccactaagcgcttgtttatagtcaatagcttgactatgttgggtttctagaatcaggaggatcagatggtggcaagaaataccgcggagaaaaacctctcatcatccatggtggcgtataggcatttgccgtgtgaggtctacaaaggaagtgcggaacttcagcagtgcagaacagaggtatcggtggtctactccttttacctgcacaatcatcaaaaaaaagaacaagcactcgacgagaaactcgtggtttgcttaatcgtaaaacagtttttggaaatttgaaactcttattaatgaaatcaagaggtttaagaggaggagatgagtaccttagccgtttaggaggtggatcaaggagtagaggtgcagtgggtgacttgactatagtgcctggagtatcaacagtgaactcaacacaaaaactagctctaataaagaactctagctccgcctgtgtgggggtgtcgatcgacataggtggtggtgtcgatcgaatccatccctccagattgattctcagcaactaaatcatgacttgctttttgtagctgcccgcttgtaccatgaaccttatctatcttaacactagtgtctatagagtgctctacagagaatgcctgaccatctatggtgggtggcttcttcaacttgtccatgtcaagagtcataaccacatcacactcattcaaaacaattggaatttctgtagatatagagcaatcgagtacacaactacctggataggtggcattgattatttcagagataggcattgccagcttgtccttcatcgtccgtggagcatcacacatcagaagtgtaatgatttcggcattaagcaagcttgcctccttatcactgacaccattcaaaattaactcccagatatattcatgaagtatataccataggttcgtgtagtcaacataaggtaacttttctagaagcaaatcacacagcgcaaaacatctctcttcaaggatatgctgttcggtccgtatagccactagaatctcaacaaaatatggcgcagtccttgtccattgttcatggacactatcatttgttgttgacgctttggtgtcgagctcgctcgatttcgctccgtcaaacgttgaatcattgattgttcctgatgagtgtcggtcgacaccgaggtcatgtcagtcgagactgagacttggtgtcgagtggttctgtaaatcagtgtggcaagcaagcgtgatggttttctctaaggtctggtgctgaattctactccctaactgaactacactaacatcctttctatcgatccgagcattcaagtcttgaaagtcattgtacagaccatcaattctttgattcgttatcacctggctcttgagaatctgttctagcatgtattccatcctactcgtagaagtgggtggacggtgggcttggtgagtagaatagctggaatgattagcatagaatagatcaggcttgttgtagtcagcaagttgaatataacgttcatctgcaatagctgcagctctgtatcctacttggtgtcgagcgacaccctggtggtgtcgatcgtcaccctcaacaatatcaggtatcatgtttccctactcatcgattttttgaccatcctcgttgtatgcctgaccagctgtcccttaacactcctgcaacatcagatataattatcaacatcttggtgttgcaattaaattcttgaagctcctgaaacacaagaaaaagaaaaaataaaaacaagtgagaaaaaaagaacaaaataagtctagtctaaattctacacctataaaataacaagagaaaagagtttagaataatcttctctaaagggagtttccacagggttttgctcccgagtactaaagagaaaaggagaatagcctctccaagattaggtctaaacaatgaccttaaaactatatatataagtcttataaacatactgggccgaatatggaaatcttcaaatttcaataacttgcgtcacccaacaagaagtctgacgatttgaagattctagaaattgccctagaagactttcttatttgtattattagtccctgcttgtatttttagatataaatactctttttggtcattgtttagaccgacaacccttaaaacttttattttaagttttatttttacttttgctcggctagtccttggagattttggagagttcaccaaacatttcaaaaccatgtaaaaagaaaatcttttctaaagtctattcttcttttgatttctttatgcaatcttatttaaacatgttttctgtttccatgatcatatctgagtaattcccgtgttgggtttagggtttctcattaggaattttgatgatttagtagatcgataacctattcgaatttatattcagagttcttcatcttgattgttcttaatgcgagttctagagtagctacctagaatgtgatcataggttaataggtaagatcggagaggccgcttattacgtgaactatcataggtaagtatctagatatagataggtctaacttaaatgcttaggtgaacgtatcaatcctgattataatgcatgattagtatttagggttttacagacgagagttgggattcctatttattaagcatagttaatcaatacagacgagagttggttgattataggttagggatttgagttctaaaacggtttgctaacaatcctaattaactgctaaatctattattcatctatttccggagaatttccttaaaccgacagctttaattatctaagtttactacaatctaatatgttatgtgctttgttgtcattttacatttaattattacttgatttagcttaattatgagactataattttttgtgttaacaaaagaactttgtggaaatcgattctaaagtactacaattgatatctaatttgagagagagcttgaggtctaatttgatccatatcactaatcttatggaaaagaaaataaagggcaattggcaaaactaacgcacaaaaatattataattaagaaaatgacatcaacaaaaaagatgggtgatatatttccctctttccctcttctcttttcctctctttctcgatattttttctccagttttcttcttcttctcactgttcacaatcgaattgtgactctctctctctctctctctctctctctctctctctctctctctctctctctctctctctctctctaaatccgtttacatcaccaatgacatcaatgtttagtctattaaagattccaacttctttgatttgcccagaaaatgtttctgtaattctattaacttatcctacaaacaaaccaattcattctatttcgatttgtttgtctatttaaactaatgattaacgaatggctaaaaaaaattgtccgaatcttaccatcgtcaacgtcaccgctacagttaatcttgattatttgggttgccaatgttgtatcttagggtatagtatttttttatcaaagcggtttaattcagtcatttggattgtctacgttttgttctatactatttagtttcattctatactattttatttgtctgttttatacaaacattattcactattttaaataatttgtattagattgtaaaatttttaatcatgttatactcagaaaagatctatttttttataaaactattgtaaaatttaattagttatttttatagcactaattcaacaattaaaatcatttggggtaatattaatttttataacattggattattctctctcttcttccacacatctcatcacgtcctctttagcgcgtgtctctcactgttgtaccattttgtcttttcactacttcaatgtgttagtttcttaatatttttgaatatggtgctatattattaattttagattggattttggttatacaggaaattcacccaaaaataaatggcctagtctgaagcaaaaaacaaaaactaatggctaattgttattgctctcggcaacaacgccaaattgatctagtgattttacccaataacttactgaacctcaaggagcaatgaaccaacacactaggaatacacaaaattatcaagtttatggaatttaagctaacaagattggaattatgattcactaacaacctattcaaaatgaccaagagaaacaagattaaagcaaaacaaaacataactaaacaaaatcaaaagattaataggataagaaagtaaatgaaacgaaaaataataattcaaagacggtttcaaaatcaagattaaacaagcaaccctagggcaagatacttgactagggagatagcaaattatttttttatttttttgtcataagatattatttagaactcaaacgagctaattttgaggaaaattgtttacaaaagtgatatgtagcggttcgactcgaattttttgcgccaaatagtccgctttgacatttgcattacgagagattaaagataaagaaaaagtagtaaattcttctttgtcgctctagaactcctccaaataagctgaaaatgctggccatttgcattgcaaattaatctattatatttaatcaatcaatcaatattcatcctttcccttcgatacctcacgtaaatcaattcattgacatttaatcaatcaatcaatattcattcttttccttcgatacttcaggtaaatcaattcattggcattaattataagctaataaagcagtcatcaacaattttcattcgcaatcacaagataagcatgcattaaataccagtcaaccactaaacatcctaaccatgttttcgaaagtaaggaatataaagaacttgtgaattgggtttggcattttgtcgaaaaccttccaagaataaaatgcctaacgtctaaatcatcattaaatcaaaggtaatttagcattaagatcattccacaaaaaatgatttacgtaaatctagcactaaacatcataaaattcatcatcaaatctccctaatctagctaccaagttcaaaagttataaaataaactatatattgcataaaactacataagatcaaatggcatcaaaaatccaaaatccattccatgaacatagaattaagaaatgcaattcaaacgccatcaaaactccttaatacattccatgaacatagaattaggaaatcaaatatgcaactaaggacctaaacttgaatccaaaatgatgggaaactaagaaaaacgaatctataaaaccaataaaaatacaaagatatcatctctatccaagatcatatcatctcctctttttaaaaaggatttgacgtcaaatctgtttgttatgcaataaaaggtacaagtatgaaatattgaagttagaactcacattatacttaccttgcacgtcgggtaagtaagcattgtcacttatccattcgattatcttgtatggaccatctattaatggcctgatttttgacttctattgagtaggaaacctttcctcttttaagtgaatcaataattgatctacaacttcgaaaatagattatcttgaatgtctacctttattagcttgcttagcatgaagcttggtcttttcataaatgtttttccctgccttttcatggacctgttaagcaagctctaccttctttttgtcatcaatactaactcttttattcgaaggtagagggattagattaaaatgtgatatggagttgaactcacaaccaatttgaaaatgaaaatacttaaaacctgaatgcaaatctgtaaattcaatatgtgataaacatttttcccaagatttcaagttttttttatcaatgcatgcaagagaatacctaaagttctattaaccactttattttgatcacatgtattttattgtgtctctactatttaagtgaaaaataagctttagttaactttttatattctcaccgagcattccgcaaacccataaaatataaatatcagagtttttgccaaacttgcaatcctagcttcattatatatcatttatcctttttcgctgtttacaataatactaggatttaacccatgatacaccacagagcaaatattttattcatatatataataatattaaaattttcggttttagtttagtattaaagttatataattttatattaatgttgtgttataattatttaataataaaataattatttaacctgtgttatatcaatccaaacccatcctgctatatttcatatcaatctaaacccgtcccgctatatttttcgtctcatgatattttaattttgttataaatttaaatattagttctggaattagttgtgattgtgattttatgtcgaaaaagttatggacttttatttctatggaatattcaaaccaagataaggaatgtttttaggtgcacatatacttaggtttgctcattttatgggatcgtaaatgtattttggtttgtttcacaatgttggttttaatttattgccgaaatttaatacaaataattcaaatagttcaaattttggttgttttaagatttagtaattattgtaagtaagataaggagaatataatttattatattttacgtggcatatgggattgccatatatttcgaatctttttagtttattacacagttaattgccataaaaaatttaaatctagtgacaactattgtaaataagtcctaactccgggatttgttttataaaatagctgtaaaaatgtatatgtaaattattatagagctacacaaattttatatgtagagaaaaaaagtcgtattaaaagagtattcaagatatttataaattatagtaaaatgttttagctggaaccatctacttacctaataaagaaactccttttgctttattgtggtgaggtggtgaggtcagcgaaaaggagaattgtctgatttgtaacatatttagtaactaaaattattcaatgccgtgattgcgggtaggattaatttatatttttacttccatggaaagtatatgaataaggaaaaggtcatcacttgtaaagataaacatacataatcaaattgaataagtaatatttgacgtgaaaagaaagactaatgataaaagtggatttatgttgcctccactccattgattaaaatttaaactaattcgtacacacgagagatcaaagggaaaatatttacaataattagcatataaaatttgaaccggaactatattaaattaacgtaattatatttataaacgtttttaactaaatgtttacaaattgttcttaacaacatataaaattttgttgtaaatagaaacaatcttaagggagtaaatataaaaagaattgttaaaaaaagattttttattttattttttatttttttgataactcaaggttaatttccgaatctgtggaagggtacatgattaatccgtggggagagggtaaaattatatagatatatctttttgttttaatatattaatttgcatatctatattttaaatttattgtaagatttattacaataatatagtaatgttgaactatcaattaccaaaagtttcgtcaaatactcattattattattattattattattattattattattattattattgttgttgtaattaaatctcaaaaatcattcttacataaaatatgatttaacaacttcttcagaaaacgttttacatgcaaacaactgatcaaactataatcttatttacatccatttgcaaatctactatctattttaccactaaaaatatgcttttatactaaaggtatctctatgacacttaagctaactatatgtttctatgttttatacgtccaactatgtgtctctttaccaacgtggatcgaggagcttcagggatctccgagtcggagtgatagtatagatgtactctacaatatcccttcttgacaaaccatttgtttctattcagacaatagatatgtggattctttccaaacaacgaatggttgtcaatcgcttctccatctcagcaatgcacttcttactgttgagctcctgcttagaatgacgccttggagtggttaaaatttctggaaaataaattggtactagctcctcatgttgtgtctgttctggttagtgttgatcgacactagatgagtgtcgctcgttagtgtcgggtgatgaacgatcctttatgttcctatttgacactgtctcgtcagctgattcgtcccagatcgaattgccttgtgtcaatcgacactaatgtgtgtcggtcgacagcaactctgcagcagcgagctccaactcgtccttaacatttcattctttccagctttcctccttagctctgaccatgatcgcgttacagctcttccttgtattagtatcaggggtatcaagaagaaaaccctcttgtctcttgataaactgaacagtttgagctacttgaacatccagtgtcttcatgtgagagctcaaattgtcgatcttcctattaagatctgtgtagatagcatcaaacttcccattgaactcgacaactagcttggactgacccttaagaatctgctcaagcattgattcaatcttactctcagcagtgagcggaggaggggtttggtaagaagaattaccataagtcctagtgaagttgttctaaggaaagatcttctagaaggcaggttttagggtgaaacctaaagaactctagttccttgtaaacttgttgccctatggctgtccaaatttcttataaactcgaccttgagtgaaggcagtcagcttgtttcgcagctccttagacttagtatcatcataaaagttattcaggaaggctatcttgatgcttctccaagtagtgagtaaaccagccttcaattgcttcaaccaagaagcagctttcccagcaagtgaggtaagggaaaagcttacacagtaagtagttttcagagactccattagctttaatgctcattacaaggccctcaaaacgctcgatatggtcaattggcttttcatgagataagtcatggaaaggatgcttgcctagtagtgcaaagtagcaaggcttcagctcatagtcgtatctctgaaagggtggggggtacgatcgctgatcggttggaatagaacatgttaggcttgttgaaatccccaagagtacgaagcggttcagtagctagtggattagctgcactaagattttgtggttggtgtcgatcgacatagagccgcaccccctttccgaccaacaactctaggatgtgttgggactcctttaagaatgttttatggtgttttggatgttgtgagatgatgtgagatgccttgggcgtcctcccttatataggaggcgaatggatgcttcccgaagcatcacatccggtccttgcacccttccgaaatgtcacatccgttctttgcatcctttcgaaaggtcacatctattccttgcatcctttgggcgatgcaaccgttcgttggtacccgctcgaccttacaccttttggccgagacacctcttcactcgtgagctaccacagtccaccagctcgagtgtcagctgaccggaccacccagctgggtcagtacttgatcagctcaccgagctcagtcgagctgtcggtcagctcacctagctgagctagctagtcttacagctggtttagctcacctagcttagctagctagttcatctagcttgtccagctcacctagctggttcggcttgaactttctcgttcttcctactaagtattttggtccgttcctcgaccatgatttagttttctcctaaaacaaaccggccttttttatgaacgcgggacgcggtcgttacaggtatcctagcctattcggatggttaacaagcgcaatcaagctatcccttgacaacaggttcaacaacagattaattcactcccgtgatagaaatccttaagcaaagctagcccagactaattctcattaacggaatctaactatgtaggcaataagaaccgactgataaattcaactaccgctctaaatggccaatcccttgggatagagacgagtatctcaggaactagtggatcaagcattccatcaaacatcttctaccaagcatttcatcgaacaccttctaggtgcgggaatgctttggatcgaattccagttgatccgacagaaacaagcagtaaacacaactagtccagaagggattcaatcaattctaaaacttaaccattctacagactatggattccacaaccattctatcccatccttaagaattctaagtcactactcagacaacatactcaaagacataatcgtagataaacaagtatattgcataagtaagaagataaagagtagagaaacaagatgatagacgaaatcaaatgcggaatctgaataacttggaaaaatctcgaattacaagttgcagaagcaaagcggcgcaacaagagtaaactaggtaagacataaataaaaactgaagcaaaaactggatgtaaaatggatgtcctgggtcaaaaccatcaaaaacctatttatacaaaatgataggagatgggccgggaatccaatcgaccggcccatagaatgataatgggccaaactgggccttgtgatcgggtgaagctccgggccgcttccaaacacttcttcttctcctcttctctgccttatgctcagcttgtctgtttgagtgcggatttgagaagactctgaaggtgtgatcaagtgcttggtctagtgatttgatgggtggtgagtgatgatactcgacaagggggtcgagtaatgtggtagagtgaatggtcaagtggttgtcaagtggtgtgacaaagtgttgcttgccgatgcggtcgagtggtgtcatcgagtaacctggagtgtggttactcgaccatggggtcgagtgattggcaagaacggctccaatgttactcgaccaaggggtcgagtgtggtgctggatgtactcgacctgggggtcgagtatgtggcttctggtttcggctttcttcttccaatttgctcgccaatagctccaaatcacctgaaaacaactcagaaatgtgatatgtatgcaaagctatcctaatcatgcaaagtatgccaaattgatgaggaatgatataaaacagtgatgaatgatatgaaactagactcaaaacgatgatgaatgaatgcagaaaacatgcaaattatagacatatcaactcctccaaacttagtgtttgcttgccctcaagaaaataaaatgacatagctgaaggagaggtttgaagttggggactcagaaccaaagcatcagatacaacataaaaaatcaatgtccaagttggtagttctaagatgcgatatgatctaattctactcaaaaacgttagccatgccttgttatgattcaatccgtctcttatactcgacctacacatgctttaaaatctaccaaaccctttaacattctttagttctggaacgtaaatcaagcaatgcatcatcaatgaactcatttggctaaggtgaaggtcaagagaaaaagatggtcccttaaagaataggctttagtaacacgggatctctcaagaatgattgagctttagtagaatgctaaaggtaagtcccaagttaagcgtacagagataagatcccatctacccaaagtatagcaaatgaagctctaatagtaatcccatctccaatcccaaaagaagaacttaattctaccctttacattcatgaatcttttaaaccctttttcagatcattcttttcttttctcttaactctaggagaagctttctcaacactttgatacttctagcggttttggatttctttaacaactaaggttcttgttttaatcttttaaaactaagggctttttacccttcttctttagctaacaagaaccccattcttttctttaacattcccaaaacctttactagcctttttgtttttctaacttctttagcttccttcccctagaattcttttccccttttctttcttttagacacatctcaacccataatatgagcgcctacctagtcttatccagcccggaaaacgcgaactagaactacatgagacactatctctgacgttacgaacctaacactttctaccaagctcaatgagaataagacctcacggacactcacaagtgataaagggctttaaagaaggtttaggtttagtgtcggggttaactcctccaataaggggagtcagctacttgaactaacatgagtggttaaaatgagtaaggaagtccaagtattttagggtatccatgagttctaattcgatgctaagacatgataattgtaaatcagattcaggtttcaataatacaaaatcttttaaggtaggattttctttccatatttatttaatatttcgtgttttactacatatgtcgtaggaaatacgatagaaatttctttcattaatctgacgaatatatttcgacggaaattcgaaggttttggtaagtgttttttcttaccaaagttttggtaggaatttggtcggaaaacactatgttttcttgtaataatatcatgattttctacgtcgttcttgatttttatgatacttttatattcttgaaaaatcatcagagcagtcaattacatgatttatgagtgagcgatatatatatttttgaaaaaatagccaaacgttttataatttttaaattttaattatgcataattttcaattcaatagtcgaattggctatttaaatataataattgaggctactattcataaatttgaatttatgtatatcacttatatatgtgaattcatctttaatgtttgttatttattgataaaacttttatttttcttctaatattaaaagttcaatatttaaaaagcattagttttatttagatcaaattgttttacctcattttttaaaacttctgtataaattaataaacattataaaaattaaattacactataaattgataaatattaatttatacatcaaataatcctatacaattatttgggaagtttataatagaaagtaaccttgtcatttgtaggttattacattagaatcttattggaaataaaattctaagaaataaattaattcatcttatcaagaaaaattctttctaatgccctttttatgatgccctttttcgactctacccttttattttatccaattttatttctagcctctttaaatttttaatgaccattttacccttatttggaaattgttttaggttaacaaaatgaaaaattaatatttttttgccaaaaatattccaaaataaatttccggccaaaattttcccgccaaatatttttgaaaaacaatttcccgccaaattttgttttcaaaaatatttttccccccaacttttttttttggcgggaaatagatttacaagggattttaaaagagttttaaaagatttacaagggattttaaaagggttttataagatttacaagggattttaaaagggtgatttacaagagattttaaaaggtttttaaaagatttacaagggattttaaaagggttttaaaagatttacaatagattttaaagggatttaaaagatttacaaaggtcttttaaagatttttaaagggtttaaaattgttttaaaagaattttataatatttacaaggaattttaaaagggttttacaatatttgcaagggattttaaagggctttaaaagatttacaaaggatttgtaaagatttttaaacagtttaaaagtgttttgaaagatttacaagggatttaaaaaccttttaaaattacttgtaaattttttaaaacccttttaaaatccctggtaaatcttttcaaactcttttaaaatctttttaaaatcttttaaaacctttttaaaatctcttgtaaatcttttaaaactcttttaaaatctcttgtaaatctatttgccgccaaaaaatatttacaaagattttaaaaatcatttttttggctgaggaaaaatttgtttcgaaaaacaaatttggcgggaaattttttttttggcgggattttttttttttgtcgggaaaaaagtttggcggaaaaaaattggcgggaaaagttcagtttccaattacatgtttctattagatgagggtaatttggtcattttgttcaagggaaggggtatttttataaatggacaaaataaaagggtattgtagcaaaatggtagtaaaaaaatggtagttttataaatctccctcttatcaaggataaacaagtgaaatacgaattttttttaatttaattagtttaattaaactataataaagaaaatacattattattttcttaacttacaatgaacatataagatttgaaataacttatcatattaatttattattaatcattatacttcacttctcatttttataagattctatttttcttaaacaaataaatcatcatatcatccatataataacaaagaatagatttttctgtatataacatgatttggattttataaacgtatataaatcattaatctatgaagaaaaaattataatgagtcaaaatttgagacttgagtaatatatttcttatttttttgtgggcaaagaagctttcattaaactaaatcctcaaaagaggtgggttcatacaacttaagcttaaaacattacatgaaagacaaggataaagattccatgagttttcaaagatgcataacttcaaaaagattgcaaaggctggaagatctattgggacctgtagagatttaaatttgaaggctagcttctagaaatcttggatcaacttgtgatcataatgagctcgtgcgatcgacgcataagagctttcgttgaaatgctccatggaagaggctgcggtttgaggcttgttctcgggttcaaaattcagggaagatatctcgttagaggagtaaggtttgagggaaggtatctctttagaggagtaagcttgatgcattcggcaaagaaggttacaagtccaaaacgcaatcttctaatcaaaagactgagattaggcggtttaaatagttttgaagagaaagttgatcgagcaagccaaagcggttttatccaacaaatccaagaaggttgagatgcatcgcccaacaaaagacatggggcggtatgagtaagcgtgatagtgcaaaggtttaaactcgttatgtcacataagagagtagaggcgtgagccgcgtcacaatgcctatggttcgagattaaacctatttcactaagcttcaatacaaaacttgcatttggtggcaaccactctactctaagcaacaagtttcaaaaattctaattgcaagtctcctctaaaaataatgttcccacgattgaaaggagtccataaccattcgatatcgtggagcaatgttttagagggagattaggcaaaggtataaaaagatcaaacctggatattgtaacgcccgtgtcccgagttagggagtaagcaagattttacacccgctgaattcggacgccgagacgtccgggactgggtctcacagatatgggccaaattaggtttagagtttgttggccgccaaaaggagtgaggcccatcccaccaaaccctagaattgctgcggtttggagaagggaagaaagatcaatgtcgtcgtgtaactctgagatgatggtcgacggtgaagcacaagggggaaccacctgccagcaaaggagctcgtcgtgtgtcgtcgatgttcttaccggaaaaagcaccactgatggtccaagagattttcctgccatcaacgaaatccagtgagaagggactaaaggtgttgtcggtgctattacaaatcgagagccaattgatgtgttggtgaaggactgctctggaatttaggagaaaacggtggtggagtattgcgaatcttcttttggcgggttccaagacacagctacgtccgagggatgattgggggcagagctggtagagtatcgattcactcttctgtcgcatagaggacccacaaagaagaagacccttagggaggaaaattttggatttttcaagaaagaaacgcttaaagaagaagataaaaggaaccaaaggattgagaagaactgaaaaagattaagagggtatcccgacgccggcggcaagaagtctcaccggcgtcagaagacatgggtgtagaggatgtctcattcctgtgtctgggagcgttttgacatgtgtgttaagttgatagaaaagaacacaagaaaatgagtaatatatttcttacataaacaaaaatactgactgattaacaaggaaaacttttcatatatttcttttttaaatttcctaattttatatactactataaaaagttatatatttacatttataccattcaaatagtttaaatgaatacatttttaaagaatatcataaatattagtagaccaaaaagataaaagtataaatactctaatttgattttcttaagaaaaattgctaagaatgccactacctcttttcaattatacccttttctattggtcattttcatttctaccatcttctaatttttaatgaccattttacacatacttttaaaatgtttttaggttaacaaaatgaaatacttatcttcccgcctaaaatatttcgaaaataaatatcccgtcaaaatttttccacaaaaaaaaataattggctggaaatagattttcaaggatttttaagagatttttaaaggatttacacgggtttttaaaggatttaagaactttttaacactcttctaagtttttttaaaaccttttgtaagggttcacaagagattttaaaatggttcaaaaattatttaagggtttacaagggtatttaaaagattttttaaaagatttatagaggattttaaaatatattttttggatgtgattatttttttttttgtcatctgcttaattaattatgttcaaatgagccatccctgagaaacattgtttacataagggatatgatgcggttcggtacaaatttttcgtgtcaaagaatatgcttttacattcgcactacaagaaagtaaagataaagataaattagataattcttccttgtcgatttgaatctcgtttagatatactgagaacgctagccattcgtttggggaacacaccatcttcactaaatctgaacattctgaaagaacgatacgtcttggttgtcagctccaacaatacatctcatcacccagagaaaggcttctacttcggtatgaagtggggataggcttcgccgggtgttagcggctcccattatcggcggctctccattagctgactgacaataccaccctaaccctgaaaacttatcactatttttccaagaaccatcaacgtagcatttaactccattcaaacaagtcgaaacagcaactttatctcgggtaatattttccatgtttaaaaatccatggttttctgaacatagctcagcttgcgctgtttgtcatgcttttgcttccgtgtccactaaacgtaggagctcatattgagatttatcaattttctcatgaatcttttcattttgcgctttccaaatataccaacttatccatggaaaagtagaagatgaatttatatccgagggtattcgccaaaatatgtgatccatatctgtagtaatagagcctgttgggaaaattccaggcaccattggaatttggatagtgcccaagtctgtcgcgatggggggcaaaaattacatgagcaattgtttcctctggatccccacacctcccacaagatgaatcaaaatttattcctttctttcgcaaatttgttgtcaccgatacacaacctgataacatttgccatagaaaataccttattttcgggggcaatgtactttccagtgtgtgattgcagcggttttatatttagaccaaaaaattgttttgaaacgatctcttgatccctaaacgtgacgtacaataccctgatttaaccgtatatttacccgttttcgtaaaatgccaaccaatagtatcctccattgttgtaacacctaaagatatgacattaattatcggtacatcctccggaacaaaaacctcttttagaagatcaacatgaaaaaaatatgttacggggaaaaaaaaaattggcgccaaaaattttaggcgggaaaatttcattttctaattacctgttctcatacgatcagggtaatttgatcattttgttcaagagaaatgatatttttaaaaatggacaacagagaagggtattgttgcaaaaaagtaatagaaaaattgtagttttgcaaattcaaacatatattttaaaaatatttatagcaaactgtgtgttaaataatatgtattatatcatagaaagagttatgatctgtataagagacgacatgttaagaatatatgatgagatgtgtcaaataaggtttgacacttctaaatatttgaaattttgtttctgcatgcaattttgaaaatattgaatgatggattgcgcacgcaattttttcattgcgagtctaaattgaaaatatagacttcatgcacaggttgaatttgatatatatatttttattttttcctgcaaactgaattttatttatatatgtaattctttacaaaggaagtgtttgagccacctcggctgaattcctgaatatgattggaacacactagttgtgtagataggagaggctaactgatgtgctatactattacaatggttttttgtgaattgaaagacaacagaagaaaacatcaaagcccaataatccacatctcgaagtaaactaggtaattcacatctagtagtcttgccattgatagcattgatgagaacctcgcaatctccctcgaattgtattcttttgtatcctcttatccaagcttgttgcattgcgaccaaaagagcttttgtttctgcctccagagcggtgttaacgtagctatagttgataatccccatgctttcgctaaggcttcatgatctctaatgatccatcctccgttgctttgagtccttgttatattgaaccctgcatcaaaattaactttcacaaaggaagacgagggtttcgtccaatgtgtattgtagttgatgttgggctttttgtgataggaactcgtcctccctgtctcatgttttcaatccattctttgacttctgcttcagtttgtgcgattatcttcgaaggactctctctgtacttgttaaaaacaaaattgtttctagctttcaagattcaccaaatgagccaaattggcattattttttgttcctttgttaaattattattagaagaagaatcgataagaaaaaagatttttgcttccacatctggtgagaaggaatgtccagttaatattggagaatttgataacctccagattatagatgcgtaaggacaattaaagagttcatgacttattgactcttcttcaatttgacaatggttgcagattggatcgatattcatgcccctggtgattaatcttaaagctgtaggtaatgcttttgaaatagtacgccagagcatgtattttatttttgggattatagaaattttccaaatcttgttcttcaaatccactgacccatggggagctgctggtttaatttgacaatatgtcagatcatgagtgagtaaccaatatccggattttaccgtatactctcctgaaggagtgtagtaccaaattaagttatcctgatgtccttcccgagagagatgaatgcttttgaggtgattgtggtcttcaggacttatacgttgagaaataagattatcattccaataccggtgtaatccgtttatggaaatctgattttccattgatgtatttctatcaggtgtaatgagtttgagaggtctaggcaggtgcgttgcaacaatattgtctttaccaatccgaatagctttaccggttcctacaatatatctgcacccttaattattacgttcaaacccgcaagcatagacgttcacccatatgattgatactttcgagctttcgcatctaggatgttgtcatctctaaaatatcttgccttcatcactcgagccaacaaagaatttggattttgaatgattctccatacttgttttgcaagtaaagcatcattgcatttagccaaatctctaaaacctaaaccaccttccgatttagaatattgtaacctcttccaagctatctatggaattcctcttttttgcattcttttcccaccagaagttcatgagtcgagtttcgatttctgagatgataccaatcggtagtttgaaacaggacatggcatagaccggcattgccatagctaccaattttagcataatttcctctcctgctggtgataaatgtttcgcactccagctcgatgttcttttcttcactctttcaataatgtaattgtacatttcttttttttctgaccaaattgttccggtaaaccaagatatttccctccaccttcatggctttgaatttgtagtatgctttttagccgattttgaatgaccccatgcacctttgatccaaaagttatcatagacttgaccatatttattttttgacctgagtagtattcgtatatgtcaaagacatcctttaaagcttgacaattacgagcattagcttggcaaaagaataaggaatcatccgtaaactgtaaatgagtaactccaggaactccattccctatacgtagcccgtcattatctccatgtgataccctagaattaataagatggattaagatgtcagcacataatatgaaaagatagggagataaaggatctccttgtcttattcctcgttgtggtttaatagtgccgtgtggtatgccatttattaaaactgagtaattaactgatctcacagtgcccattatccaatttatccattgctcgctaaaaccaaatagcctcatcgttgtctcaaggaagttccactcaactcgatcgtaatctttgctcacatctgttttcaccgccatataggattgagaaaccctttttcttacttttaatgaatgcatcatttcatgcgctatcatcacattatcattgaccaatcttcccggtatgaaggcggcttgaggatcagacacaatcgcatcgagatgccgttttagtcgttctactaggcattttgagattattttgtataggaaattgcataaagctataggacggtaatcagagagtgttacaaggtttgttatctttggaatcatacagagatttgtgtggttcattgattgtttcatgtatgatgtcctaaaataattttttacctctttaattacatcttgtcctactatatcccaataagatttataaaacctagctgtaaggccatcaggtccaggtgctttgtcatctccaatttgacttattgcattgaaaatctcacaatcactgaattcctttgtgagatcatcattcattgccttggtcacagttgatttgaaacctgcaaaatcgatagtagaaacaagacggccattgctttcatagatatttgtaaagaagttttgtgcatgacgtcctatatctctatcccctataaaaatcgttccagcatcatctttaatggaagttattatgttcactgaaaatctattcttggtgcaagcatggaaaaaacatgtgttgcggtctccctccttcatccaactatttcgactttttggttgccaatacttctcttcatcattgtatgctatggtaagctttctctgaatttgcggtatgagttgtcgttctgttctcagcatacttgcatgactctgtttagggattattgtagatgtttaatccgggtatgtgaatttaggtttgatttgtgctttagtgatgccatcgcttgtctgcagtttttaacttgatctgtgatctgttttctttgccctgtgttcactctgttccaaccattcttaacgtaatttttgaaatgcggtacgttgatcagcctttcatcaaaccgaaaaggtctcatctttgttgtttttgatttttctagagacagaagcaatggtttgcggttagatccagtgaaatcaaggaattcgagttcagcagatggaaaggaagtcgctccttcagaatttatgaaagctctgtccaaataacatttgactgtgtgagaatgacgctctccaacccaagtgaaacgatctccttttgagcgaatatcaacaagatcgcaagaagctatcatgtttcgaaaatccctaaaagtccactcatctctttgtggccctcctatcttttcacagtttgaaaatatctcattgaaatcactgatcaaaatccaagaatcattgcatgtaagtgatagattttcaaagtgtttccataaatggtgtctttcactttgacaaggatgaccatacacacaagacaagtagaaattgatattattagtagcgatatgtacatcgatatggcgttcatcctgacaaactttggataaacacacataatccttccacaacaaggccaagccaccactatgaccttgtgggggttgtgttattacattagaaaatcctaatacacatgctagattactaacaaagtcacgcttatttagagtttcaataagaaataaaacatcaaacttaagtaatttacataggctactaagacgtgattgagtcatcggcgcaccgaggccctgacagttccaagagccgattctcatggaggctgtggggataccaggccccccgcgcctccgtccattgaaagtggagatgtagtagatgttgcaaagctgactttcttttccttcttgcggatgtgacccaaaaccgccgattcctctgctgcctccgcttgattgtataaagtttcaaagctgactctctttctcttaacaaaagcaaactcattcatagcattgttagagacttcctccaacagccctgcttctctctataccattaaggattcacgtagatgttttgcatgaagatacctgagtctttcagcagtgagttctgtgtcttcaaatgcactaaccatatctgatggaacagaacttgaagacccctcttatttaatgtttgtagcggcatgactctgtagatccggaatcaatgtggtgaaatcaacactaggcagcgactcatctcctgtcatctcttgttcatcagggttattctcatggtggtcatcgtcatttccatcatttacatttgccggttcagcctcctcaaacgccaatgcacattccttaacatcatgcttaagagaaccacacttggtacagaagttcctcaatctttcaaatctgtatttgatggtggtgttctcattcggttggaattgaatattcctctaaaaccaaagcggaccatccatgttccaagatagtttgactcttacaaaacccagttggtttgtgttctcatcaaaactaacatctaaaacataccccaaacggttccctaccgccctagctgatatagctcaaattgtcttaagcttactccctcaaataagagatcgtcattagcacttaagggtcgaattcaactgagctctcaatgttcacacaatagacttatgatgtattcaaataagctagacaaagtaaattaatgtaaagacaataaagcaagtaaacgagttgtagactcaagcgattaaagcatcgggtctaaggaattgtctcgagagatagataaatcgtagatctagctaatatgagggttgttatcgtaccgttctcaaactcaaactatgattttagagtaactagtggtgttccgcgaaactctctatacttagagctaagataaccggagaagtagagaaaccctaaactaaagcatgcattatatcaagtttgattagttcacctagtatctaaaccagagtccttctatgagcctacatgttctttcttaaatgcctaggctcatctatgatagttcaaataacaagtacctatggtgggcatacctattatctgatatcaagttctaggtgatcagtgtaaaactagcagtaagaataagcaagatgaagaaccctaaaaataaccctaaggggttttcgatctactaatccatctaaattcgtattaagactctttaaatccaacaagatgattactcagagatgataaccgaaacacaaatcataatctgaatagtttgcattgatgaattaagagtaaagggtaaagaagttcagaatcctctctacagggattgagttcttctctccaaaagtgtatctcaaataataatacaaaacttcggtctaacaatgaccaaataattaggtatattcgtgactaaaaacgtgtagggactactttgcaaataagaaaaacttcagggcttctcaaagacttggctaaaaatagaaattccctcagccgaaataagggtgtcgatcgacataggtgtggtgtcaatcgacaccatcgcgtgaaaaacgtctttgataatcttcattactgaaaagcttccattgttcccagatgcgtaagtatactgaaaatgactcaaaacatacgaaaaagactagaaagactctaaaaaccattctgaaactgtgttagaaataagtaaaaaccaggacatatcactagccattgcattagtcaaattgagaattggaataccttggatgtgaacaactgctaaattccataattagctcaaacaaatctatattttaacaaccaaaaatttacaaaaattgaaaaaagaacttcctaaatcaactcaaattaataactaacttacttaattaaattctttaaacattttttgttttgttataaatatatggcataacctaaaaagcctggaactaaaccgaaaccaaaaaaccgtaatgttgtaaaaaccaaattgtcgccaaaccaaattatagacggtttctatatggtgttagtttttgtaacaccaaagaaaatgaaccaaaactgaaaaggaaaaaccaaacacatagttatataaaattttcatacaactaaacaaacttgaaaataatataattttaaatatcattgtattatgtatagaatgattaaaattgtactataaacaatcaataatccaactttaaataaataatatttaagttttacttgtgctgctcaaatatagactatgatctagtatactataaattaatcaaatatcataatcctaacattattaatttttagaggttctactgtatttaactatttatcattttgtttaatacgagtatacgagaacacagattgtgaacccaaaaaagaaaggttcacacctattactagtctacaacctttgaagccattcgcatccatgtgagagcatatagaatattcaaagaaaatagttgacttcctttcttttaggatctcgttctttacctgtcattattgtacattccattttacaatcacttcttgcgttgttaattatgtcgtctgcacacacataaacacgactgtgataacataaatattattaccactttaacacctaaaaacaagataattctttttagggttgtatacacatgccgaaccaatgtttctatgttttcttagatgttacatgtacaactgaaaaattatgtctttttcgttgttaccaatttctttttctaagaaatattctctcaaaactagttgtgtctccaatattatccggtaaaagttctaaaacgggatgcctgacagctttcgtgagacatctaattgatatgttgatgtgacatgcattacccataatgaaatgatattttattaaaaatgtaaagtttagttgatataaaagtacatgttgtggctaaattgtctaggaaataatagtaacgtttaaaaaaagaaattatcaaaatagataatgaattcaaaacaaaacattgcaatagtgtttgctactaatatcatttttgagtgctgacctggactggcgactccaaaggcgatttagttttttattttatttttcttacacgtatgatgtcggcggcggtaaatccgcctccagttgggttggtttttgagtcggaaaaaggattgccttctctggtagccgagggtgaagttgttacgagtcatttcgcgagctcggagagtttggaggttttggaggtttctcaacagggagatttaagggtactagaaactttggcaagcgttgggatcgagaaagagataaaatagaattcaaacaaggaggtgggtgtaacccggtggttacaacttcggcttccagttcggttgcagtgttgaaaaaatcatgggttcgcgctgctacaaaacatcttttcacgaaacaggaggttgtggtgtctaaggttgatggtaaacaaggagtggtggtgccgaaagagatttttgcagatgcaaaaccggtgtgggaagattttcttgtagggaaatttcttaatgcatcggcaccacatattgaaaaaattcacatgatcgtgaacaaaatatggagacttggagatactacttctcttattgatgtctttgaggtcatgagactaccgtaaagtttagagtttggagtgagtcgatgaggagaagaatattaactagaggcatgtggaatattataggtatcccaatgctaatatcaaagtggactccatttgctgaggaggcacaacctgccatgaagtccattccattatgggtgacattaaaaaatgttcctccttcaattttcacagacaagggtttggagtttctatcaagtgcggttgggaaaccagtaaagcggcatccaaaaacagaggcttatgttagttttgaagaagctcagattttggttgaagcggatctcactaaacatttaccaaaggaatattatattactggtgaagagcaaggcaagttagatgtagtaaaccaatacttttatccatggttgcctccacgctgtggcaagtgtaaaaaatggggcatcaaactgaagtttgtcttgcagtaggggtgaaaatactacagcccaccacgggtgaaaatactacagcccaccacgaaaaaaacgtccaagtagaaatagtgaaggaagtagagaaggtaggagatgtttccgttaaggatactgagaaggtaacccaaaacaaaactctatcatcgatgcaaaaagttgatgttgaagggatgggagacaaggaggaaggtactcttgaaattgagcaggatggaggatggattactccttctaagactggtcgtagtccaggaaaacagatcgttggtctaaaatatggagaggtttccatattatctaactcttattcagctccaagtgagaaggtagcggatgaggaaaaaagtgaaaacttagaagatgatctccatgcaaatagcagtagtgataatgaacaacatgaaactttaaatgcaagggctgcagatgtttcagtatattcggtattagcagagaaggttgtgcaagcaaaaagggaacaaggctacgaaagaccgaggtcttcctccacgcaacatctccctcgagactcaaagtcaactcataaatttttcccaaaccgttcatctaaatatgctagggatttccctagagacaggagtaatggttccacacaaaatctttaaatgttgagcttcttctggaatttttgtggtttaaataaaaggtcaaaacactctgttgtaaaggattgggtagcaaaagcaaatttagaatttggatgtcttcttgagacacgagtcaaagaaagaaaagcggatggagtatttaaaacagtgtttccagattggtcatttctgtataattatgattctcattgattaggtcggatatgggttgtttggagttcaaatgtgagacttgcccctgttttcacaagcggtcagatgattacagtatcagtattaatggaaggcatggagaatgaatttttctgttcattcgtttatgcttccaactttgtagaggaaagaaagatattatgggaagatttacgtgctcaccaagcttctcctctgttttttaataaaccatggatgatttatggtgattttattgaaacactaaagattgaagaacactctctgtctcagaataatcctttaatcaaggcaggaatgaggaattttcaagatacagttcgatactgctctcttagcaacatgaagtttcatggccctttgtttacatggtgtaataaaagagataatgatgagcttatctgcaacaaactagaccgagttctagttaatgatcagtggattttggattactagcaaacatatggagtttttgaagcaggcggatgctcagatcatcttagatgccgaatacaattgggggctgagaagccacgcactcgtaaacctttcaaatttacaaattttctcgcaaaggatcccgattttttgtagttggttgaggaccattgggggaacacaaatgctctattccattctacggtggcgatgtataagttctcaaaaaaaaattgaaacacttaaaaccaaagataaaagctatgggaaaggataagcttggtgacttgacgacaaaggcaagggaagcttttgcacaactctgccaatgtcaaaaagatactatgacgaatccatctcctggcgccaagcgaaaagaagttgctgcttatgctagatggtcacatgtttctgcactagaaagagaaatttttgaagcagaaatcaaagctacaccggttaaagattagagatggcaacaataaagtgttccataaagctggaaaggttccggagatcagaaatgttgttaaagaattaatatactcggatggcacgactcttgacacacaggaggaggttaaaaaggaggtagaacgttattttcacgagtttctaggctacaaacctgaaaattatcaaggtatctcagtggagggtataacaaagctaatataatattgttgtcgagaagcagatggggaaacacttttaagggatgttacagaggaggagatccgtcgtgttctgttttcaatgccaagtgataaaagtctgagccagatggttacactacagagtttttgcgagaaacatggccggtaataaagaatgattttgtggtagctgtctatcttttttctctacggtttcattcctaaaggtgtgaatactactatcttagcacttataccaaagaataaagaggtaaagcagatgaaggacttcagaccaatttcctgctgtaatatcatctataaagtcttctctaagcttattgcaaatagattgaaagtcattctcccagattttatcactatgactccgtctgcttttgttaagaatcgcttattgatggaaactgttctcctcgcatctgaaattgtcaaagactatcataaagattcagtctcagctcgaagtgccataaagattgacatttccaaggcatttgattttgtgcaatggccgtttcttctcgccactctctactttgaatcttccatcaaaatttaccaaatggatcgagctttgcatatttatagcctcattctcggtccaaattaatggtgaactatcaggcttgttccgcaatgcaaggggtttaaggcaaggttgttccttatctccctatctgtttgttatatgcatgaatgttctttctcatatgctggacaaggctgtggtggaacgacaaataggctaccatccaaaatatcataatctccatttgacacacttgtgttttgtagacgatttgttggtttttacatatgggagaaaaagctcgatggaaggaactctcaatatcttcatacaatttgcagaaatttcgggactgcaaattagccttgagaaatcgactttatatatggttggggtaaaagcgagcgataaggaagccatcctacatgcatttccttttgcttatggtgctctacctgttcgatatcttggtctaccacttttaactaagagaatgacttcaaatgattatactcctctcatagacaaaatcatagactgaattggtaaatggacgacaaggcacttatcctttgcaggccggctccagcttattagttatgttattcagagtctcactaccttctggatgtcttcttttcatttaccaactgcaggcattaaggagattgacagattgtgttcggctttcttatttggtcttgagtggagttaaacgctaaaaaggcaaaggtggcattgagtgatgtatgtacatcgaagcatgaaggaggattaggccttcgttcactaagagaagcaaacaaggccagttgtctaaagctcatttggagaattacatcgtcaacttcactttgggttcaatggttacacttatatttgttgccgaaaggttctttttggtctattaatgagaactcgaccttagggtcttggatgtggaaaaaactgctcaaatacagagagttagcttctggttttatcaaaacagagatacaaagtggaagatcaacttccttttggtttgataattggtctcatcttggccgcttgattgtggtcacgggacagagaggttgcatcgacatgggaatatcacttcatgccacagtttctgaagcagtaatgcaacacaagaaaaggcgacaaagagttgatatcctaaaccaaatagaaaaagccctagaaggctctcgttctaaaaggctcatcgaaacagaggatatagtgcgttggatgggaaaagggaacatattcaagacaagattcagcaccaactaaacttgggaaggtactcaggaatcaaagcctaaggtagcttggtataaaggtatttggttttctcacgccacacctaaatactcatttctagcttggctcgctcaaaaaaatcgtctaaatacctatgacagaatgcaaagttggaatgttggagctgatcgcacttgtgttctttcccaagaccctctagaatcacataattatctgttctttacatgtccttattcagcagagatttggtcgggcctcactcgaaaaatcctctcctcaaagttttcaacctgctgggatcctatcatcaagattatctcagacacaactcttaataaagaaaacttgttcttgataagatatgcttttcagcttgtagtaaactcaatatggaaagtgataagtatgtattttgcatgttttgagcatctatttgtcatcactttagcatcatatcatcactgttttataccatttctcatcatttgtcatcactttacatgtttaggataggtttgcatgcatgttgcatatttgtgttgatttcaggtgatttggagttgttgacgagctaattggaagaagcggacctgatcatgacaaatggctcgacccagaggtcgagtaggagcttcaagatttcaagagaccactcgacccccatgtcgagtagaagacatcaccacatcacctcaccactcgaccacgaggtcgagcgtcttcatctccatcacctgatcatcactcgatcacatcactcgaccctgaggtcgagtgtcttcaccgccattacctgatcatcactcgaccacatcactctacttggaagtcgagtatcaccttcaccaccactcgactacaccctcgatggcaagtttcagagtcttcttcattccgcactcaaccagacactcgagcacaaggaagaaaagaagactctagttattcactcgacctcccactcgaccacttgggtcgagtacagttcttaatccgtcccaatacttcgtcgttttgagtattagggtttcagaatatttggctataagtagcatgtacttcacattttcgcagacaagtttttatctagttttattccgcagaccttgtgttctagaccttttgtaatccggatttctctttatctatttagtattcagtattcagcttttgttcttgatttcgtttactgttgttcattctgttatcatcctgctgttacactgttgttatcatgttttcaacttgtttaacgtttatgctttctgttatgatgtctgagtagtgaataggtttctgaggatgggttagagtagtgtagaattctcagtatgctaggtgattgagtattgattgatagatcccttctggattagttgttcttaatgtctattgctttctgatcaactggaatttgagccgagacatttccgcgtccaaaaggttttcgatgaaatgtctgaaccactaattccagagattcgtgaccctgtaccatggtattggttgcagggagcgttttggctttaacttgttgattcgtaatgcctgttaggttagctctcgtcaatggtgattgagtctgggactaggttaacttgagggtctctgttgcggtgacacttagatttggttaatgaacttgttgtctagggttaatttattgagcatgtcaatcacctgtaaactgagaaaacgaaactactcaattaccccatcctcgggaattctttatctgattgaattctttgtttactctactgttgtttactgcatcttgttatgtgtcgcttaatttatgcagttctttcttgttactcgacctcatattcgaccacccagttgtctggcaacagactatgcagtcgagtatctgtgttttattttctgtctgttactcgacctgtcactcgacctcacctagtgctctgcaaagagctgtgttggtcgagtgttttattgtttctgcttgattttctgttttctgcatgttcactgttagaacacaccaaaacctgttattgcttggcttgacttagtgacttctgatcacatcttgattgttagcatcacacccatttggattgacaacctgcagtattacaacgacaagatagtgctttaggtttaattgattaaaaacctattatcagaaggaaagaaatggccgctgacatggaaagcacctattccatcaactcagctcatccacaaaatcgataagcaagttcgaaacagaatctcatccattaaagagcaaggagacgggagatacgatggttgtatggtgaaatggtttggttcgagataattcatccacttcaatttgttttaatcttttattttcaaaatttgtatattaaccacacgctgcatctaatgtacccacgttttcgaataaatttttttaaaaatatagtttttcctacttatttatatccgtgttataaaccggataagtatggatgtgattatccatctctcatctctgtctataagatatggattatgtttatccattacttcctccctaagatatggattatgtttatccattacttcatccctaagatatggatgatgtttatctattacttcttctctaagtaatttacttcctagctaagtaagctctactatatatagctcatttcattcatttgtaagttacagagaaaacagagagaaagaaaagagaaagagaaagcaataagaaaactcttgtttcgagttttattctctctagtattcattcttctttcttactttgatcttttataacacgttatcagcacgatcgtctctccgggagttatctaaccaactgatcgtctatttgatcaagcatcttttgaggtaacatttaaattatcttaaattcatcttaattcatttataaaaaattatatgctttatattttcggagtatgaggttatacctcctccttaatcgaatggtaagctatgcctcttcgaaatgccataaatggctcattaattgaatgattatttatttctatagataatcatgtcaaatctagctaagctcgatgtcgttgcccttgatgtatctggtaaaaattatagtcatgggcatcagatattaagatgcatcttagatcaaatgggtttcttagcaccataaatgcatctgaaacgacatcagatgagagcaaagctaaagccatggtatttctacgccaccatctccacgacaatttgaaaaatgaatacatcacgagagaagatcctgtggatctatggtaatcacttaaagattgtttcgatcatcaaaaatatgtgattttgccaaaaaccagacatgaatggctaaatctccgggttttggattacgaaagtgttggtgattataattccgccatgttcagaatcacctccaagatgatattatgtggtcaaaaagtgagcgattatgatatgattgaaaaaacgctctccacctttcatcttggaaatgtaatccttcaacagcaataccgggccaaaggatacactcgttattccaagttgatgcaagtcctttgggttgctgaataaaataatgaactcgtgatgatgaatcatttatctcgcccacctggatcagctccacttttagaagtgaatgttgctacatccagtgatgataattggcgaggacccaaaccttgtcgaggtcgtggtcgtgggagaggtcgtggtcatggccaaggaaaaggaagaagtttccattccaatgatttcaacacggaaaaaaacaacaaaaataatgttggtcgtgttaagaaaaggcatgttgaaagcacttgccacggatgcggcatgaaatgacacttctaccagacgtgtcatataccaaaatatttagtcgatctttatcaagcctcataaaaggcaaaaaaaagggatgttgaaactaatctcatctgtgatgagtcggaaccttcctttaatggccaagatgatgatagtcatcttgatatggcagattttctcgattaatcatgacaacgagaaatcaatgtaatatattatagccatatgtattatcatgctatgcatgacaagcattatagatgcttttgtaattctggaataatgttatatattatgacatatggatagtctatgtcaaagtttcatgaataaatattttattccagaaaatatgttatgacatatggatagcctatgtcaaaatacgagattgaggatgaagatatatgtctggcggacagtgcttatacgcacactatcttaagagataaaaagtacttctcctctctcaaaataaaagactccgctagaagcgtgagtactataaatagccatgcaaagataatattaggctttggcgaagccaattttacaatgccaaggagaactcattttaaagtaaatgatgcattatattcccctaagtctcatagaaacttgataagtttcaaagatatccgaagttatgggtatcatatagagactatgaataaagatggcattgaatatctttgcataaaatccgagagacaatttatattagaagaattgccaatgctatcttccggattatattgcacaaaaataaatatcatcgcatcaaatgttttagtaaactcgagtgtcacactacactcaagtgagtttactagtacatttaagatatggcatgaaagacttggacatcctggttcagtcatgatgcgaaaaattgtgcaaaattctaatggccatccattgaaaaaccagaaaatatataaatctggtgagttttcatgtaaagcatgttctcaaggaaaactcataataaggccatcgccaaacaaaattaggaatgaaagatttgaattcttgtcgagaagtcatggtgatatatgtgggccaattcacccaccgtgcgggccgtttcgatattttatggtattaattgacgcatctactagatggtcacatgtatgtcttttgactacacgaaacacggctttcgcaagattcatttctcaaataatcaggttaaagacacaatttcctgattatgccataaagaaagtcaggcttgataatgctggagaatttacttcacaagcctttaatgactattgtgtatcgatgggaatcgatatagagcatccgctccctcatgttcataaacaaaatggcatggccgaatcattaattaaacggttgcaactcattgcaagaccgtgaatattgagaacaaaactcccaatttctctatggggtcatgctatattgcatgttgcggctttggttcagattagaccaagcgcagataatgaatattcccctttacaaatgacttatggtcaagtaccaaatttatctcatctccgcatttttggatgtgcggtatatgtgcctatagcaccgccacaaagaacaaaaatgggtctccaaagaagattggaaatatacgtcggttatgtatcaccgagtataataaggtatcttgaaccacaaactggtgatttgtttacgacacgttttgccgattgccattttaatgaagatgaattcccagctttagggggaggaattcatcaaatgcatatgcataaagatatagaatggtgcgtaccatctttaaaatatcttgatccccccccccacgaagcatcgtgagctggaagtacaaaagattgtacatttacaaaatatggcaaatcaattaccagattcgttcaccgatacaagaaaggtgacaaagtcatatatccccgctgcaaatgctccatcaagagttgaaattcctagtgagctggaattagatgggagcaaaattaatgaacctaaggttcaattaaagcgtgggaggcctattggctgaaaagataaaaatccctgaaagaaaaagaaattgggaaaagaaaatgaaaaggttcttcaagaagaaccaagtcctcgggacgatagagaaaagtatgagatttccattaactatgcccatgatggtatcatatgggtagagatgatattgatgatgataatggaatattcttcttttctttatctaaagagatcgatcaagagaatgatgatccagatccaaagacattatccaagtgccagaaaaggccggattgggagaaatggaaaaatgtcatgcaagttgagttgcactcccttaataaaagaaatgtctttggacctattgtcactgcatctgagagtgtaaaacatgttggatacaagtgggtattcgtgcgaaaaagaaatgaaaaagatgagatcacacgatataaaacctgacttgttgcacaaggtttctctcaaagaccaggagttgattatgaagaaacatattctccggtcatggatgcaattacattcaggtacttaatgagccattcggcatctaataatttagatatgtaccttatggatgtagtgacaacttatttatatggatcgcttgataataatatatatatgaaaatcccggaaggattaaaagttcccgaggcattagactcatcaaagtctaaagatatatatggtcaaattacagcgatcactttacggattgaaacaatccggacgcatgtggtataatcgtttaagcgattatctacttaagaaagggtatgtgaataatgaaatctgcccttgcgtcttcattaagaaatccctttgggattcgtgatcatcgctgtttatgttgatgacctaaatataattggaactccaaaggagattgatgatgcgcgaactcatatgaaagaagagttcgaaatgaaagatcttggaaagacaaaattttgtctagggctccaaattgagcatttccaagatggtatatttgtgcatcaatccaattatacaaaaaggattttaaagcgctttaatatggataaagcgaatcctttaagtactccaatggtcaatagatctttaaatgttgaaaatgatccatttagaccctgtgaggataacgaagattttctaggtcccgaagtaccttatatgagtgctatcggtggacttatgcatcttgcaaattatactagaccagatattgcttttgctactaatttgcttgcaaggtacaattcatcccctacacgaaggcattggaatgggataaaacacatcttccgttatcttcaaggtactattgattttggattatattatcctagaaaacccgagtttggtctagttggttttgcagatgtagggtatctatcagaccctcataagtctagatcacaaaccggatatgtttttaccattggaggaactacaatctcgtggcgttctcaaaagcagactatagtcgccacttcatcaaactacgcagaaataattgctcttcattaagcatctagagaatgtgtttggcttagatctatgactaatcatattcaagaagcaagtggattagtcatcaaaagagagccaacaagaatatatgaagataatgctgcatgtgttgctcaaatcaaagaaggttatatcaagagtgacagaacgaagcatatccctccatggttcttctcctacactcaagaactcgagaagaacaaggaagtagaagtgcaatacattagttcaagtgacaatgcagcagatctattcacaaaggcgcttccaacttctacatttagaaagcatgttcaaagtattggaatgcttcatctacgagacctgtgaagtctcttcgagggggagctcacgtcactgtactctttttcccttgtcatggtttctatcccaatgggttttccatgataaggtttttaacgaggcagtacgtaactcatcaaaagtgatggatactcaagggggagtattataaaccggataagtatggatgtgattatccatcactcatctctatccataagatatggatgatgtttatccattacttcctccctaagatatgaatgatgtttatccattactttatccctaagatatggatgatgtttatcaattacttcttctctaaataatttacttcctagctaagtaagctctactatatatagctcatttcattcatttgtaagttatagagaaaacagaaaaaaaaaaggagaaagagaaagcaataaaaaaactcttgtttcgagttttattctctctagtatttattcttctttcttattttaatcttttataacaatccgatttttatagacaaattacttattttgttcttataaccatgatatcaggtatgcgccgcaataaacaaaaaatacctaatctactatttttcttcaattgaaacgtaggctaatttttgaaatgagaaattattattcaaaataacctcttttctaagttgaatttgtcaacattcactgtgtctcaagctacacatcacgaatatataaactgtaatagcatggtaaaaagataatcaaatatataacgtacgagatgttgttgtagcgagcgattacaataaatatatggattagttagacttagataaataataaaattttggttcaaatttgaccaaaaaagaagagagtagtaaatttgtaattaagcgagataattttattgcgagtgatatatatatattgtgttatatttggagataaaatgtactattgaaatatatagagttgtaaaatataatgtcatcgaataaaaacaactttgttttgacgggctataaacgacactgttttgataaaaaagaataagcacaaattatatttctttttttttgttaaagggttaagcaaaaaatatatttctctaaaataaaaattcgtaaatttgaagatagagtgtttaaagcttacatattgtgttatttcatgtgaatatattagtttgatatatcaatacatttaggttacaactacaaataaaaggaaatcgtaagaggattgcaacgaaagacaaaagatttcagatacaagaaaagagaaaattagaatgagaatatatatcgacacaaaagataagcaaaccctttaaacgtagcagagtcttttaattattttccagatatgatttcaccaaaccaagtcctcttgcttcttttgacttcaaccgacgttaatcactgaacgaatattaaaccaactaaaccaagtcgacatcacggtaaaccagtaaaattggatcactccattaacaatacctataaatattactatgtgtttagacagatttgattctggttagttgcccttcacggagtagaaattaagtcaccgttattttaataacaatgcagatatgtatttaacctatgtagaaagcacatgctcaaattcacgagactcaaaccatttaaatccaccgactagtaactaatgctctcaactttaaaaaataattttcacagaataataaacgaaattttttggtcttgactttaatttatagaatatttttaaataaatagatcaagtaacacgaggacgtcaaacaaaacaagcctacatatgaagaaataaaagcagccaacgaaaccacatgggaaacagatccacccggaagctcaccaatttccaccgacactaattttttcttaaaataaaacagattgtttaagattagatttggcaaatataaattgctaagaaagttttagccgtaagaaatatcgacagaaaattcgtacatatacttttttgttagaaaatacgtacataatcaaaaaggtaaaattacaaaaataataaatttactacgatgtttaatatgaaacagatgaaataagtgatagtaattatatactttttatttttttattctcttaactcttttgtttctgattagtaacaaaatttatttcatatcaattatgtaaataatatttttcaaaattggcttttttaagctgtaaataaaacctgattacaataaaaaaagattagtaagaaaattaacactgtttaattttatttttttgggtgattaatgttggaaaagtttttatacttttgataataatgttgtagccatttgtcctttctttttactcttagacacccttgtagcattaataacagtccgtgtttataatgaaaaacatcaataattttaatttgtaatttaaagttcaaaccacttacctactcaaattgctcactaactataagatgaaaaggaaatttattcaaatcaagaaaacacgtagaacagggtaacaaagtttgatttcctaattataagatgaaagaaagtttggtaatacaaaaaaactgctaaattacaaaaattaaataccaaaaatctgaacgatggttgtgaaaacagtcaatgcggttttacgacgaaattaactaatattacttcgattaattagattattttcttgaaaaaataagaattcaaattattcttcacaatttaagtcaacgcagtaatttttttttaacttgtatcaatgtatttaaatactcaaatatttatactactattttttttttgttggggccaagtctatgaactccactcgtctctccctcgacgcacttaaatttacataactaagtgtgtgtctattcatatcactcactctctctcttcctcacacttacattctccctctatttttttttctctctctccacaagaaacgccgtcgttcattaaaaatgatggcggtgggcagatccggaggcaccatcctattgttctgcctatcattcttcgccgcggtaaccgcggagagtccataccgattctttgactggaatgtaacatacggcgacatttacccactcggtgttcgtcagcaggtttttcattttctctactccactcacatttcatttcatgttagtaacttgatgttacaaaaaaaaaaaaagaactctttgtttaactctttacgtatagactgcatattacttctttacttgtgaaaaaaaaatgtatcttcgagatgatttttgttccttaaagtgtatcatttgtgtaatgattggtttaaaatgtgcagatcaatactttataaaataagttactcttttttatattgtgacaatgaaggttagatccggtgaactgaattaatcgatgatgctaattgtttttttatattattggtatatgaaaaatagggaatattgattaatgggcaatttccgggaccagacattcacagtgtgacaaacgacaatctcatcattaacgtacacaacagcttagacgagcctttcttaatctcatggtaacatctctttttttcgttatttggaactacttactttgtcctctttgccttctgtggttatatgttgttgacttgtcgaagttgaatagttttttttttttttaacttgaataagaaaatacctttattttttttgtttttatccattttttgtttaaattgtttttattttgaagaacctaaaccaaataaaagatcttcatttcctccattagatattattatctactatcatctccgattcactaagaccatgtgtactaatatgtcaactgtaggaatcagatatttactttgtaatctagattgttagatcacgaaaatcacggatagaaaatttatgtatgtaaaactgaaatggaaaaattaaaggctcatctagcaaagaaaagtctttaaaatgcctgaaaacagttttgtttttgcttttgctgacaaaaattaaaagataaaaaaaaaacttttacggctgataacgtaaataaatatttgtggaaatgcgcactattacgaaagcaaagcatgtgaatgttataaatgtagacttggggcaacttgaaatggtccataatgacgtatgtggcatacgtctataaacaattaccgaaaatctagtaggagtattaaaacagtttcctaagaaagactaatcaaagataactaatagtgagactgggttttgccattaatcgggtggcaatcaattctttattttttcaatagtatgcattctactttaacaaaaaagatagtgacatcaagtaataatgatactaatacatattactatgttatatgtttttgatattactaatatagatatatataaatttatcaaagtagatatctgtaaatattataaaattttttaaatatttaaatatttagatatttaaaaatttattaattaaaataaataagaaaatcaattatttaattaaaaaaatcgaataattaaaatcattaatttttaaaatatttgttttctgtccattcctaaacattagcgacaataatatgtatatattttcctttttttaaaaaataatagtacgattttatgatgaaacaacaatgataacagaataatattgctctccacattttgccacgtctctccctaatttactagctgtcttccaccggaccacccctttcggtgaacaatgtcggcgatgtcgtcgaatttacgttgtcttttagaataggtcccacccacatccactaactaggccatcttcatgacatttttcataactaacaagaaaaggtcacaaagggattgaaattattcaatgcacatgctttagttttaccttgtagtatagagtttctaaagttttattatagtatagatttttaacgaatcacataagataaaaacaaaaaaaaaatagaagtgtgtgaattatattcgttttttattctaatgaaaaaaattggatggacaggaacggagtacaaaacagaagaaattcttatgttgatggaatgtacggaaccacgtgtccaattccaccgagaagcaactacacatacattttgcaagtgaaagaccaaattggaagtttctattacttcccatctcttgcctttcacaaggcagctggtggattcggaggtatcagaatccttagccgtcctggaattccagttccatttgctgaccctgcaggagattacactgtcctcattggagattggtacaaatttaatcacacggtaataatatgaatatatgatcctaaacaaatatacaccttttcaatctcatgcaaacggttttttattttattttatttttaactcatgcatgcaaacgttattgataaaaatactcacaactatttgttttttgttttacaggatttgaagtctcgtcttgatagaggaaggaagttaccttcgcctgatggtattcttatcaatggccgaagtaacggtgctaccttaaacgttgaacaaggtgtgttagcatttgatgtttgtcaatctcctacaatttttgtccttccaaaattaaaaagaaaaacgtttttttttgtgtatgtggttgtaataggaaaaacataccgattgaggatatcaaacgttggattacaagattctctgaacttccgaatccaaaaccacagaatgaagcttgtggaagtcgaagggacgcacacacttcaaaccatgttttcctctcttgacgttcacgttggccagtcttactccgttctaattactgctgaccaatctcctcgtgactactacgtggttgtttcgtctcgattcacggataaaatcataaccaccaccggggttcttcgctacagtggctcgtctacccctgcttctggtcctattcctggcggtcccactattcaggttgattggtccttgaaccaagcacgtgccatcaggtacttatctttcttgcatatgtgattaagtgttttatgctcctctccaataagtgctatgaataatttttctttcgtagaaccaatttgacagctagtggaccaagaccaaacccgcaaggctcataccattatggtcttataccgctcattaggacaattgtgttcggtagttcagccggacagataaacgggaaacaaagatatggtgtcaatagtgtgtcatttgtgccagctgatacccctctaaaactggctgacttcttcaagattagcggtgtctataagatcaacagcatctcagacaaacccacatatggaggtttataccttgacacctcagttttgcaagtcgactatcgaacctttatcgagattgtattcgagaaccaagaagatatcgtccaaagttatcatctcaatggttactccttttgggtggtcgggtatgtctgtctattttcacgctcttcatttattattttctttgttttcttacgagttaaacaaagtgtgttgtggttggatcaactgcaggatggatggtggacagtggaagacaggaagcagaaatggttataatttacgcgatgcagtttcacgttccacagtccaagtgagccctttttttttccccctttcattgtcaaattaacacattgtgttttcttgttctaattataaacattatccatttacgggaattcaggtgtacccaaaatcatggacagccatatacattgcattagacaacgttggaatgtggaacttaagatcagaattttgggcaagacagtacttgggacaacaactttacttacgtgtcttcacgtcatctacgtctttgagagatgagtaccctatcccgaagaattcgcgtttgtgcggccgggcaagaggacgacatactaggcctttgtaaggaagatatacgagcttacgtgaaattcgtcatatccatacacgtttaagtatttcttgggaagacttgcaaggttacaaacaatgagagaggatatatgtagtaacaatctagtttgacgtgatctcagctcgaggtctaaatttttatgtaattcgaatttgaagttccagtttttctttatatgcttttgtcattcatgttcttttaattttctttcctttttctacgaagttataaacttataatattaattgaattttactcatttggatcattatgagtctatatggtaagacattcagccagattcagaaaatctgcagtcaccaattccataaaactaaattaatctgttttttttttcttttcttttttcttacgtcgttattataataaatcaaataaagagaatacataagagaaaaacagagcatggtagaacaatctattacaaattcatgacaactaatcttttcttgaaagaaaattcttcattccaagttaaagcttccaactccgattgtagagggaagggcacctccgaagacactttgcaccaaataatattctatgattattctttgaaccaaccactgctaagtgataggttttacttgttttatttagtcttttatcaaagaacaaaccattcttcgtgtttataaggctttttaggaattc

SEQ ID NO: 192 - DNA, 134499 bp, Arabidopsis thaliana
gaattctctttcagatttttattacacaagggactgtataatttaagtttggtggagggttcaagacatgttgaacattgtgttctcttttcttatttcaaattttgcatcatctaaggcatagaaaaaccatacaaatttgaaaatttttcagaaaatgatttcatcaaaatcagagtgtcatgtagattgcatttcattttaggattgtatatagagtgtttgcgtttaggattgctcatttgcataggggataatgatgatttcaaaccgataagcatgttttgattcaatgaagtaagttcaatgccaaggttgttagttctctattgcataaccgattgtatctctgaagtaagaccgcaccctgctttgaatttgtaacttgactatactactttgatcgaaactcgcttatctgatgccattccctatctattagaacctgaaatgaatttgaaattatcatgtttatgcattgtttatgaactcatggctaccatatacatacttggatcatcttattcacttcatcaccctctgttaatccaagtagttgtctctcatttttaaagcagtttcccatacccttagtctagccttatttcaagtcaaagatcatttgtgtgtgattgtgaggtctttttcgattgagcttggtataacgtgttaggatgagccgacaagagtagtctttcatgtagacctagcccacaccttttgggtggagacttgtatttgggattgggaatgtgtatggaatgaatgggaatgagagtgagaatgagaaggaaaagaaaagaaaaaaaaaaaagagtaagagtttagagttctaagggggatacaaaagtgttaagtctagtaaagggtttggaatgtaaagaagttaggctttgtgattcaaagaaaagggtaaaacgccctatgtgctaagattagaagaaaagccttaagtttatcaaagtataaaaccaaacccgctagactcttaaatcgtttcaaagagaaccccttagaacttgaaccaaatagagagaaagaatgacaaaaagggtagagttaggacatctatgggactgggatcatcttctgagctatcatactatatcattgggtagatgggagtctgttcttgtacgtgtccgttggcttttacctttagcattctactgaaactcaatcttttctctgagagtcccctgttactcgaccaaaccgttagagggaccatttttatctcttagcttaagcccgaaatcaagtgagttcatacccattgcattgcttgattcactattcgtgcttaatgaatgttaaagggaattggttgatgtgaatgcttgaatagattaaggcaagttgttaggttgcattgtgacgagtatggctaacgtttttaagtaagggtctatcatcttgcaacttagaattagctacctggacattgagcttacctattctatatgcatttcttcggtttttgaatccccaccttcaaacctctccttcaacttaagtgtttttgtttgcttgagggcaagcaagagataagtttgggggagttgataacactgtattttactcattttaggtgtatgtttatcatgatttagctttgcatttgctcattgtatcatatcattttgcaccattttagcttgttttgcatacttaggcatctaggatcatcttgcattcgcattgcatgttttggtatgttttcaggtgcaaaaagagcttaaaaggactctactcaattcattcactcaatccgggcagctacagaagaggcatcattctactcgacctctttactcgatccaggatgctacaaaggaggctccagtttacttgaccctcttactcgatcaaggcaacctcagaagaaagcagcagactaatctactcgcccctcctactcgatccactactcgatccatttactcaaccaagggtgaccatctctacaagacttgttgagctatcaaagcgtcttcgaatcctcctcattccccactcaaccagacatctgagcatacggataggagaggataaaccatctactcgaccaattgatcactcagagcatatacacaaaggcgcaaactttgcagcaccctctttactcgatccccaagatcgagtattcgcccaaaccgcctcaagtctcttgtcttctagggaatctagggtttccaacattttagtataaatagatcatttggggtttgtccaaaagatctatgtttatctttcagtttttctttgtatttatgaatcttgaaactttaattactcttaatctattttgttttggcatttgattgtttaagtaaagttgtttagcttgtttagatctacattttggtatgattatagtaatttataggtttgtgttcttgagaatgttgcatgagtagtgattagggttcttgaggatggattagattagggtaatctctaggttagttaggtggttagtgtttagatttatacccttctggattcgcttggcccctatgcggttttcgccggctaatgtggagattcgatcataaacgtccagcgtccaaaagacgttcaaatggatgtctgacctacgaattccagagatttgtagactcgaccaagggattggcttgtctgcctattggctttggtagattatttcttaaaccctgctttgcaatgttttatcaacgagagttgagattaggaagtggtagagttatgggggtctctatcacggcagtggattgacccggtttttgaatctatcgtcatgggtatctatctttcgcctattagccatttgatgaaccctagagttgcccttatcaatggatccatccttagaaattctattagatttatttgtatcccctgatgattgcacttttatttacctgttatttgtatcccctatttttatcccctgttgattgcatttaagtttcttaattttgtcactagttggttctactcgacccagtgattgagtagggctctaaagttctcatttttacttgtttgaatcctgacctaggattattagtagaaacccaccatcgttataatctggcttgacttagttgtttctgtacacatcttgattgctagcaatacagtggactggattgacaccctctataactgcatcgacatgtttgtgttttaggggaattgaagtgaaatcacactcttcagcacataagcagacctgaaaaacctgcttatcatcttttctcttgtcgattcttagcaactaaaactcttctcttttctcttgtcttttctctaatccatgagcaacaaaactcttcagagatcatagatgcatcacgttccaacaagaggccatgtgtggatgacgcttccaacaaaaggccgtgtgtggatggctgttccagcagaaagctgcttgaaacggagaaacgtttcaaaggcatcatctctttcatcagatgcaacataaggtagacggaggaagcacacatcttggatctcaaactgcatgagaaagaagcgaaacttaatctcctaaggaaaatgaaaaggatgaaggacggatttaacgtggaggaggagttccagaaagtggaggagtaggtaagcaaggcttataaggagaagaatgaattcaaggtgattagtattgattgggataaactggggtatggatcgacccagagttcaagttttgaatcagatgaagatggagatggatgtgattgtatggtcataacaaaattacatctccatgttattgaattgcaatacttctatgttatttaatccctttaagttatatcttcactttttattttctattagcgtgtgtgattcataatctgtctctctttcacgcgtgtgtgatggcagacttatcttagatgaacttgatgtttggttgagttatacgtgtgtgatggctgagttattctaacgttaaggcggacttatcgtagattaacttgatgtttggttgagttatttgtgtgagatgcctgagttattctaacgttacggctgagttatcgtagattaatttgatgccttgttgagttgttagaacgtgatggctgagttattatcgcacaaatcggaagactggctgacttaattaaaattgacagtacaaggaagatggttgtaaaagcaccaaatttagctaagctcataaatacttgttcaagctctcatactttttctctagcgtttcaaatttttttccataagatcaatcttttccgccttagctaagttcacaaatattggcggcttccagatccttcttcatctcaatcatctcctcttttatcatatcaaactcgtcacacaatgcaacagtccaccatctcttgaaaccgctgcctcgaccggaacccttaaaaataagaggttgattaatagggatacaaaaataaaagaaataaaataaagaatcataactcaaaagatgcttacatctgatattttatacggacaactgaaataaagtttttcgcttgtaacaggatcatgagaagtggcaacgacaaccttagcattgcaatctaactcgatcagaacgcctttatcgcgcctcctgttttcgccgtacctcattctcatccttatttccatacgatcgagctcctacattaacacaaacacaatatacaccacgttaaatggctaacgatttttacttttcagatggtcgagataaatacctcatttccttctgaaaccgttttctcatcaacactagagtcgccgtggaaaagagatctctgtgccatcatcttgtcttcaattagtagggcactaaagcactaaatctatatagtcgtgtatgctaaaaagcactaatcaaacgacggcgtcgtgtattggtgaataaatttagaagtggctgagttataagagctttgcggctgggttatagacatattaatattctttattatatcattatcgagattacaaaaactatttttatggggaaccgccaataatgactggatccataatcacacgaacacgccaatagttaatattcaaaataattcaaacgagttcgaattgattcgaataactaaaccctcaaatattcaaattttcagtttggcggtggaataccaatacgtcacggctgagttatgcctgaagatttcgtggtttgaccgagatatgagaaaccaaatgttattatgagatttaaaactagctaccaaattgttggctcaattagtgtcaacatctataatatcaaaacagaaaataaagtgggttttcactaagtttttgctctgaatctggaactgaaaaatcgtccttagcttccttttccttagtttttgctccaaaatgtctttttatctccattgttgtcccactgcataaaatacctgaaaagacactaaaaatactcgagaaataacataacgactcaaaaacctaaccctaaatcatagataaattagtaaaaatagggatatatcaactcccccagacttagcttttgcttgccctcaagcaaaacacaaaagcaaaacacaaaagccaaacccgtggaagaggttttgaaaacaaaggaactcccaacattctctagcctattgccatgatcatctaaactaaatccacatgcctaacaagtctaatcaaatcctaagcaacatgtacttctctgcaagcttacacaacattctagattccatacctaagttccacaattatatccactggaatttcatcgctgggtctcatcaaacaagctaacactcaagatccttctagactcattcatctactataccatgacaaatcgaccatttttttttctttctttggtgttctttctctttcccagacgtattctttttagagagtaaacaaaggagaactcgcatactggatcgacaccctcggtatttttccaacatttgtaattgatcattccaaataatgtataataatagggtcataggaaatatttctacccctatacactatctgaaaatcctctcaatctctcattattttttattttattttataagaggagatgaacactttttctttatcacattggtctcaatatcaggtatgaaccaggagtcaagatctatgaatactaaccgtttgaagaggtaaacggaagagcagtgagattggctcgagccttagtagttgtattggaaactaggatatcctcaagtctgttggtttgccatctagatattccaatagtcggattgagttgaacctgcagcactcatcaatcatgcaataatcaagagaaatatagatcatgattcctaactaaactaaaaaaaaacattttttttttaattagaaataataagagaaaatgactcaataaactcaaaaactaaaactaataagaatcaaaaataaaagcaatattagtaaaaaccttccccagacttaaacgacactatccccagtggcattcaaatctgaagaaggtgggaaaaagaaataaaaataaaagaaaataaaagaaaaggaaagaaaaaatcaaaccagtggattgcctcccactaagcgcttgttttgagtcaatagcttgactttgcggagttcaagatgtgggtaggatggtggaatatttctgctgcctcctcgccttccaaggcagtgtgaaaactgatctggtcgggcagctgcaggtgtcgatcgacactcattgtggtgtcgatcgacactctcctcgttttctgcaagaacaacaggggaaacaagctttcgagaaactttaggcttgttaacatgtgaagcagacttcgaagaatctaaggaattatcgaaggtaaagcaggagaagagatagaagagaacttatcacagagggccgcaagaggtgtgggctaaaggcaatgtgcagaatcctttgttttgtgaatcccgagggtgtcgatcgacatgagggatggtatggatcgacatcgttgctctgcaactctcattggcgagctgagctggtgggagcgttatgtgtggctctgtctggggattctaaggggtctgaggatgtgtgtctatgctagaggcaatactactaatagtctaagtaaactctgaaccatccatgccaaactctgtctccaaatcacaaactttaagagagatcctacctcccttcacatcaatcctaccaccagctgtagctatgaatgctcttccaagaataagaggatccttgggttccttcttatagtccaggaccacaaaattagcagggattagggagttatcaaccttaacatgaatatcctcaagaattccttcagggattcgtttggaacgatccgcgaagagaagagtgattctagtcagttgtgcacttagcagcatgaatctcctccttaaaacgacgtgtcctcggataagggacaagaagagtgtaagaagactcgggcttcatcgagattcgcgcctcatatggtgcagtccggacccagtgtcgatcgacactagaggtgtatcgatcgacaccctcgtgaggaagtgtttttgaaaataatgttcgatacggtgtcgatcgacactggttggtgtcggtcgaaaccaactctgcagcagcgagctccaacttgtcttcagtgtccaattcttcccaaacatcatctccttctctgatcaagatggcattacagctcttccttgggttagcatcaggattaccaggaagaaagccctcttgtctcgtaatggattgtgcagttgagctacctgtacatctagcttcttcaagtgagagatccaattgttgatcttcccattaagatctatgtagacaacatcaaacttgccattaaactccgtaacgagctttgtttggctctcaagaatctgctcaagcatggattctattctggtctctgatgagggtggatggggggcttggtaaactgaattaccataggttctctggaagttgctctaaggaaatgtcttctagaaagcaggctttggagtgtagtttgaggaactctagttccttgtaaacctgttgccactcaagttgccctatggctgtccaaacttcttgtagccctgagcatctatgtagaagactcccttttctaactcagtctcaggctcaatggtctcatcctcagctgcaaggtggacatgcttcttccctgtaagcaggttgtgaaccgaatacagcttagcatgtacctctgccatttgattacctgaaacagttccaacaatctttttcctctcaaagtcagcattcttggtgctcttactacaagctaggttctctatcagagcagtagcatcaactggatatctcgtgttgaagttaccattgctcgctgcatctagagccatttggtatctctaatcaactccattgaaaaaggtaccaagaagttgtacctcattgaagccatgatgtgggcagtcccgttgatactccttgaatctaacccatgcggctttgaagtcctcaactggaccttgtgtgaaggtagacaacttgtttctcagcttctcagacttagcatcatcatagaaattgttcaaaaaggctatcttgatgcttctcaaactcttgagggaacctattttgagttgtttcagccacgaagcagaatctccagcaagtgaataagggaagagcttgcacagtaggtagtcctctgagactccattaactttgatgctcagaacaaagtcttcaaaatgctcgatatggtccattggctgctcatgagacaagccatggaaaggatgctggcttactaaagtaaagtagccaggcttcagctcgtaattgttcctctcgaagggtggggatacgatcgctgatcgattagcatataacaggtgaggcctgttgaaacccccaagaatacgacgtggttccacagctggaggaatagctgcagaaatctgtggttggtgttgatcgacccctctgttgtgtcgatctacaccgatcacgtctgcattctgctcctgaaggtgtcgatcgacacctagttggtgtcgctcgacaccgagccctgctgcgtctctagcagctaattgcgcattgaggcgcgccagatcctcattggcgtcctcaggtaggatgagtgtatgatcatccaatttctgaccagcctcattgtaggcttgcccatcctcatctctcaaaactcgttctgcatcagctcggatgactctttcagccattgctaaccaaatatcactagtatatatataattttaatataatttttaaataggtatttaaagtaataaactttttaatataatactaattaaagatctaaattttataacattttcaacaagcaatctccattcttcatataactaatatattttatatattaacaaataaaattaaaattttctatttcatgactcaattacacacatgtatatatatgaggtctattagctgacaaaaaattattaatatatgatgaaattgaattaataataagtattattattatttatatatggacttttatgttttgtacgtatggattaagataaacaaaatttataatgtatgagaatataaaatatataatataacatatagtttttctttataatatttctattaaccaaattgtaagagctatatatatatatataatacggttcaaattatcctaagaactactccctcaaataagagatcaattgtagtatttaaggatcgatttccacaaagttcttttgttcacacaatgaattcaatgtcgagattaagctagcaggataaaattgaaagtaaaagaatacaaagtaaaaagacagcagattgattggttgtaaacgatgaaataaagagataggaacagggtattcttaggaaactattggttagtagatctaatgaaagctaggttgttatcgaacaattcttaaactcaaactctaattatgcaataaccgatggtgttccgcgaaactccctatgcctatagctaagaataactggagaagccgagagatctttaacctaaacatgcattctaaacgagttcagttgttcaccttagtagataggccaatttttattacacacctataaaccaggctcatcaaataatagatccaactacaaatacctatggtgggcatatctatttttctgtattcaagatctagttaattagatctagcattaagaataatcaaagatgaagaattatacagataacctaacaggggggcgatctacgaaaccatatgaatccctaatgagaaacctattcctaataagtaaactacccagacatattgaatgaaacaaacaacatatttgatatagaaagcataaacacagcaaataagataaaggaaaaaagagatctcttcactgtctttaaaactgaatgaatctctgaagaacaagggatgaatagcttatgtctctaaaaaaaaagggttttgcaaagaacttgataaaagaaaatttaggtctaaaaataatataatacccctataaaacgtccacggactaataatgaaaatggggaagtcttcaggggcaaatttcctcttctgtaaacttggaagcgtcatggactttgctgggtcaaaactggtgtcgatcgacaccaggagtgtgtcgatcgacactcctctgaatctggaactgaaaatcgtccttagcttcatttcccttagcttttgctccaaaatttcttcttatctccattgttgtctcactgcatagaatacctgaaataacactaaaaagactcgagaaataacataaagactcaaaatcctaatcctaaatcatagataaaatcagtaaaaatagggatatatcaatatatatttatttttttgatagaaagactttttaattaattattttaaattcaattttattatatatatataaataatttaccttgattgtggtattgacatatctcccgttgagacaatatctctaatataactagtttgaaaatttcattccggttcaactgcttgaaatgtattatctttggcttgatcttagtattggtgtctgttggagctggatttccctccaggaatccacctgcgaaaatagcaagccagcccacaaaagcccaccaagcccaccaagtagaggacctacgcaactaatgagcccacatacgcgaatgggtacttgggccagataaacccaatcacctgatgaagggagataagcgaataacaacctaggaactgatgaggagatattcgcggagcggacctgatatctcggaactgacctgccgaatatccaggacgatctccgcagatcccggacggagctaccacgtgcgtagacctatataagggagcaaggacaacttggaagacacattcaattctgcttatattcacacacatacttttacacttgtaatctcctttcacattatcaatacaaaaagtccattcgttcttagcaatataactctcaaggtttctgtgaagatctagccctcctttctcataatctcaattacaaatctctagtgtggatttcagaacccacatttggcgccgtctgtggggacagaaatagatcattccaacaccgtaactaacacatcaattgtgaccaacgatcatggatcccaattcatccaattcatcgggatctggcttaccagttcagatcccaaacgatgacgttacggacgggcacctcccaacggatctccctctccgaaccagggttgatgctgtccataacgctgatgcggaggacatctcccaaaactcgaattcttctggatctgaccaaatcactccccctccgcaaacaaggggcggagaacaaaacgtcacgatacaacctccaaatggagataacccggtcaacccgtctaatcaggtccctccgcgacctgccagcgaattggctgagctccgcgcaatgatcatgaacttgatcaacttaaccaaaaaccaagaaattgcgcatcgcaacctcgccgcaattgtgggtcagcaaagatgcgactccactcgcttgggacatgaggtagagcgcgataccgcgggtaaggaagttcccaccccgcgaaactaggattcctgcccagttcccatagatttgacaggtaccgtctccccgaccgatcctactccaaagactcgtctagacttcgcctcgatagacgtcacacctcctaacaactggcaggtcgctttcttaaaacaggattctgtacttatcgaacaaaggacgtctgaagccgatctctggagtctcactctacttcaaaacgaatcccatcgatcttacgttgaaaaattcaaagcaattaaatcgaagattgcgaacctaaacgaggaggtagccatagcagcccttcgtaacggtctgtggttttcctctagattccgtgaggaactcactgttaggcaaccaatctctttagacgatgcccttcacaaagctctccacttcgccaaaggcgaagaggagctcgctgtgctggccttaaagttcaaagaatctaaaacgcaaaatgctcctcttgcaattaaaacccccttcaaaaaggaaaaccaaacgcaagggcagcataccttattcgcaatagaagaggcagctgaggacgagagtccagaacttgacctcggaaaatattgcaagtaccacaacaaaagaggacattccaccgaggagtgtcgcgccgtaaaaaaattaatcgcagctgggggcaaaactaaaaaaggttcaaaccctaaagttgaaacccctcctcccgacgaacaggaggaggagcaaactcccaaacaaaagaaacgggaacgaacactggagggaggtgactctcccccacccgctaggagagaacgcatagacctagtctttacggaactcgatctaggtggcaagacaggaaggtcagtcaccacacctccctccgccccgcataagaaaaacatgaggtttccattacgcctctcaaaattctgcagaagcgcaactgagcacctctccccgaaacgcatcgatttcatcatgggagggtctcagctctgcaacgactcaatcaattcgatcaaaactcatcagaggaaggcagattcctacacaaaaggcaagagcctgatgatgggacctgaccacaagatcacattatgggaaagcgaaaccaccgacctcgataaacctcacgatgacgctattgttattcgaatcgatgtaggcaactacaaactctctcgtataatgatcgacacaggcagctcagttgacgtactcttttacgacgccttcaaaaaaatggggcacctcgattccgagctgcaaggcagaaaaacgccacttaccgggttttcttgtagtcgacaagaaagctcctttcaacgcaatactgggaagaccatggctacacgccatgaaagccgtcccatcaacctaccaccaatgcattaaattcccctcggaaaaggggatagcagtcatatacggcagccaacgcagctcccgaagatgctatatgggcagctacgagcttatcaaaaaagctgaactcgtagtactaatgatagaagacaaactcgcggaaatgaaaacagtcagatcctctgatccttctcaatgcggacctcaaaaatcatcgataacgcaggtctacatagacgaatcagatcccaaacaatgtgttggggtaggtcaagacctcgacccagcgatacgagaggatttcataacctttctcaaagaaaacaaagacagcttcgcctggtcaagtgcgaacctccaaggaataagcctcgaggtaacctcacacgaactcaacgtcgatccgacctaccgacctataaagcagaaacgtcgcaagctaggtcccgaaagggctaaagctgtgcaggatgaggtcgatcgtttgctcaagatcggatcgataagagaagtaaaataccctgactggctcgccaacccggtcgtcgttaaaaacaaaaacgggaagtggagagtatgcatcgactttatggacctgaataaggcatgtcctaaagacagtttcccactaccacatattgaccgactggtcaaagccaccgcgggacacgaactattgtccttcatggatgcattctccgggtacaaccaaatacttatgcgcccagatgaccaagaaaaaacagcttttattactgactgttataaagtaatgccctttggtttaaaaaacactggagctacttaccaaagattggtgaacagaatgttcgctgaccaactaggtaaaacgatggagctctatatcgacgacatgctggtcaagtcagctcacgaaaaagaccacctcccgcaattaagagaatgcttcaaaatcctaaacaaattcgagatgaagctaaacccagagaaatgctctttcggagttccctcaggagaattcctcggatacctagtaacccaaagaggcatcgaggccaatcctaagcagattgcagccttcatcgacatgccatcgccaaaaatggcacgggaccggccgtatcgccgccctcaacaggttatttatcgcgcacctccaggtctaccgataaatgcgtctttttctatcagctcctccgaaaggataaaaagttcgattggaatgaggactgcgagcaagccttcaaacaattgaaagcatacctgtctgaaccacccattctcgcaaaacccgaagaaggagaaccgttgtacctgtacacggcagtctcctgaaccgcgataagcggtatcctggtgagagaagatcacgaaggacagaaaccgatctattacgttagtaaaacgttgatagacgctgaaacccattatcgagcaatggaaaaactagcactggccgtagtcatgtcagctcgaaaactgagacaatatcttcaatcacatcccatcgtagtgatgacgtctcaaccaatcagaactattctgcacagtacaactcaatcaagtcgactagcaaaatgggccatagaactaagtgagtacgatatagaatatcgcaccagaactagctttaaagcacaagtcctagccgactttgtaattgagctcccgttagcggacctggatggaaccaactccaataagaaatggctcctccacgtcgatggctcctccaaccgacagggatctggagaaggaatacaactcacctcccccactggggaagtcatcgaacaatcgttccgactcggattcaacgcatcaaacaacgagtctgagtatgaagccctcattgatggcattaagctagctcaaggaatgcggatccgcgatatacacgcccatagcgactcccaactcgtcaccagccagttccacggggaatatgaagctaaagacgagcgcatggaagcgtacctcgaactagtcaaaaccttgacccaacagttcgaatcattcgaactgaccaggatccccagaggagaaaacacctctacagacgccttggcagctctcgcctccacgttagatcctttcgtcaaaagaattatcccggtcgaaggaatagaacacccgagcatcgacctaacagtcaaacacgctgggatggaaacctcggcaacttgcaactttacgcgagtaacccgaagcaccaccgccgcggctagagccctcgcagcagccgcagaggcaggtgcagcggaggaagaggccaagctcagaacccctgaacaacttgcctcgtacgaacctgaaccgtacaacgactggagaatcccaatcatcgattacatcgaacgagggatcacacctcccgacaagtgggagaccagaaaactcaaagcccagagcgcaaggtactgcatcatggaagggagacttatgaaacgcagcgtcgcaggtccctatatggtgtgtacctacgggcaacaaacaaaggacctcatgaaaagcatgcacgaggggcaatgtggtagccactatagtggacgtaccctccgctgcataatgctagccgattgcatagctcattcactcaggtgcgataaatgccaacgacatgcacctactcttcatcaacctcccgaggaaatgtcctcgatatcttctccttacccatttatgaagtggtccatggatgtcgtacgtcccatggaagcctccggtgggaagaagagactaaaaaacctgctggtcctcaccgactactctaccaaatggattgagggtaaagccttccaacaggtaaccgagaaacaagtcgaggtcttcctattggaaaatatcgtataccgacatggcataccttatgagatcgtcaccgataacggactaacctcacctcgggaaaaatcaaagcattttgcgacaagtggaagatccgccttaccacatccaccccccctgttacccacaaggtaacggacaggcagaagccgccaacaaagctatacttagcaacatcaagaaaagacttgattccaaaaaatcaatgtcatccgacatgctccacagagttctctgggcctaccgaactacaccttgcaaatcaacgcaagaaacaccgttctctctcgcctatggtttagaagcagtaatccttgtcgaaaccatagtaccaagcgtgagaaggacgccagtcctgctaacaccggaacacgcaaatgttagaggacaacagagacttcatcgatgaacgcagagatcacgcaatgatccaagttcaaaactatcaacaacctgccgtccgctactataactccaatatcaaaattcggagattcgaagtaggagagctcgttttacgaaaagtgttcagcaacacgagagagctaaacgctggaaaactgggaactaactgggaaggtccctatcgaatcaccgaggtggtacgtgacggcatctataagctcgtaaaagttttcaacggagtacctgagttacggccttggaatgccatgcatctcaagaaataccatggataggtactcaaaaacaatcaaactacgataaggcttgatcccttggcagggtacgtaggcagctcccccaagagcgcagccatcacttcaatcgaattacaaaagggcttaatcccctaaccaggtatgcaggcagttccctccgcaaacgcaattaccatctcaacctttccatttgaaagacgaaacttcaataagaaaaacatacatcacatcttccatcaacgaagatcagctgctcacctgacagttcaatcacccttcggtatcgagcagggacctgctcgatgatcaaacgccagatcgtcgcttgctttacctctttttgtacttaacaatttcgagagaagaataaaagaaaattttgatactcattatcatgtttcgcaaaacaatcatttacactatgatttaaaactcattcgtaatcttacgatacccaaagcccaacacccgaatgttggcggatccattttgtgatctcgcttctaaaacgtcgatagtgaactagacttataaaaacacatcactttggcttcatcggagctcacctactacaaccatatctaactctttcgctatcaacacataacatagtaaacaaggaagaaacgaaggtttcattcgcgacttggcgataccaaaagcccagctcccaaaatctggcaggtcccttgtgtgacctcacttcaacaggttcccgagacaaaacaactcaaacttactcaaagctttaaccttcgaagaacatatcatatcacatccgaaataacttggactcgaaacaagtccaattattatctggaacatggacaaagcaaggtgatcatacaccaaaattaacgaagtgtcaacactcgaatggaaaaccaaaaaatacttgctaaaaaggataaaagccttggcatccaagtacttaaacgaacaaaggataaaagccttcccaggcaccaagttcaaaaagcaaaaaacgaaaggataaaagccttccaggcattaattctgaaacaaaacacaaaatcctaaaacaaacaaggagcgaaagtgatcactccctcgattctccggctgacgtagcgaagacagtaccagaaccctccgcgagacctcccggaaaagcgtctttgttgctcccgaactcatccaagccaattggcgtcccttgctcgtcgacgtccatcggacgtaccaccgaaatctctaaaacctgcgggagatccaacttgcttagagtaaagtctgatacctccttcgatttgtaccgcgcctctaggtcatccagctctgcttgcagccgaggtttctccacggtcagatcgatagcagcctttgtgatctggtcgatcaaagccaggttcgactccacctcggccgcttgcccctccagcaccgtgtactcctttttggcgacccacttctccttgatcccagccagcagcttcgaatacgcagtagccagctcaaccttagcatcgtgaaccgccttcttcgcaccttgtgcagtcgaagtcaggtccatcacctttttggagagctcctccctcctctgctccaagcgatgaatctgcctccggaatagcagccgcaggttccatcttctcctctctgagggaggcgaccccctggtcgctcacgacaaactcagccgccagatgcacctccggctgggtccgagctctcttcggagaggacggtgcaccatcaaaatgaacaactgcagatggcccagacacatgagcgacctgattgttatctgactgacctgctgcagtagaggtcccggtattgatcttaagaaacgagggatgagacactgaggcagatgcgttggagacggctagagtgtttcagccgcggacaccatggctgacagatcaccagtacgagcaggagccccgacgttggctcgttgaacacgaagacttggacgcctcattcttctaatgagcgggagttctgaagtggagctggagtcaggaggaattgaacagacaaagcacaacatgtgttagttagcagctcgaattgcgcagctgtctcgataactcgtacattttaaaaaaaataacagaactcgtacctatgggcagattagcctcggggctcggttcaatccgcgggacctctttgatcggatctagctgtgctgcaggaaggacgattgcatgaactgctagagctacgggagctgctggaactacggcaagagcagctacgatgcgatctctgctaaaagtggcccagttagtctaatcacgtcggagaagggttaacagctcgagttccgtcttagagagagtaacttccttggtccttgctgcaaaccattaaaaaaaacattagtttcagtactaactttcagcaaaagcaatcaaggattcgacacaaacaacaacaaaaaaactcaagaggctcaggtctccatctgacccaggttggtagaccaggtcctcgttattctcgcaggatcaaagctgtcgattgaatgacgatctactctgaagaagaagtacttggatcgccaattggtgtctcgacaagccttcaaactacctaggaccaggaatccgggacgaccactgatgtagtacgtcccctggtcgctcctagcattggtcttgacctggcagagctgaagaaggtcatggcagctgaattatcccgagcccaggtgaataacgccagtacatggcggacgaagttcgggcacatctggggaaaggcgaggccgagacagtagagcatctcgaagatacacgccggaatcgggaaaaataggccacatttatcgaagaaattagcataagcgcagcaccacccgaccgacacgttctcaggatgcagcggcggccttgggagtatcatagttagcccccccggaacctggcatctcctccggaggtcgaccaggtcgctgttcgtcatcggcgtgcctcctccttgcttggcagcctttttcttcttcggctaatcggctctggttgatggcggacgaattggacccatttcgcctagggttatgacacgtctttgtactgtggttgcttttattctgggaatcttcgaagtcgctcatcgttgggtttcgacagaaaaggacgagagagatgaaagaaaagagcaaaagagggcagatcgagaaagaggggagtactagtagagaaacgaaggagatagcaaaagaaaaaagacgagatttttctatctttacaaaacgaaacacagtaaataataaaggaggagagaagttaccttgacagtcgtgtgagttgttgtgacgtcaagtggagagatgggaagttatttaaagccgtcatcaccatgattttcgagattgcagagatctcttctccgcgcctgatctagaccgtcaaatgcggtgcgctgaagagacgctccatctcagtcgttcacatcagcaacgacttatctcgcgtatctcctcgaaatctttcggttaaggaatctgaaatcaaatcgttttgttgagtttatcctcaaaaccgactgatcttatcacatctatcatctcatcaagaatattttcgcaatcttacctgacctatatgtccgctcatcgagttcgcctactcactcaatgggctggggggcaaatgttggagctggatttccctccaggaatccacctgcaaaaataccaagccaacccacaaaagcccaccaagcccaccaagtagaggacctacgcagctaatgagctcacatacgcgaatgggtacttgggccagataagcccagtcacctgatgaagggagataagcgaataacaacctaggaactgatgaggagatattcacggagcggacctgatatctcggaactgacctgccgaatatccaggacgatctccgcagatcccggacggaggtaccacgtgcgtagacctatataagggaacaaggacgacttggaagattcattcaattctgtttatattcacacacatactcttacacttgtaatctcctttcacattgtaaaatctttgtcattatcaatacaaaaagtccattcgttcttagcaatataactctcaaggtttctgtgaagaactagcgctcctttctcgtaatctctattacaaatctctagtgtgaatttcagaacccatagtgtcaatgctcaaactcctcattgtgagctgtccaaacataaaagttgggttgaaaccctctattatacgaatgtttagatacggtagctatagaaataagttctctatttgtacattttcgacatggacaccatattcgacccccatcatataatcgatagtttgcaaattccatgaattgacttaacccggcttcatattcgtcggatacacgtctagtgcgtggattaatacgattatatatccactttcttacgatttatatattattgcttgaagacattttttgttacaaagaagaagataatagaatagaattaaaggaaaaaaagagatggtttactcaaatgcaaaattttagaatgaatatgaaagaattttttattttttgctagatatgaagaagagagaaaacgaagccaaagattcgaatgaatatataacaaagaaagaatgaggcagcgtaacgatctgggcactgtctcggagagaggctcggtgaaatagacatgtctgtgaagatgcggactaccagcacctggacagaaagaccctctgaagcttcactgtccctgggattggctttgggattggctttgggcttttcctgcgcagcttaggtggaaggcaaagaaggaagccaaaaattaagcaacaacttggtggaagatcgacaagacacctatcaatttgctagaataagactgccacaaaagatgtggccttgtaatcaacttgctacaattacactgtcacaacagtagtggttttggtgaccaatttgctaccgcagaaagagtggcctttggtcagagatagggtcagtcacaagttgtcataattgctacgaaagaaattgtgagtctccacttcgtttctagttgcgaccgacacaattgttacaaagtttaaacaatagtaataatcttattttgtcacaaaagcttgtggcgaaacctatttttgtgaaaaattacaacaacaattttgatactaatcaactttgttgatatcctttattgtcatcaatcgtcgctaatagctacaaattgactagttgataatagtcgtaaaacgttaattgatattctattcaactatttttacaaaatcggcgacgaattttgttttgtggaactttgcaacaaaattttaaacacatttggtaacaaatttgttacagaaaaatttgtctcgcaatatgtagctaatttgctacgggttgtaacacattagctacattgtttattaaatcgcattctgttcttagtcgttaaaaatgtagctatatggtctaggaagaaaactcgtttgtttattcatgtatatatgtaaatttattatcgattttaatccttctgcattcaatctatttcatggtggaagaagataagcgtgatgtttttggttcacatgatattagtattcaatcgtgattaaatatatattcatctaatctaaaatagttgaaagtatatttgtgatccaaatcaaacaatagcgaagaagaaatttgtagaagcccaaacagaaaatttcattaaaactaatcatgaagaaatcaatattcattcgaaagaaatctaatctaaaatgtttgaaaagctatttgaaagtcgcaattttttttaaaaaagttcgccctagctatttctctctctagcacaaccttcgaggagtcatgttccgacggggtcagctcttgccggcgttgctagatctagatttttgttttgtttttgtcacccatatctaatgatcttgctcgtctcgtattatgtgctcatcggagattcacccctgagatctttctccttcgtatccatcattttgtttgctcctcatagtgtcgtcaatgttgctttctcttcttccgtcaagtttcagaccttgccgacgaagaccctttggatttggatcttgtcagagacttcttctgtgaagaccatctgctaccttgctctcggcgtgaactctttgggtacgttaggcttggttccgcctttcttgtccccaagtgacacgtacgtagccttccgtactacggtatgcagctcctgttctagtcttgtcttggtttacacttgtacaaggtaccacgataagactgaccaacaacagcttgccgtgacgtccctctccgacaagttcgtgtccttccaagagcaatgcaacggccagctcgcagggttggcggcgaaccattctaaaatcagatcagccaacaacgcgtacgcggagcgagtcaattcactttctgcaggaaccacgcggactactggagctcgaacgcgactcaattttcagggcaccatcagcccgagtgtccaaaattcaaaggaagcctctgaccagcagactccgccgccctcggttgaagtcgggacgacatcgactcagaatccaaccacctcgtcttcaccagcaggatttgccgcagtttcaaatgagacaatagctcggacgctagttccacttgatcctgccatcagactaccaatctccgatcctcgacaagagccaagcgcagtcaattcggagcttcaaagccttcaagatcaaatctgggccatgaacgcaaaagtccatcaggccactacttcggctcccgaagtggaaaaggttattgaggcaacgaggagaacaccttttaccccaaggatctctaagttgcgtatccgtgagttccgagatttcaagcttcccgtttataatggaaaaggagatccgaatgagcatttgacttccttccaagtcatcgttcgacgggtccccctagagccatacgaagaagatgctgggctttgcaagttgttctcggaaaatttgtcaggacccgctctcacctggtttacccaactggaagaaggctcgattgacaatttcaagcaactctctactgcgttcattaagcagtacggatacttcattaagagtgacatcactgaagcccatctttggaatctttctcaatccgcagatgacccacttcggacgtatattattgtgttcaaagagatcatggttcaaatacctagcttatctgactcaactgctcaattcgcgctaaaaaatggtctttggcatgagtcacgcttccgcgagtctttgacagtaaaccggcctgagacgattcaagatgcacttcattgagcaacgaactggataaacgcagaagaagaacgagcttttctagccaaaaagttcagtgcttcaaatgttgcaccaaaggcgcctcaacccgtaaccaccaaaaaacccgccgagccctgaaaacctacagcaggaactttttccgttgagaaagaatcatcgaagtcctctcctaaagcttcaccgtccaaaccacctttctctcctaagggcaaaaacggcgcttttccgagtaacaaatgggtccaagatctgaatgcgtactgtgatattcataagatgaatggtcatgcaaccaaggactgcaaagctttgggcagattgttagcggcgaagtacgcgtcaggagaaatttccgaatttgacatcacaccgatcgaattggctcagaccgcgaacgaaacattagaatcagaggaagcttcacctccgagcaagaaacagaaacgtgacccagcccttgtaattcctaaagggccgaagaaaatggtcaaagtgattatgggaggttcaaaactttttcgtgattctattagcgcgataaagcagcatgagagaagaactgtcactccgatcgcaaagaaaccaaaaacgggtcaaactgattgtcccgagatatcctttactgaggaggaaaccagcagacgattactatcacctccaaatttgaatgcgtttggatcaattccctgtgctcgccaaatcgtttgtcgatgcaaaagcactgctcgtgaactacaacatcccaacccttgtctacgtgataattatcatcttgaccactcatcggacatttgagaaatgtcttcttttgatcgccaataagacgttctacaagctcaagctgtttaccacaaaaacagatttggggaacaccaaaatcaccatcgtacttggaaggatcatcggatcgttcctctgatgaagaaggtgacaataactaagccgcattatttgctacatagccaaacacatgaaaatcaaaaggggataaattccaaaatataaaccctaacatccaaaccctagatctttaagaaaatccaaaatccaacccctagatatcaaattatcataaacggcaactctaattcctttgcaacccataattcaatggaattgggggaaaatcaaaaccctaatttattttctatccaacccaaaacttaccaatgaacttggacaaggcggctgatgcgaaagattcggcgtcggcggaggttcgtcgtgttgttcgtcggcggaggttcgttgtgttgttcgtcggcggaggttcgtcgtcagagaagagagaaggagagaagaaaacttttcgagagaagaaaggagaagaaagaaataaagaaagagagagaaaagtttgtaatttaatgagatgagaaagattttttgaattgaaattgaaatacatagtgtgaacacatagtgtgaacgcatagtgtgaacacacaatagttattatgataataaaagtggaatgcgggcccagacaaaatactgcgcattagccatagttatgtcataagttattcagttgtcccgtactcaatttatttgtactttgtgaaagttttagtatttagagttggacttcattaagggaattaacttttagttggacagatgatataatatgtttaataataagatatcatgttttagttatataattttccaaatatatgcgttttgccatgtttatatcaagatggtccaacatgatacaatgcataccatataatgtaagaagtgttttttgaattgatgagtataatatgttcaattgttttttagattgtatgataattagtataagtgattaataaatgttctagaataatgtataaaaaaaatttccaagtatgaaactttttctttataattatgagaaaaattaaaaaattacctcctttttaataatatcatattttagtagataaaataaataaactgtatttgtctcataaatagtaaaaatatatataaaaaatacagcttcttaaaaattttcatttaatatattagaaataattatagttttaattaaaagtagagagaggtgtatttttcatacaaaaaccataagtttttcatacaaaaactcatatttttgatataataaaaatatttaaattaaattaaattgaagcaaatttaagtaaaaaaaaacaatactaaaattatatttctttcttatatatataggaggggttttattgtaagagataaacatgaaagaactagtacaacggtacaagtacaaggtacatacataataacacttaacaaaattccaaagtacttaaaaatgaagcaatagttcagacgacacaattacacgatacagacataacaacacaatacttaagaaaattccaaagtacttaaaaatgaagacataatacatgaagcaatagtacagacagcacaagtacacggtacagacataacaacacaacacaaaatacacatttaattatgcgtcggactcctcgggctgcaactacgcgttgatattaatcccaggctgaaacttgttgttagtcctctttctacgatgttcccctgttgatggaaaccaggtttcttgatttctccccggtttagttgtggtatctggcggtaagactatcaattgtcttatctcatcaggaataatccaaactgatgaatgcgggactggataaatggttctgtagtatgccaatatctacgtattcatatggtaataatgcgaagttaggtcttccatttcgagaccatctaatatctattcggtccccacaaagtgtcgggcagcggcaatcgcatgtacacacgggtacttatcaacatcaaaacgtcggcaagaacaagttttccttagcaagtcaacagaataagacataccaccttcgccaatgacgctgtattgacgttcgaagctgttaagctcggtcaccggcatcgttttcgcaattgggcataaggagtgtatttcgttctccacaaccggcacaagaccccttgtttcagaatatttaacagactccttcctatgtttgttaaaccattctgaaattttctcaattatcgcatcaaacaaaggtaaaaggaagtatttccttgcacgctcaaacgtactgttcaatgattcacacgcattgctcgtgtctatgttatacctatccccttcaaaatagcacctagcccaattttccacaggagcccatcgatccaaatacgtaccgacattaggaaatcttctcctaaatcgagcatactctcttgtgaactcaaactgagtataaacatgtgtgcatgcaatgaagttagccgccgcttcttccttctcagttttcactcgtactttaacgttttgagactaatgtcaaacacaatggccatgtctcgcgtttggaaacacttgcatagttgatttgatgatgttctgatgtctatcactcacaaaaaccaaacctggttcatcttgtataactgttttcagcttgttaaagaaccacgaccaagtagcatcgttctccctatcaattacagcagacgcaatgatataattgtgatgattaggatcttgggctgttgcgaaaactagcttaccgccgtatacggtcttaagaaaagtggcatccacaataacaactttcctcataactttaaacccttcaatgcaagcacccaaagcaacgaataagtacttgaacttttgttgtgcatccacttccacatatgatattgtcccgggattcacctcctttaatacgtgcagataagagtacaagtcggtgtagcttttttcaggactaccacgcacatcactaacgtgttgtcttttccctctccatgcggtagcatacgagcaatgcaaacccattctttcccgaacaatactcattatgcttttagatggtggagtttgaaactcacctggataatcctcatgcaaaatagacgcgattaatcgtggtgtgtcggtatgtttacaattgcctgagttcttattagaccgcttgcatgtgtgcatcttcttgtgaactctaacactaaaacaatctgaactctttacttttgcacatcgtaaataccatcgacaacctgttgttttagattgccgacatcgtaacatgagtcgctgtggatctgacgctatagttgcggtcgcaaaacaatacttatttgcagctctgttaaccaaatcttgcacggcctccttagaaacaaattcttggtgcaattcaatccccgttccatcttcccattccgtaacactctgacttttctcactactctgacttctttcaccaacacatggaagctcataatactcaattctaccatcaacaccattatcttcagcaacatccatccggctatccacatgctccctatcttcaataactacattctccatagcctcttcaaaaacccggctatccgcattctcaatagcctcttctacactattagcctcttcaataatcggttcatcattcacacaattacctcctgcagtttctcctctaaaaatcgtcactactccaccattctccacatcaaatgcattcaactcctcataattaacaccaactgaacttcttctctctacccttgaaatttgttccacccactcagattctttatttactacctccacgttcaaagctggtctaattcccttagcattcactaccgttagataacctaaaaagtcatcatcatctacaatagatgtctctctctgagatgtgcatagaatataactcaatttcaccttccttgaggtttcatctattccaatcttcttgcatatcttttctactaacatagagtatgttacctttgacgtcctcaacaatacaccgcttaaagaattgtttgaaatccactcatgctcttctgagtaatacccattgtcaaattgtatgaatgtgtgcttgttcttcatcgtctcctgtaattacaaataaattataaaaacacaattacgtaatcattcagatttagacataattgtacctatattataactcactaataccatttgtaccacctgtcctattgtatctcaataaaacacttgtaccgcttatactattatatctcagttttaccatttgtcccagttcgtcaattctggctttcacaaatcgtaaatttcgattgaacactcactaaactctctaattcaaaacgatacaacagcccagaatgaacaatacaacaattttatgttattaacaactaactccaacaagaaattcacattaatctacaaatcaaaacgaaatcggatttacttttgtcgttgaagaggaagctcactttgggagcagattatcggcttggaagctacggcgatctcggaagctaactcgtcggtgaaattagagttcaaatcgccggcaaaatcggagctcaagtcgccggcggcgaagtcggagaaaatcacgtcggaagtcggagaaaatcgcgattttggtaacggccgtttttctttttttttactcaatgatttattctttattttgaaattctccttcagttattcattaaggagagagatgtaattgcacatggtcgagtggtactcagaataaaagatggtacgccaaaatagtttttccaaaatggtggcagaatagaacgtggctcgtatttactcaacatgtggaccccactaaaaagtattttgtctttttgcggcagaagatactcatagttgtaccattgtaccatcgtattcatagttgaactttccacagttttcataatttacagttgaactagacggtaaataattaattataagttgaacacacactttttctctattattttgcatttccaaagttttcataatattacatcggtaaaaacttggttttcacctattttacttcatataaggtgatcatatactaaatgttccttatattagaaggggtgttttatatgaaaataacattgttttttagaaaatattaaattttattgcatttatctaaaattatttatttatagcttgggatattcgtatataattttacatgtataataaattatcaatttaaatttttttaacattttagcgttacttagttgaactagttgaattaattatattaaatgttactacgaaaacaaaaaaaaaagacatttgaactagttcaactaattaaattaaaaattaccacggaaacaaatacatacatgtttttaatctaatccaataagttgaaccaagttaaactagttgaattgttcatacaaatccaagaaatacatattcaaaacacacaaattatttttttcatgtgcaacaaattctacaagtgatatcccagacatagccttattcttcctctggcgacgcttttttctggttgatggaaaccatgtttcttttttttaccattttttggtgtataaattcaattggctctgtcgactctggaaaaaccatctctggccgggtcatccatttcggcagacatcgattctccggtgatgcgtcttcctccgtcgatattgttggatcaaaatctaaatcgatatctcgatatttacttcgtcctctctggaaacgttccttttttagagataccatctccggtctactcatatatttcaccggtcgccttttcctccgtcgcagcgtcttcttttttttacaagtgccttgtttgttacactctatctttaggtctcgattgaagaaagtaagtgaacgaaacgaaaatagttgtttagatatttgcaatggtagtcagtacaatgtagtaattgaatcgtgttgctccccaaatcaatccatagttgcagaataaatggtacaactgaaattggttcaattgatctagttcaaatggttcaactgatctagtacaaatagttcaactgatctagttcatctggtttaatcggacgagtttaactgatatagttcaaatggttcaactgaatgagttccaatctatttttccggcgtatggtaccaaaacattagttttattaagtaaatttgaaaaataccttctttatgagtttttatttaaaaaataatctatcctatattttctaaaaaaattatttttaatatataaaattaataaaataacctcattataatttaatataactaaaaccttaaacagaaaaattccataaattaatatttgatttaactataatttaaatgataattcttatcttaaatattttaaacaaaattttgtccaaaataatatatataaatatatataaataaattttattaagtgataaacttcaaaatatatttagatattaaattgttaaactttaatataaaagatagataaactatatttatttcaaaaatagttaaaaaatttatcaacaaccaaaacatatttcgaataatacatatctttcgaatttatcaatagcctaattctttttggaatctattacttagatttcgaatttatttaattttaattttttttcttctaaagtttgaattctgtttttatttattaagaatacagcttttaaatttagataaaactgttattttacgtattaaattatagtgttatttatattttgggccaggttatttattttattgggcttgggtcggattattttggttgaatttgtagtttctatatttttgaaaggttatttggacatttccaccagttttgattaaaaaaagaaaagataaataaaattatagggaaggggtagcattactgatcattatttcggagaaaatggcattcctgccatttattcgctcaatagagatagggagagagatagaaacaatagagatttcagtgaagatgaattctttaaaagaaaccttaaaaaaaaaatccggtttttatctcaaaaatcatggaaaaagggtaagaagtgatcagaaaagaattgatttggagagatatgaaagctttttgttccattgttgagaagtggagattgattttgagatcctcggaaggttgcggtttctatcgaaaaggaaaaaaccttctcttgtaaaattatttttttgtttttgtttaaaattaaaattaaaatttacttgtttaaaaacttaaaagataaaaatttaaggcttaagccatgtatcatcagatggagagggctacagctttttataattaatatttatacaatcctctgatgttgggcttggacccataacaacatgggctataaataaatgtcaaataattatttcagatcaatagagtaaatcttaatcgtctcgcaggttttctcatctggttatttatgttaaaccaaacttaaactattcaaaccgtccggttagatttttaattaaagtgttgttcgtttctccattcacataaattatctgaatggagatgaataatgatatccgtttagtgcaatataacagagcagtcataaagatcagttgaataatttttaataaaatcatttgaaaaataatcgaaatcagactgaatctgatcggaccagctgattcagttcaaaatagaaaatgtcataaataccccgttttaatttaaagattacattcctaaaactgaatcttcttctcttttcattcttttgacagtttatctcttcttcgccgacaactcaagacatagacaacacagctcacttcaccaacccattctctcgtgcgccacttcgttggccgtttctctccgccggatctctatctcttgtcggatgtcttcttcgctaacttgtttcttctccaaatatttcattccctcgtgcgtgagtttaaggtaagattcatgggttttgtattgagtatttgatgcttataggctataatttttcatgggtttgattattggattcttatagtttcatgggttttcaagtttttacttcctgagtcgattagctaaagattcatggcattggcttctgtttggcaattaacgagttcttatagtgaagactgtgaagatcttaattgctctaaaagccttgaatactttgatgttctccgagattagtctatgtagtttcatgtgtcaatgttttttttgtgtgtagtaacttcttcagggtttatttggttgtgaaaacctttgcgctctcgaaaaatgattcttatgtcatgtgtcaatgtttcaaaccttctagttcagtgactcttggttccagattcgttttggtggtcattgtctactcttttcttttctcttgtggtaatgtggtttgagttctttgcagataagagatatcttctgttgtgaatattacaaacttttgcttccagcttgatagattgaacaggcgaatagtttatatgaggttgttaatatcaaagaaagggctttcagatcttaacaaaaccaaatacatatagatagatttagcttaccaatgtttgacctaaccccatctcaccggattattggatttgtatgatgatgaaacagaaatgaggtgtgaactgtagaatcaataatttgttaggatcattctcagtggacttttttcttgatgggaaacttgaagcggagcaattaagtttagtaagcttagcaagaaacttttgctccttccttttattctatttatgcaggcatgtttagttacatccatacattattagattggcttgataatttgcatgttcaatcgagtaaaagcagtgtctagtgtgttgagttttgtgtctttcatgtttttgctttttgtttttgtgtttgtgaactctgtcatctttaataataataaatcttgatccatagcttttttgtaattgataagtgtgtattttgcatgtttttagcatccatttgtcatcattttagcatcatatcatcactgttttatacaatttctcatcatttgtcatcactttacatgtttaggatagatttgcatgcatgttgcatatttgcgttgatttcaggtgatttggagctgttgacgagctatttggaagaagcgggcctgatcatgtcaaacggatgctatttttgttattttttatttgttttggttatctactcagtattccgttgcaatactcgaccaaattcatccacctcaaccgtcgtctcttccaaaagaagttactcgacttcttttcccagtctcgcatctcactcgacctaggagaaacactcgacctctgcgccgccgcaatcgaatactccacctcgctcaccgtcgaagtctcagggtctactcgattacaataaaagaactcaaccacgagtattcactcgacctcctgcaaccatctactcgacctctaggcttcaccggctgaacttaaactccacgattcactcgacctcctgaagcatacccactcgaattcagagacaatactcgatccaaatcgtctaaagggaactcaggaacaactcaatctactcgagtacagaattgttctcgatcaatagggtttggtttcattactatctttgagactaacctattgacatttgagctttgagttctaaatttctacaagggaatcatgagcaattacagtggcagttcttctattgatcctgactacaacatggatgagacagagtcgtcatcttcaaggcctgagagagaacagagagaatatgaaagcttcagaagaaaagctgagatagcccgagggaagagagcgatgacagagaggtatgagcttatagacaaagatctggaagacgagtacatgcctgagcatactcacagagctaccaaacttctacacaagcccgacgcattgcctgctgaggaatatattaggctcttcaagctgaatgagttctgtagcacgaggtatccttgctcgaccacacttgcacaactcggattgttggacgatgttcagcacctgtaccagagttgtcatctggacactctgatggcttatccgtatgtagcatatgaagatgagacaattcagttcctctccacgctacaagtggagctctaccaaggtatgacctctgatgagttggattgtgaaggattgagattcttgtgattctctgtgtatggtcatgagtataggctataaattaagcgcttggaaggattgtttggcttccccagtggaacgggaactaagcccaaggatgacagagaagagttgaaagacttgtggatcaccattggcagctctgtaccgctgaattcttccaggtcaaagagcaatcagatacgcagccctgtcatcagttacttccagcgttctatagccaatgtactctactcctaagagatcacagggactgttactaactctgatatggagatgatcgcaatggctctcaagggaactcttcgccaaactaagaatggcatgtctctccaaggtgaaatcaatgacacacctctctctgtacttcttctgatccatctgtgtggatacaagagctgggctgtcagcaataaccacaagagagcacgaggcgctctgtgcataggtggtgttgtgacaccgattctgatagcttgttgagtcctaatcatttctgctggacttgagccgcgagcaatggatatcgagcacctacgtcactgcgaattcctggagtttgcaatggttgacgacttccacaggttcaggtttgagcactctacagacaagagagctagcatccttctccctagccctgaggttacacggataatagagggagataacattgattttcggcctgaggttggatgcctctactatgagaacgctccgccattggatgaggatgatcttctagaagaagctgcttcagatgggatggatgaagacagagcagtggagttcgacactagcgtgtatcactttggtgaacatgtacctctagcgagggagagcaagagcttgactgaagctcataagaacaacagtaaattgcagaagtggtgcaagaagcaggacaagctgctcgccaagtgtttcaagactatcaagcttctgacagataagctgagttgttcctcctccaccactgctattccacagggacagactcctctggagatgccatcgaggagatttgatgagcttgcgcacaggcctgagcttagcgagcagagagtctcacatgtcccgtctaggcattcgtcattcgagtcccgggagcacaagcgaagaaggaaggctacactcactcgatctagcagcagatcacgcctcattcactcgaggagatcactcgaccgcggtgctggccgcaacagaaggagagaggtcgagtatcctcatagcggtgctggccgccaaagagctgatgaggtcgagtacccacctgctggagctgatacagaacaaggtggttcgtctatggcctgggagcaatcacaggcagccattgacgagcaactacgttcattcttcgactgaggtaagcgcctcacttcaccattgtattatatcatccgttgtgatttgtttcttcattttgtttctgtgattggatttgtcctgagcactctcttccaagtttattcgcacagtggactgtctgatttaagtttgggggagggctcaggaagtgtgtgttgcattgtatatattcttgagtctgcattcatctaaggcatagaaaaaccaaaaaaaaattgaaaaatttcagaaaatgatttcacaaaaaaagagtgttcatgtagttgcattacatttaggatcgagtctagagtgtttcatttaggattgttgcatatgcataggggataatgatgagatagccttgtaagcattttggttcactggataaactcagttccctcgttgctagttgtctgttgcgtagtcaatgaatttgaaataaaactgaaccatgcctaaattgctctactcgaccacactgtcatgatctgataccattcactatcaatttgaacctgaatctgatctttaattatcatatctgcatcaaatttgaactcatggataccctaaaatacttgaattttcttattcattttgatcactcttgttaatccaagtagctgactttccttattagagcagttaacccaaacccaaacctagactttctttcaaaccctatatcacttgtgagtgtttgtgaggtcgtattccgattaagcttggtagaaagtgttaggttcgtaacgacagagatagtgtctcatgtagttctagttcgcatttttcggactagataggactaggtgggcgcttatactttgggttgggatctgtttaaaagaaaaaaaaaaaaagggtcgattcattgataagaaaaggtaaaggactctaggtgaagtaagctaaagaagcagaaaaagtctagtaaaggttttgggatttgtaaagaaaagaaagagttcttgttagctattgaagatgggcaaaagcccttggttttaaaatgttaaaaacgggaaccttagttgttaaagaaatccaaatccgctagatgtatcaaagtgttgagaaagcttctcctagagttaagagaaaagaaaagaatgattagaaaaagggcttaaaagattcatgaatgcaaagggtagagttaagttcttatattgggattggagatgggattgccattagagcttcatttgatgtactctgggtagatgggatcttatctctatatgcatagcttgggacttacctttagcattctactaaagcttaatcattttttgagagatcccctgttactgaagcctattctgtaagggaccatctttgtctcacgaccttttaccttagccaaatgagttcattgatgatgcattgcttgattcacgttccagaagtaatgaatgttaaagggattggtagatttgaaaacttgtgtaggtcgagcatatgagtcggattgattgatgatgaggcatggctaacgtttttaagtagaattcgatcttgcagcttagaactttcaacttggacattgatttcatctggtttatctggtgctttggctctgagtccctgctttcaaacctcacctccagcttgttcttgattgtttgcttgagggcaagcaaagactaagtttgggggagttgataagtgtgtattttgcatgttttgagcatccatttgtcatcactttagcatcatatcatcactgtttaataccatttctcatcatttgtcatcactttacatgtttaggatagatttgcatgcatgttgcatatttgcgttgatttcaggtgatttggagctgttaacgagctatctggaagaagcgggcctgatcatgtcaaaccactcgaccccgaggtcgagtaggagcttcaagatctcaacagatgactcgaccccctggtcgagtagaggacatcattacttcaccacatcactcgaccccgaggtcgagtgtcttcatcccatcacctgaccatcactcgatcacatcactcgaccccgaggtcgagtgtcttcaccttcattgccagaccactactcgacctcatcactctacctggaagtcgagtatcaccatcaccaccactcgactgcatactcgatgacaagcttcagagccttcttcattccgcactcaaccagacactcgagcacaaggaagaaaagaagactccagctattcttaattcgtcccaatactgcgtcgttttaagtattagggtttcggaatatttggctataagtagcatgtacttcacattttcgcaaacaagttttatatctagttttattccgcagacactgtgttctagacctttgtaatctggatttctctttatctattcagtattcagcattcgttcttgatttcttttactgttgttcattctgttatcatcctgctgttacactgttgttatcatgtttttaatttgttcaacgtttatgctttctgttatgatgtctgagtagtgaataggtttctgaggatgggttagagtagtgtagaattctcagtatgctaggtgattgagtattgattgatagatcccttctggattagttgttcttaatgtctattgctttctgatcaactggaatttgagcctagacatttccgcgcccaaaaggtgttcgatgaaatgtctgaaccactaattccagagattcgtgactctataccaaggtattggttgcagagagcgttttggctttaacttgttgattcgtaatgcctgttaggctagctctcgtcaatggtgattgagtctgggactaggttaacttgagagtctctgttgcggtggcacttagatttggttaatgaacttgttgtctagggttaatttattgagcatgtcaattacctgtaaactgaggaaacgaagctactcaattaccccattctcgggaattctttatctgattactgcatcttgtcatctgttgtttaatttctgcaattctttcttgttactcgacctcatactcgaccacccagttgtctggcaacagattgtgcagtcgagtatctgtgttgtaattcctgtctgtaactcgacctgtcactcgacctcacccagtgctctgcaaagagctatgttggtcgagtattttattgcttgaatttctattttctgcatgttcacttaggactgctagaacacaccaaaacctgttattgtttggcttgacttagtgacttctgatcacatcttgattattagcatcacacccatttggattgataacctaaaatactacaacgacgtgagtggtgttttaggataattgattaaaaacctattatcagtaatcttgaatgtgataaatgcatgcaggtgattgaaaatctttaataggagctgccattgtgtgttgattgggtatcaagtactttttctaagtgatccaaatccttctctttttcgcagttccaactctttggaaagattgtaggaaaaatctatttgctctatatgttaagtcttgttgtgagtaattgttctctctgcggttttaggttaacttgctttaaatccaaataattgttctgtgttcgtgttaccttgagatgtatgatatgtttcagtttgtatttgcagtacttttattcctctgttgttttgattctctagggttcattgttgctctctgcctctcttgttcttccacaatagccaagatcaactctttggttcaatcgatcgctttgtctaaggtactatcatcattcatcaaagctatgttagtactcaattggtattttttatatattgaaaacagagcttgatcaattgctgaaaatagagcttgaaacttcctttgctttatttgattcaaatcttaagctctctgaattgggactgtatatatgtgtttggttgtgattatttgtgaattggaattttcagggacttagttctagttattcttgggaaaacctgttaaagtaaaaaaaattgcaccaagtctcattagtcattagacgtgaatctacttcagttttttctttatcttgtatacctcctaacagaaaatgatagatgatttcatacaaaaacttagtttaccaattcgttattgaacagtttcgtggtcatgctctcttttcacttgtcgccgttgtttcactttcaggcaagtcagagattcggtgagaaaaaggtaagctttttaaataatctttgcccatttctaataaacccttcttgttaaagattgggaattttattgcttgattaaattttgaaactttttcgtgttttgttttgatttagccatggatattgatgcttcgtgtagcttggttttatatggtaaatcctctgtagaaactgatacagcaacacgtttgaagaacaataacgttcttaaactcccagataattccaaagtttcaatctttttacaatctgagatcaagaatcttgtcagagatgatgattcttccttcaatctttcgttgttcatgaactcgatttcgactcatcggtttggtcggtttctcatttggtctccatacttgtcttccactcacgatgttgtttctcagtaagcatctatctgtttggtttcctctttaaggtttgcttatcttttatgtattgaaatcagcttttttagtttctttcagtaacttctctgagattccagttggttcagtttgtgtctctgatatacaacttaaaggtcgaggtaagtgttttttcttaccaatgatggattagataagagttaagatgtagaattggaaattgaaaaccggacaccgtgtgtgttgttgcaggcagaacaaagaatgtttgggaatctccaaaaggttgtcttatgtattcgtttacattagaaatggaagatggtcgagtagtgcctttgatacagtatgtggtgtctcttgctgttactgaggcagtgaaagatgtttgtgacaagaaggtatgttcttgaaaataacctttttgttgtgtgttttgatcccttgtatcagaaatttgaagttcatttgttttcagggtttgtcgtataatgatgttaaaataaagtggccaaatgatctatacttgaatggccttaagattggaggcattttgtgtacctctacatatagatcaaggaagttccttgtcagtgttggtaataagcattactctttagaagtttgtaataagtatcttttagaagtagcactgctcttagtcttattgaagctggtgttccttcttgcaggtgtgggattgaatgtggacaacgagcaaccgaccacgtgcttaaatgcggtactaaaagacgtttgccctccatcaaacctacttaaaagagaagaaattcttggtgccttctttaagaagtttgaaaatttctttgatctattcatggaacaaggtaatgtaatcttcatctttatcactttttaagtatattccaaacggtattatttgatcatttatttaaatgagatgagagtaagggaaatgatcatctaattatctagttttaagactatacaacctttgacatcatcactctgcacttttcaggttttaaatctcttgaggagctttactataggacatggcttcacaggtaatggttttctcttcgattgcaatttctgtgtgcttgtcattgaagggtttctgtacaaatctgaactggttttgattttatgcttatcctattagtcactagctgaactaaatggcaaaacttcatcaattgggaactatgtactaaaataattgctaggctaaaatgaccattttattctcatttatatgatttaatgtacactgtagtatttgcttgcaagaaactaagatcttttaaagttaagaagacgacaatgttacttaccatctacacactgctaaacatgtagcttttattgtctagtggcattagcaacttttcttaatacattcacattgaggtttggggatacaattacaatctttaacatgtatttacttacacctgcgcagtggacaaagagtgattgctgaagaaaaaaacgaggaccaagttgttcaaaatgttgtgactatccaggtaggatgatgattcttatggattggttattataaaatcaactcgtgctttgatcctcattgcattctcctttaaatttccggggtttgacttcttcgggatatttgctagctattggagatgacaatgtaatgtatgagcttcatcctgatggcaataggtgatattttgagcatgtgttatcgatagtttaatcgataaaatggataatgttacagttcatattttaagctaatatgttgtgtatctgttcaactacagttttgattttttcaaagggctggtccgaagaaaactatgaaccagagactcttgaagcatcttttggtgaacgcagatgttatttagcaattagcaccattaacactaagataaacaaactgcctttatatatactgtggatattgtcctttgttgcaacttttttgtgtatgttttgactcattaatgttccttgagggttcgttgaagaggaattggaagcgttgatcatctaattatctagttctgtaattagaaataatgatttgggtccaaactgtttattgaaaatattctcaaactctcttcttattaatatgacaaaacttaagcaaattgtacgtatattatacattcatcatacctaagctattataaacaactgacaagaaagttatttttttgtaatattcacaattttatatcacctaatctgtaggtagtcgtcacgtactacaaatacatggtgatattatttttaattatgatacaactaataataatgaggaacaaacaagtgtttttttcctggggaacatgaaattcactgcgggaataagacaaaaactgtatatttaccttactcgttttcttgaaaacctcgtttaataattttctgaaaattactgtaaaatcatcattcaaccgccagtaaagtgtattcagaaaatcactttcaaatttttttcaatcggtgcaacttatacttctccagtgtcatgcaatttttcttatagttatctaaaatgtgaaacagagcaaagaagccttacattgtcgtttggtttaataccaaaattaataataacattgtatgattattttgtgtttccaatagctgcatgtaaaggtaatgatgcccaaaccaagggaagacttttcacgtcactaatcttctatcaaatctatcaaacccatacttgtactcagacttctcacgtttgtcttcataggttatcatcacctctttttgcctactcaatttttatttatttttacttattcacctaatatctatttgagtacacgttttatgtttcatgatgatactcatattaataattacaacttacgtattttagaagatcgactaacgtattttgtgacacgttttatgtttcatgatggattcatttcatgccacttgtttaaaactcagttaattaagaatcatttgaagacttatcataaattgctatgttttaccaaatatatagtataacttttttgcttacgttgtatgttttataatcaaatcaggagtcagattttggtataagaatatatactcaaataaacaaaaagaaagactcaattactgtttagttacgtcaatacgagtgatcagaacttaaaagagaagtcaaatatgtgaaattgaccttagctaagaacttccaaaaaaagaattcaaaccccagtggcaaaatagaagcaaaaattagctttaaaatcaaagcttttctgatcaattttttcttgggactctgcctctctatctctctgcctccgaattttcttttacctttcacatgagtaaagcgactcacaaagacaagtttcaatgaaacaaagaaagttatcataaaataagacaaaacagaacctaaagagacaagacagaaggtacatactacatctctgcgtctgagaaacaaattgcttttgttttcttgtcttcttctagaaaatgctactcttatttttccttggatgttatccttttgctttttttttctttgttatttacttatttatatacacttggtccttccattttttcttttttggtaattgtccttcgaattatttattttataaaacaaaaacataatttaatttactggtatatttcactctgtcactcttgttacattgactgaaattatttattttataaaacaaaaacataatttaatttaaacaaaaagaactctatgaacacttgtagtttcctctaaactcctctcaactcgagtacccccatcattcgtcacacgaactgatgaacagaagatcattataagagacagtctaaatttcttttaaacgctattgataattttctttacgcaaatataatttgctttatttaaaactacttaatccataatacatattcctgactacacatttatggcataacaatagattgaccaccaaacggacacattcacttccactgtttcacctgaacaactagtgttttaaaatagtatagattcaccaactctttaacactataaaattacaatctttagtttgatacagttttaaaaaaaggttggatattgtaacgtaaatatgatcagtagtttgcatggaaagaaatgaacatggaacaattgcatgttcataagcataccatttcatcttaactatcctaatattcttttgattttattctatttcgatttggattttattaatatagctaaaaaataaaagaatctaaaccaaattaatcaatattttcataaataatagcataacaaagggaatgatagaaaaaaagtaactacacaaatttgaaaaaattcaaacgagattccaacagagaaaaagtgtctaaacatttgtcctacgattgcaatttgaccaattagatagtacaaatcagaagatgtctcgtcgacaatacgattgatagcccagtggataaactctgcttctccctctctcaatcatgccgccagatcaaaaatattcaatagaccataaaaagcctaccatttcttagtattgggacaagagacattaaatgcaaaaacattaaaaacaaaataagaaagaaaaaaaacctaaaaacttgtctgaaaaaagcttctactctgattcttcttttctcttttctactgacacgttttcaatcaccttaaacgacaaatctctccacaacaagacacgacacaacaaagcttatcttctcaaaacccttcactcacactctctcatctctagggtttcactaacacaagcttcctttatccctctctctctctttctcttcctagtttctttagcttccatggaaacgaaaaaacccactaaatctttaaacccatacgcaccggcgtttactcctccttctcgttctcctcctttgtttaactttaacaagccatttccttgttacaacaagccttttaaagctattaccggcgctcatgttaagccggaaaaaaaccctttcgtccgttatgggttttgtcaccggagatgtctcccaccaaggcttttgaagaagcctttaccggaaaataagctcgccggaagaacctcggtcatggttaagaatatacctaactgtctcgggtcagattttatctcttctcaacttttttataattttgtttttggggatggatgaattaaaataagagtttgtaagaatttgcagacgaatggatctcttgaggattttggacaatcattgtcggaaacacaatgaaaaatcttcctacgactttctttatctgcctatggattttgggtgagttaatgcttatttttctctattttgggatgaaattaaatgcttcttgcaatagcggtgatgatggacatttaatgtgtaacaggaaacgagccaatttgggttacgccttcgttaacttcacgagctctctcgcagcggagagattccggagagaatttgaaaacttctcttgggacaatatcgggttcaggaagaagatttgcgaaattacagtggctaagtatcaggtttgtgttcttttgattctttggttagccattgttgttgttatttagagttaatcttttggttttgatttgatttagggttaaagtcttggttttgacatatttagagttaattagtgcaatctttgtttctggtctattttgttacaagactctcttttatctttggttcatcatctgttgttgctcatttagggttgtattgtgcaatttggtgtttgagtctctttctttcttgttttgaactctcaatatcttgtttttttccttcttctttgtataatttctcaatttctgttttcgtctctctttttattttattttgttgaaatctctctttaaatcttgtataagtaactgttattgcttatttagagttgttaaattgtgcaattttgtgtttgagaatctctttcttcttgttttgcttattaatgactctttatattcttggtttgtaattgttttgtccttctttttatatgatttagagttgagtagtgcaattttgtgtttgagtctctatattcttgttttgtttgttaaagactcttttattcttggtttagtaactgttgttgcttatatttgaatagtgaaattgtgcgatttattaaattttgggtctttttgttgtagttcttggttttgtaatggatgttgcttatttagagtcgaactcttttttcttcatttgatatgacttagagttaaatagtgcaattttgtgtttgagcctatatctgaagctcttttattcttggttaagtaacttctgttaaattgtacaattttgtgtttgacttttgtgataggggaaagaagagctgactcgacatttcaggaactcaaggtttacttgccacaccgacgattatctcccggtggttctctcgcccccgagcaacggcttcacggcttatactctcacaaaacttggttaccgagtcggcgcacttggtggtggttcacgaaacgcttcattgcgttaaggtttttagggtttcgtagaagagaaattgtgttttcattatctccctgggtgtggtgtcaccaactagggtgaaatggaaacatagctttcctcttacttctctctcgttcgctttttagttttctagtttgtgtgttcgttaattagttaaaggtgtgttatgaacttagttacgctactacaatggtcaagtgctcttattatattccacgttcttttaatatcctatgtctcattctctttctgatttttttttttcatatggaaagtcttcaaaataaatggatctaacatatgtcgtagctaatgtaaagtggttatacaatttaaccctaaatttcttcttttatcaccaccgctcaaagctttggaatgttaaggatttatttggataaaagttccttaagaattaacaaaacgaaagtttcaacgaaatggtctttagacccaatacgggctttatcaaaagttaaaacagcgatacaaaatttgggccggtactcatagaaagcttttgattatacggtgggcctcaataaactttggataagcagatattgaaatgggcggtaatgatattgtaatggactagttttttgcggtttaactaaaaataaagttgatcagttaaagcattttgttgaacaaaaaaaacaatttcagtataagcaaatcgtaaatgtgagttttcatttcaggtaaatcattgtagacattttaatggtaagaaacattgatttttttttttttaataccaggaggttttggatcgaagcctgtaatccctctaaacccgaaaccacaacatataatattagttttgttccaagcgtcactcgaaccacatcatataatattgacttttctacatgaactaaaattgaaataatactaattcaatttattaattaccacggatttgtctcatgcttctcacatagaatcttctcatcatatatatattatcaatttctttttgtgataaaagcctaaaagaatatcatatatatatatatatgtgtgtgtgtgtgcgcttgttattacatttacaataatcagatattgagagtttaaaaatcttttgtgtcaagagagttcattttgattatacacaataaatatggtagcgtaagtcatgatatcaattagataaagaagctttacaataatcttgtagtaaaacatataaatgtatcttaacgaaaaggtaaatataactgtagacagaacaaaagaggagttgattcatatcttttcttttgacccaaaaagtaatactaaatcagttctttttcttctttatctatcaaccttctgaggtgaactttgttgcgtcatttccagacttttctcatgcgataaaaatatcatatagctttaactatgtaaacataaaaatgtaaaaaatgatgactttttgtgaagccaatcatttctttaaaatatcttacgaagagtagtggagtctacatttgaatagcaacgtagctgtgccttcttctttttcttcctcctattttcatagaaacaagaaaataaatataacattttacataaggggacaaattataatttgataagttatgaggataatctttttttttaatgttggagcatattgtttctatggttttaaaattatatacgatttgaagtggtttaaatttaatagttttcaatgactaattttaagtttatactaaagacaaaatatattcaaacgataagtagatgaaagagttagaactatatgttctatatattaaaaaaatatatatatatatgttcagagaggttgatttaattttagatgtttatttatataaaatttattccttactatattaacttgtaagaaatattataatttttggaattagataatcaaagttttatttttgagtattagaagaaaaaaaacccatcgttttctcttaatttcaagttgtaagcaatacaatagaactatagcataaatgttaaaatgtacatcaaagcatcttgaaccaaaaaatatacttaacgaatttcaactaaaagggcataagataatcaaaatgatcattataatgcgtcaggggatctaataacgcattttctaatacattagttaattaggagcctatgggcttgagcctcttgacaaaagtgataagtcaaaccaatatatataagaaaaaaaataatttactaatacgaaaatagatgaatctttacattgcttccacttaaattttgtttaatagaatttagtaaagaagccgatttttaatgtataagtaggtcttggatcctatgctatcatgaaatattttaatttttttgaagtattaaatacattagaaaatactaagttattgttgaaggttgttaatagtaattaatcacgttctcagttcaatttgtttttggtttttagaatttattattatgaatatagtaaccaaaataaaactaagttagtaaggatgattgataagaatttatagttattaaccattttagattcacgttttaacaaatatacatttaaacttttgataaatagaaattagttaaaacgtgaatctaaaatgtttaataactataaattcttatcaatccaccttactaacttagttttattttggttactatattaaaatagttagtattacattttgaaaaagtagttagtatttgaaaaaaatagtattattacatttatatggtaatatataattcaaatactaactatttttcttttatcatcagatattatttatgactcaaacgaactaaaattgtagaaaattgtttacataagtgcataaattatttgtgtcaaatatctgttttgacattttcattacgagagattaaaaataaagaaaagaatttctcgtcggtttgaaactcaaccaaatactaactattcgaatatctataaacttttatttgttcgtgaatgaatatataaaattaattgtgaatgctttatatttcctctgtttctttttgtttgattgtttagaagaaaaaatttgtttcaaaatgattgattttttaggttttcaatgtaatacttattagttataattgataaattgtacacttcaatataaattattaaatatcattggtttagagttattgaaaattgtaaatcacaaagaataatatatttaaaagaaacatttaatatgttttcttaatatttatgttttttctaaacaaccaaacaaaaaagaatagaagggagtattaatgttctgttcttacaataatgaaaagtatctagagttattacagctcgaaataaatatactatatatctatatatatatagtgttggcccgatccaatgtctttggaaccgtgttgcaattattttcacactacaaatcaaatttcttttaattattaaagaatcccaccaacaaacatattactacttctatgagttttcggtatcaacaacacattataaaatttatcactagaaatacttgtttactgcgaaatttaatgcatatattttgtaaagtagaagccctaaatatatggaaggatgcaaaacaaagagtttctctgtttctgcaacccatcactaatttaagcttgttgtccatattctatgttacgtcatacttaactttcttgtccttgataatgaaaaaataattccttagattagttgacaaaataaaaaagaaaaaaaaaagcaagagatttgttgaaaaggattgaatatatagaaaatgaaaggaaaaacaaattgagctttaactacctccacaagtctcttgcgccattacagctgcccaacacatttgtcttatgactcaatctatgctgataaaaagatatttactaatgcaaaatataattagatcttaaacttcatgtgtttctctctatatatatatcttaattagttctttggatataaaaacactcgttcgatgttactatcatacttcccaattgtcatcacttaaatgtcaaatcattaagagtggttcactgtccatctttgtgcaatttatattatctttgtgttggatctaatcgtgccgtacttgaattcaattaaacgctataaacatatgattttccacccatttaagaatttgttccattatattcgtacaaatggatgtatcatcaatgtaccaaatacataaaaatgtaaattttgttcaagcatgaaatgcaactataacgatttgtttattttcttttttttggttaaagactataatgatttgtttccccttttactccgattcgattagctccatttttataattattttttttaatatttaaaagttcaggtccaaaggctttacatttctaaaaggcgagacccataacagattaaatttatctttttaaaacaaaagatctttttcaacgtatctggaacccaacacttctacctgaaaaatttactactaggccaacagcgcacgttgattttaattttataataattttaaaatgatcaattcgttgaaagattttgtgtaaatgatattcataaaggtcaatacaatcaagttattttcagttggaaacacaaaaagatatttcacataaattagtatcacatatcagaaaaaaaaaaatcaaattggtcgattatcttattttgaatataaaaataataatgaaaactgttgaatatgacacaatataataagtaactagtcgtattcgttttgatctgtattattggacgaggacaaaataaaaatgtggtgaggttcatacaatattttggggtcttcaaatttatatataaaaacccaaataaaaaaagtcgcggcctttccaaccaccaagcagcagatgggatgcggcgggtccgagtacgacccggtaaagacggtcgggtttggctcaccataacgggtgaggacgtgtgaccttgcgacgcggagccagacaagctactaagttcgggagcatgtggggttcacacgttttaactaacacgtggtcacgtgatatttgcatggctatggcatgtggcggccacgaccaactttggttttacagtttgataaattaatcttttttgctctttaattactttcgactaatttctcaatttttgcaactggtaagtgcatataaatatataaaatatttcttttccaaggagtttaatttcaattctagagtctttacgtgaaatatctttctattttttacaaaatacttatttcgaaaggactaggaatggatggatgaagcaacaccaacgtagtaacattaaactgcacaggtctagatttttttgcctatacacttaaataagttgacatcatgttgagtgaatctaaattatatgtaatagatataactgtaaatttgtttttattttctataaatttgatatttaacgccaaatttaacttgaattagcagagattacagatttgttatctatgagacatacaaatgcaacctagaaaaacatcaattttaaaacatataaccatgttgtgaattaggttaaataatagagaaatcgttaaaaagaaacaaagtttcttgaggcgttttgagtttaacctagtttacttttctttttttcttcattagtctgatataatcaattttacaaacttagtttctctaattatataggctttgaaaatttaatataacagaaataaaaaatatgaaaaatcttctatccatgatatttctccactcattcgaatagagcacccaaaagattttataaattttaagttactttaaattaacaaatgatgggtctgattggtaaccaaaagctttacaagttttttagctattagttttatcggaataatgcaaagttgttagaaggaactatagaaaaaactgagagtaaaactttttgtaacgcttttgataaagttttgacaaaattgtgatatttctccactcattcgaatagagcacccaaaagattttgtaaattttaagttactttaaattaacaaatgatgggtctgattggtaaccaaaatctttacaagttttttagctattagttttatcggaataatgcaaagttgttagaaggaactatagaaaaaactgagagtaaaactttttgtaacgcttttaataaagtttttgtgattagtaactgtcgaaactatacaaagctatattgctattaaaatggttactattcaaacccagtataagtgaaattacatgttctttatttttcacagataaatcttacacgttaacaaattattaggtatgatggttttgcttggcttatatatatggttatattttgaagattttcaaaagaagaagttcaattgtcttatatatatagaagtgaatatgttgttagttcaattatttaggaaagaggtatttgagttctgtcgaatctaagttcgacgaaggcttctcttctagttaaatatccatccacatacaacaaatcgtacatctttttttttttttttttgcttactttacattttaatttgcatcacagtagatcgaccaataagagaagttcccttctctcgtttctctcgttaccaacaacagattcacgagatacctaactttttttaatcgttttattttacctgaaaacgaaaggtcagaatcatttataacttattcttaggatgatgtaacgaaattgaatcataaagctcaggtgaagtatatttacatcccaagtcccaacgattttaatgccacaaacaagcatgatatttgcaggggcagcatttactatgtacttactattttactgttaatatcataaactaattgattcgaaatataagaaatataactatataagcccttttaacaaacaaaaaattaaaattaaatataagctctaaaaataataataacctttatctaattatttaataggtaaaacaggtaaataattctaaaatttacattggaaatataaaacttttatctttgtgggacaaatttttctttagaaaattcatttttgtgggatggagagaatactattttactgttaatatcataaactaattgattcaaaatataactatataaaccctttaacaaacaaaaaaaaaactaattaaatataaaccctttaacaaaaaaaaactaattgattcgaaatattcttggtgtgctggctattttattttatcaaaagctaacaacttgcttaggataatcatattttctgtcattatcacaaatcataataattgtttgaaagcaaattatatgttatgcttactaattttaaatctgagagtcaattaggaactactcgtctcatcaattcaaaataatattttctcctgagtttaggggagttttattagttccaatagatgtggtatttatttaaatacattttgtatgcgtgatgacttaatcttagttaaatttattatttattttgaatgagcttttctatatttaatttagaaaacaaatttagaatttctaaacaatgaataataataaattcaactccagttcatgtgcatcactaagttgaaggacactaaaattagactacttctacattagatcctccagaattggagatatcgactattgtttgatttttaatttatagaatttatgttgaatattttgagtcatatactatcataaaatcatgggtgcattatcaatcatccgaagattttttgttgttgttgttgatcatatagtattccaagcttccactattcaataaatctaaaacatattattgtatactaatctctacatatttctagagtgacacatttttaaatgaaataacatcaattcgttttacatccgttcgatttttatatgttagaaaatatatctttgcatttttctgtcgacattatttaagttcttgaagttatgaatcattgatatatgattttatttagatatatatatatatatatatcgtaacattttctatcggtttaatagcacactatttttatatagatatgatgttccttttggataacttagaacataacttgtgatgctgtattaaaattctaatcctgtaatggagaagagtttggatgctagaaacatactttataaacatgtacaattttaataagaacaaattgaatattaactgaaaactctaaagattctcaaacgattgatatattgttaaactaatcacccaaaaaggaagagtcttctaaattacaagttaataaaacaaatgaaaaaagtaaattcactccccctaatcttaaatcatatatgtggtgaagattaatataggaactaatggacgagtttggtttcaacttgcacaacaggaaactacttcgctttggctttattctctttgaaaatgattattggtgtctaatagctgtagaatttttattttattttttaacgacaaagacatatgaaaaaatgaacatattcaaattgatattcataatgtgaagtaaacgcagaaaattcaatgtacgataacctaaccacaaaaatttctgaaattactttttgtatattattgtgaaaaaaaatatcgatcgtgaatacaacgaacacattatatttccaaatccaagactttaaagaaccaacattatatacaaacaaatccctcaatacttatttagaatctatcataacactaggctttttgacgacttaacgttttgactttgaaatatcttggctttagactagaatatcaagaaatcctccttgatgttatattgcatcttctccaaattcggctgaaccgcaaactgaatcatcggtggtggtccgcaagccatggcaagggctgagccatctaatccatcagggatatgttctcgcataatcgcctcggaaataaacccggtactgtatgcccaaccttccttagctgattccactacgtaccaaacctttaaccggtccgggtattgctctgcccaaccatccagttcctcccttaggagaatatcttcctcggtccggttagcataaatgacgtacatttcagtctcatcctctggatccttgagaatggcttggataatttggtaaaccggagttattccggttccacctgccaacattgccaatttatcagcaaactttggtttaccgtgaaccgtgaaactacccttgccgagatactcaacgtgacccaatggtcctttaatctccaaagttgaccctataggcaaagagtctaggtactgagacatgagcccgccgttagggaatcttgggtggacaccgccaaagtaaatcttgaccacgagctcgaagtagccaaccacatcaacggtgctgcttggtgtgtaagctctgaggcagagcttgtcattgatggtggcgcaaaggaaaatgtgcttaccaaccggtaagcctagaaccatatcctcaaccggtaaagcaaaccggaatttacgaacatcatgagaaatggaagtcttttcgacgagttgaaccgggactttagcccggggattaaccaaagcgaggttcctaaccggagtcgcctctccaatgggagccaacagcgagaacacggcggatgaaccgtgaaccgagttgttaggcgaggaagagtcagaggaataaccagtggtgatgagctcaccgatacggtaatcctcaagcatcttcttggctttatccgagtgaatggcttcaaactcctccgtacaatccgtaccagcattgatcaagattgaatccgaaccacccgggtgatccataaggaatcgtgtacaatcatagatatgtccatggacaatgatccagcaagagtcagccgaattatgcttcttgacctcggacatcgagtacatcttcgcagttgtgttcataaacggcgtcgagacagacttctttagactaggaggcgcgtcagccgatttttcgaggtgacgttccttcgccatccatccaccagattcattaccaggaagcgttggatgctcgaacacaatcccaatctctcccttgtgtggcttgcacacgttagtcttcactctaaaccagcagttattcatcatccccatgagattccatatcattttctcgggctgcgtgttgagagtctcgtcccatgcacgaacagcaatctctttggcactaagcaagtccaaaacctcaacctcaagtgaccaaaaacaccaacaccagaacttcccatacttgtttggcttctcttgatggtcaagtgcacatacgttccatgtctctccaccatctaccgtgacctccacacgggtcactttttttccacctcctgtttttttttgtataaagattattgttactattaaattaaatcatcctatgaaataacgtatttattaaattaaaatgttaaaaggacaagtaccggaatatgcgtaaccctttaaagtataaggtctttgggttgtgaaagcgttgatgggaagaatctcctcgtgacatggcgtcgtaatcacggagtttatgtttagctcgttgattatgtactctggcttataccaccaacctaaaacaaaaccattgaatttgaatttatgtaagtcacagaagctgacatcatccaccaacattagtttttcattttttaatatgatttctgtttttgtttttctcctataggttcggagactttttaaacatatcaattagttcatcttaatgagatttattgaagcaaaaagattttatgtaccttcttcgtcggcgagttcggcgtctaccaaagaaggtaaaactctgttgtccttgaaatggtagaaattgtcggattctttagttgtgacaatgattcgtttcaaccatttaaccatccggccaccaatgaaaccggggatgatgatccgaaccggaaaaccgtggtctggtgttagatactctccgttttgcatataagccaaaatgatgtctcttgatggatccatggcatattccttcttgatgctcgttccgtatttggaaccagcagttccggcaccgcccggaagatcctccgacccttcgaagcagacgttgagagcgccgccttttcggctaaagatcccgcagcgacgcagtacgtcgcagagagggacaccacgccacacggaggtggaaactccggcggatccccagttgaatccctttgacttcttcaccatgttctgttccttacggcggttccccgcgcagactagcgtcgcggcgaactcgcggtaagcaaactcggagacgagctggtccatggtgaatttcatgggccgtttgacgaatccggtcacctcgaccgtccattcggcccattgggctttagggacgtggccgtggttacgaacgtagtgcaacgggacaggggtgataaacccgtggtgcattaaacggttaagaggcgcctcggagttgaagggatgtttccctgtgagacgtaccatggaagggttacgctcgatccagctatcagccgtgtattcgtccctcgggtccaaaacggacggttcaagctcggcgttggattttcttatcatctccttgtagtacacggcgttgctgttgtgtgtctcgttctcgtcttcgctcgacacgtcttcgtcatcgtcatgaaccttggctggtttcaagaacacggtttggttggtggtttggttctggtgcgccttaggggaatcggaccggcctggaacgggaggtttgtaagaacgaaccacgccgttcaaacctggctcgagacgagcgtattggcgattatctacagaggccgccatgttggaaagtgtataatcgtaaataatgtagaaagcagagcctttttctctctctatctctctcttgtgagtgagatgagatctgaggacgaaaatgcatcgttggtggagatgaagttatataggagagagcctagtggtatgcttttaggaagtatcgtgccgaatcacacgtatgggaccatttgtgactttttaatttttttcttacacacttactattaattttttcttatgacttgacttaattaaataaaccatccatttgtttgacaaaaataaacgatcatagttattcaataagcttaaaatgatcatttttgtccctatttgttataaaacaaatgtgaattgttggagtagttttgtaaatacttttaacgtctcggaaacatgtatagatttttttttgtcaactaagaaatgatgacaattgaataatatattattatctatcattggttatttcctgtaatacaatataaaaatgtgatcaaaacattttcctttttattttagtcgaatttgttttactaaaaaatatgttttcttattcgtgacacaaagccgtatttatttttaatggaaaaataacgataaaagatgacaaaataattaagagcaataaaattagtaatacaaaaatcgtggtgataatattttcatactattaattttaatagtttttgtgatcggtaactattaaaaccgtatatatatatatatatatatatatatatatatatatatatatatatattttgtaaaccgtatattttttaccagtaaattaaagaattatcaatgtgttaacataggaagaacgttccttttattattgagatttgataatccttttacccctggttctagtttagaagtttatcaatgttcttatatccttcagttaaacataggaacaacgttccttttattcttgagatttgataaatcaattaaacatattatcagaaaaaatctaataatcatacaatatttattttcttattaaacgttattttcagtaatattttcttattaaactgttttttagtaatatttttttttgataaaattaacagatgtgattttcagcaatattgatgagatattaattattgagtaatctaattttttgtatacattattataacctaaaatagttccttgaatcatctaaaagtttaaaatacctatgtatgaatgttggaaaatgaaaaaaaaaaaaaaactgaatgatggaaaatgatcacgttcatctttttccttaaaataactacaaaattatttctctttttgatcaagatgcaacattacagccacctatatattagtattactgttattattgtttttcttcggaaagaatggcggtgactaatcaaaaccgacggagccacgggttcagcagattcagtgggtaaatctttctttatttaagacttttttttgttgaaaatttcattgagtaaatattgaatattgattttcttgtgaacttctaattttgggtaaccaatatacatctttattttttttatatatatatatatatatatacttcttctgttataatatataagatatttcactaaaaagacaaagtttaagatattaattaatatttttacattaaaaaacatattttgatatttaattaaagagagtttgctaatgaattttttactgcagaataaaaatttatcttttgagatgtgagatgaagattaaatctgtgaaagaaaaaaaagtaaaaaagacagtttaagtttaaatcatatggtactatttatattatgtttaagttttatactttaaaaaggaacatgaaaatttagttgatttcaagtttccactttatttttttttatgctaacctttcatgttaaagtgtcaaacaatgaaaactaaatttgttgcgaagactattactatccatacaacaatttctatttcatagcacaatttcttaaataagactacttgcatatagcagtttcaatatatatgatttttatatacctaactttacaaataagataatcaatacaatatatatagtatagttaatatagggaattagggacgagtgatatgaagaaattatatttacgacgtttctaaaagcggtcgtttgtttattctttacattgttttatcatttttggtggtttgtcattttccaaactattattctcctttttaataaagtcattaaaaaatgagtcgtcaaacttgtgagatattttacctcaattgatcgcctaacttgattatttagctcgtagttgttgacttgttgtcataacgtcattaatcctccaatctcaacattaattataatcaaactttgacaatatttgcgtaacataaaagcgaaaattgtttattgccacaaatggcaattcagcactctttaaacacctatttctactttataactctcgcatatctaataatcacaaaaaactctcgcatattaatgaatagatgttggccagattgtattatatatatcaaagtagttcaaaataatttatggattatagatttttattttatttttaaacctttttaaaaaaaaatttaatcgccgtttttttccaacctattgccttgactagatctgaccggcgtgtaacggttcttatagcgccggtcccttctcttgttttattatctttgttttttacgattgtgaaacgtgctgattttgacgaggtagattgggttgtaaaaaagcttggttctaaaaaactgaaatcaacaacccttaaagtagatggtaaaaatatagtcgatgttctcgcttatgcctcatgatgtggatcttcgtcttgtctctagtcaggtgtcttattttgtttggagcactagagactgttcttcttctctcaacggatctgagcaacaacggttttgtttttggtgcctcgtccctctcttttctctcccacttccttttttgtgttcaagtgttttgtggcctcctcttattgatttggttggttacccaaaacagttgtagtgactagcttgatctctattttttggacttgtttgcacgtgttccatggttttagtggtggtctttatggtactcttcccggtttgatcttgtgatgctctcttttgagattggtttcatccggttgatgaattgtctcactccttgtttctatagttaagacatgattgaggtctggtcagttcaatggcttcggcgttcaaagattgctgagtcgatattgtcgctttctgaagtaggatagaaattttttatgctttgtcctgattctctcttgccggaatagtagtttaggttcacttggttttgagaggtagtattgtatcactataggaggtttcgctagatgtgtttggtgtttggctttgatcattttgtttcaagggagctattttgatatgtctatatctctagagttatttttagtcttggcttctatttcattttttgaggtttatttcaagttatctctatttcgtttcccttgttagggattagtttctagagatatatttcttttccgtcggctttgtttctggaaaagttaatctcttgtcggctttgtgtaacaaaaacgcatcccactcttatattcttccattatattaataaaattcgaaagaaaaaaaagaaaaagaaatatttcacttttttattgtatagatttatcctttctaattttattagacactgaggatttgaatggtgatgcggttggatggacaaatccaaaaacggtttagtgcactttatttttaaagcgtacaacaaactgtcatgaaccaactctatttatatgtaaaaacgatctgtgacagtttactttaattatttgtaaatccgcaccactatagacaaatttgtaaatgataaataaaaatgattcggtataaaaatggattttcccgtatttaccactacaacaatttagaatctaaattctcatagtcctctgccttatctgtatttaaaaaggtttttataattatattttatattatttataaatatagataaataaattaatatttttgtaagtgttttaaaacaccaccaaattttcaaatatcataatattataatttaattaattttgtataatatattaattttggattttgttaaacttttatttttttgacgttgttaattaaataattacccattggataataaagtaacccctgtatttgtatagaaccgatgcaaagcatgtgccgacaaaaagtgtaacccatgattacaaaccattaacgcgtaataattagtattaacatttataatggttagattctctagatttatctaaataaacaaataaaaagaatataactatattttgaatgatttaagtttggaaaaaaagaatgatttagaatttaataaaattttgtataaaattagataatgtgttattaaactatttcgatatatcactaaaaattagtatgaaattagatatttgtattttaacttataactctttctaaaaccttttaaattattaaattaaatttgatcacttcaaaatttccaataataatggatttgaaaagcatttttttttcagatcagtagttcaatgtcttttgattataataacatttacaaataatattaccagtaacattccattctactttgtataatgctctacactgctatttacaaaaatacttttcaaaaatagtccaaaataggaaaaataattacatataccagtttcgattttcatattgtgtaatgagttacatcagaactaattgaaattgtcgagccgacaatcaatagttattctagctatatgaaaattatagtacataatcattatgattgaatagctacgtacgtaaagcggcttctccgacgttggtttgaaatgtttgctcaacttatgtttttcaaatgttttttttctaaaatttgtaactctcaatactcttttgaacataatatttttggttggtcaaaaaatatcacattttaaaattattcatatctacaatttgtaacattagttatatattatagaacggttttaaaatttattattaaataacatataatttatatttaaaaatttatgattaaataacataagattaatcatttcaatttattttttgattgtggaagcttcatgatctagtggtcgaggatttaaatgcttgtacaacaatgctacggtttgattcctagagagcagtttttttacaacttaatggcgtaaggctaatcgaaaatttaagaatgatgtagagccgttcattgtgatattgagtgttagggataagattcttcaacattggtatggtgcatataaaaattgtaacaccggattttggaaatatggtggtacatgtagagaagtttaaaataactgatttgcttatttatgtcacaaaaatgtaattttttttcggtcaaacgttccgagagaactctacagttaaggaagtttgatcgaaaataatttcaggatggatgtcctttcgggaaatgattatcgaaaccgtatgaacgaggacaaaacacagaaaaaaatcatgtggtgatttgtaggattggtagggaaatatttgaagcctcatgtatgtagtagacggaccgtcggacaaaaatgtggtccaaaagcccgaaagaggcgtgaatgttgcaggaagtacatatattttgtatagatctgatagattgatcaatatttataataaaattaatcataatttctatgattataatcgagtacggacgattaaaatttttattatatatattcaaattgaatacaccatctaacttactccaattatcaaaaaggaaacatccacatttagtaattaaatttgattttgtttcaggagaagttttggcgactaaattgatggtgaaagtttaatatttctgtccctagaaaaaatttaaactcggaagaaacacaatgagccaataaagagtgtgaagtggcgcatggagattccaacggtccatgagtaacaaaaacatggatttcaagttacctcactatctcgttacatgtctacatgctgatgtgttccaatattttcaaaaagaaaaaaaaaagaaaagaaaaaacaaacactttcactcttatttggaaatggaaagaaacttgttacaacaatttggaatgataattacaaatatttaatccaacgcaaattcttttcttttcttcacactacaccacctaaaaatactcatgatttaacacatttaatgaatatataaagtacgagaaaatattcaagtgtcgatatcacatatcatatattatattttaatttaaataactcttacatgcaaattcaataaataattgacaaaagtaacaattatctttgaacaatgttacaggtatgattttatcaaaaaataaatattacaggtatggtattactaaaatataatcgcactatttttcgtttgaaaaagaggaacaaatagtttaagagagattacaaaaactcaaccattctcaatttttatgataaaaaataatttttgaaatcatcatgatattttaataaaccaattcaaccattcctttttatttgataatttaattcttgtaagttttgtttccctattattttattttattttgtttcaattaaattacaagtacaatgctataagcaaatatatttaaaaataaatttctcatatttggaaaaagactacaaaaatatttgagaccataatataagcttgtttgaaacataatatttggtcgttttaaatatattataagaatatgttatttctaaattaattaaattacatttaatagaaattattacacacatattatattatcatgaaaatatacagtcaagtatggatattatacggtgaggttagatattttacatgccaatttaaatttgattggaccagatatcaaattacttttttttttttttgtcaaatgatatcaaattactaaaagcacatacttgcaatgtccaccaaagatacttcattttttgtggtaaatgttatcacgttgtgtgtcggtaacaaaaaatttacggaaaaaagtataaactgtgactcaagttgtagccgatatgaaacattagagaaaacaattaaccatacaatatttgaatgtcaccctgcatgacaaatttgggttctttcgcatataccttcggctcaaggggttttcccctcaagttctatttttacaaatatggatcatttattatggagagtcccttcaaaatttgattcattttccttccaatagataatttggtatatttggaaaacatgaaataataagattttagataatgtgaataaaaagacctattagatgtgctatatttagcggaaaaagaagcatatttagattaaaatatgcatgtaacattgttatatagaacaaaacgagcttcatacgggaagagagtaatatagtaataaatatatacatttctagataatacactataaacacttttgaactaatttggggtgtaacagataaaaagtaaactcataaaaacaaaatgataaaactatattaaataactaaaactgtaatatataactatttctgcacatttagtatgcagaattagcagtatatactttttaaaagggtattaaggttgtttttatcaaacttttattcaaaaattattttataaattaaatccgtggacacactgcaaaaccgaagtcataaagtgggatggattaagattgtcattttttagacagggagtttatgcggatcgaaatgtcgcaacctgcaaaacgaaattgaactcgtagaagacgggttaaccccgcatggacatctttagctgtgataaatatctttaacctttacgtagctattcaatcataatgattatgtactataattttcctatagctagagtaactactgatcatcgggtcgacaatatcaataggtctaatgtaaatgtttcattatacaatacgaaaaaatccaaactggtttgtgtaattatttgtctgcattttgactatttttaaaaagcaattttgtcttaagaatgtatcagattggaggaagaaaggaactttggtgaaactttgacacaaggatttcaaagagtcaaaaaagagaggaggaagctacatctagggacggctaataaaagaaagaaaagggtaaactaaacttaaatagttttgaagacaatgtgacctttgctgaacctttgagccatctttgtatatatagctctctctactcttgcctttgctagaaaattccaaaatattccaactcaaaatatttttattaattaataaaacaaaacaaagaagaaatatgccatttggcttgtttttcattagataaggtgcacatattgaagtggggctttctcattagcattttgacatgattatggagaagttgaacattattcaaaaccttcattacaatgccttcattcaacttagccgcacaaaaaaaaataaaaaaattagccccataaataagggaataaactccttcatacataagtagcaatcacttaggaaagtaggcattgtaatacaccatcaagataattcataatagaatgaagtagtttcgtacattgttaatattaattcttagaattaatgtaaatgatagcaagtacgatcagagcacttttaagtgcttttagtgtgatcgtgaaactgattctgaatagatttttgataggtgtgtatgatttatctccttataaaccggttttaacagattttatctaagtagggaaaacgggttttgaactgtagatgactaaatacattgtgttttcgacatatccatcttcttaaaccaagttatactctttatggtatattattatatatgtatgactaggggttggaaaatttccttatttttagacaagatttgaagttgtcattttgacgtcacgagggtcatatatataatgctttttcgataagaaaaagaaactaaaacattgaagaaaaaaagaacaacaaaacaaatcgatcttgaaaaagacgaagattgtgatttgtggtttttgacgtacatgcatgtctatttcttattttctgtttgtttttattttctcaaaaaagtaaaagaaaaaatgagaaatactgaaaaagccaaaggaagttgcgtttcatgagatcttgtggcatccagagaattttgggtgaaccctttgccaaccagacaaagtactattttgatggctatatgaattgttcaaatttgataggcaaaataatatatcaccacaaaaagatatcaacttcaccacatccacaagaaattcaggaaaattatctgaaaaatctagtttattatcattttcaaatttacaaggtattttaatattgattcatataaacatagcagaaccacaaattacgattgtccacgcagataaataaaagaagctgatcgtgaccattaaacatgaaagtaacacaaaataaaacataaatatctagtctagatagatagaacattcgtattttaataccgatcagatatctccattgttttgcctgtaaattttgacacctcttaatctttcaccttttgtggctagactccatcttcatatgttggttggtctctatctcaaaagtttgtaagattaaaaatgactctataatttatgaatgatgttaaacttctaatgatttttttttatatattagataaccaaacatatttttaagaccaattgaaatatgaaccataagattataagtgaaaacacaccatttctttcatcatacaataaattttactttgtcatagatatatgccatactattgaaaaacatagaatttagtacttatttatatgggtaaatataacaaataatattacattgtatatttttatagtaaatgacgcaatcttacatagaaatgtatatttctttcttgaatgtattgtgctcagttcgttactataatattaaactatggagtatataaacaaacatcgagcattgcccaccaaaaaataaaataaaacatcgagcataatttcttttatattcattttttggtagaattgtttctaatattatgaaactaggagttaaaatgaattttccttttagattaaaaaaaaagtttcacaaaaaaaaaaattaaaaaaaaaaatgaatcattagatctttattaaataaaacaaaacagaaatccatgtgtgagcatccaaacagatacacaaatatgtcttcccaatggtgtaaaaggcaaccaagaaacaaagtaacagtctaatagatagtattattggtttaagtggtgtagcaatcatagtggacgaagatttcttgaaccatcacattttttatatgtctatattgttagtatatgtgatgctaatgtagcctttctagatggaagctatggaataaagatgatgttttcagtgtaattggtccaagtattattggtttaagtggcagttgcttgcacatgctcgtgtggaccgtctgcacgtagcataatatttgttatgttatattctaatgttgaaaatccacgtaaaccgtcaaagagtaaataaactacgaatgtaaaaggacataaattagcatattagcatggatgatgcacaagcagttgctaattatgctcaacctggatcggtgaaagggagaaaataagtcgagtccagtaagaaaggcccaactaaatagaaaactgtgttttccaatagagcggaagaaaagccaagcctgctgagaatatttaactcgtgccaaaacagttaataggagttcaaaattattcagacaaatcaacgaaataaacactacgtctctctttctttttctgtttcgcaagagaagaataagtacaagaagaagaaatcgaagaaggaaaaaaaaaaagaatcgacatcaacgagaacaaaacaagtgaaagaagagacgagaaacgtaatgggccttttaagttaattaaatgttctgttgttggtttagacaaaacacacacaagataggccttaatgggccagaagaaattggcattaaaaagaagaacaagatagtgagtgtttagtccaaatttttaaataatcaaatatatagaacgataaatagatcatgttaacataattgatatttataatattaagttcattttatataaactatgagatggtttcatccatatattttaaaaatgttctaatggttaatttttaggttcctttactatgtgttattttaaaattaattactcataaatcataaaccaaaatagttttctgtttgaaactttctcaatttaaattacaatatttctatttttaatctcttattgacgtataaattcacttctctcataagtattaaaaaaaacaaaattaaattgttgggataattgttgtttttggtgagtttggataattgttttttagtaaaaataaatagtgaataaatatggtaaacatattaaatattgatacttcattaatcattatttaccaattcttatactgttatgaatttttattacatttgattggttgggctgtaagaaatttttaaagccactaaaaaagttacaaccccaaaatcgaaacaaacatgctttagctttcctattttttctcacagtccaaataatatatttttaattattttgtctgtaagttcatgtttttctaaagcacaattttatggtcttcacaaaggtctgtacctttttttctctttttttttcactttattttctcattttctttaaaaacattactataatttttatatatatattaaatttagttttatggatataaataataggcaaatatctactttatgacatatctataacttacattgtttttaatatatatatatatatatattaaatttatttgtaaattctattatataacacataagtacaatttaccaataatattttttgtttaaaaatacatacaaccataatcttatttctacaaccaatttttatcaagtaataatattaaattaataaaacctacagcctaatttgtacagcaataaaatctacaactacagtcatcacacatacaacaaaaattctacagttacagacgaactaatcacacacaagtgtatggttttataatatatattaaacaaaactcaaaatccaaaccaaactactgtatttaatttctatcatgtgtttttaacacaaatcgaaaaccaagcaaactattgtgtttaattctatatgttttaattatttttccaaaaattgttggatgcaaaactaaggatttaagctagtgtttattaaaaagaaaaattagaatgagaaaggcttcaaaactaaagttgggttgtcggttggaaacaagagttcaagagggtaaatcatagttgatagtactattatgaatgtcgctcttccgggattgcattcgcttacaaattattcgacgcatcgtcttggtcgaatatggatagtttgagatggagtggaagtttcggtaacactagctcacatgagtactcaaattattttctgttgggttaagtttcgaaatggagagatatttctagtatctttcgtctatgcatctaacttcatggaatgcaatggcttaagtggagagatcaaaactcgagttattttcaaaaagcagtatcggctagagcatcaagaaactcgattaaaagtttatcaaatgaagctggaaaagtcttgacagagttagaagacattaaaatagaggttgtggagtattgtaaaagaattatgcaagcgcaacctacatgactagtggagatatcatatgactacttatcagggttggtgaattttaaatattcccagactgctgctaaaaccttaatgcatccaattggtgttgacgagatggctatcctgctcagtttttaattgctgcttggtcgatcttggaaatgattttataatagcagtgcagtccttcttgatctttggatgcatgcccaaaagtgttaaatcaactattctgactcttgttcccaaaacagatggtgcacaaaatatgaaggagttcatactgatagcgtgatgcaatcttctatattaagtgatatataagataatagcaaaccggcttaaagttactttacaagaggcgatggaaccgaatcagagcacctttgtgaaggggaggctcttactagagaacatatttttagcaacaaaactagtcaaggactaccacaagcaatcactctcatctcgtttagcaattaagcttgatatctctaaagcgtttgacatagagcaatggccgtttattgctgctaggctacgtgtgatgggttatccatagctctttatacactagataaatatatgcatctctacgtcctcgttttgtttttttctctagctcttgtggtataaggaaaggatgctctctttcaccgtacttctatgttatcatcaacaatgttttgtcgactatgttaaacagagcagctgttatgaaagagattggttctcacccgttttgcaaggagataaagcttacacatcttagttttgctgatgatattatggtcttcatggatggtactcttggttctctctgcaacatcatgatagtggttgatgagtatgcccatatttcagtttttaacatcaatgtgtccaagtccacaatatttgatgcgggtcgagggaagatgactttggaaataggggccacatcagtagggttagtagtaagttctcttcccatttggtaccttgggctgcgctaaccacaaaagcaatgacgagacttgactacaaacctctacttgacaagataaggtctcgttttttaattggacaagcaagcacctctcacttgaggttgtctacaacttatgaactcagttatatgaagcatcttaattttctggtgttcagtcttcaggcttccaaaaaatgtttttagacattgaaaggaggtgtagttcattcctctagagtggatcatcgcttgatgcaactaaagcaaaagtgtcttgggaggaggtttgctactcaaaaaaggaagggggcttggggttccgcgtatgatggagatgtctttgatttatgcgttgagcctaatatggaggttatataccatgtcgggctctctatgggtggcatagataagtcattaccttctgcgccaagaatcattttgggatatcaaagcaacgtccttagggtcttcggttggacgtaagctgctcaagctttgcccacaagccattgagtttataagaatggaagtaaaagatggagttaagacacgatcctagtcggatacttggttgtcaatggggagtcttattgatcgtagttggagaaaggggaacatatgaattgggagtgcaccgagatgctacagttgcagaggttgtagcaagaggtcactggtcaatccgtcgtggtcagaaccaacatataagtttgattgtggaccagatcatagctaaagacccgtccgtacactcggctagtcaagatcatattctatggtggtatgcaccagacacatatgaagatgaattctcagctatgattacacggaaacaaattcttctttgtcgtccagagcaaccttgggcctgtacaatttggttttcataagttgtgtcgcggttcgcatttatagcttggcttgccgtaaaagattgcatgtcaacatgtgtaagagcaagagtgtgggggaggggatcatccgtgtctttttttgtagagaacccgaattttgataccggatcccgcaaactggatctcttatgtattccgaaggcccatcagtttccaagcccaagaaggatcatgttgcacaaaggaggtggtcaaatcttaacattaatttgtagtttaattcatggattaatgactatggtcaaaagaataaacttatcaatgaagtttatgaattgattgtgaaagttattttgtgaattaattctatagttaatgaccaaataatggcatattggaagaagaaaataggctattaaagataggtgaagactccaagaaaaatggggcttttacattttgaccacaaagcttaaacttaaacattcttattttctcattaatacacaaaagatttttttttctatttttatgtaagatctttacataaggaatactatactattttctatgtacaaattcttcgtacatttctatatactctcttatacttttactagctatgcgtatctgtcttgtacttttgtacttgagagtttaagcccacaaataatataaatacttgagtgtgtgaatccgacatccacattttggcactgtctgtggggtggaggcgaccatatccctttgacacataaagcggactatgagagagtccaccataagctaagggaattaagttgaaattccaccaaacaaccagttcggctcaagacatcaatatggtaattgaaaaaacgaggcagaccccgtttacctcgcaaattgcaaatttccaagtaaagattctcctaaggtcaaccgccctacatgtgaccaaaatgacaatctagagaaccacttagaggcattcaacatagagagcacgaatttgttgcagcaaaagaaggagattctcttttgaaaatatccaaaagctcggcaacgacaaatcggacgatgcatatctatctacctctttgcaagacatttttccgctgatttctggataccatcatattattcaacatatgctcatgatggcccaagagtcagcttcaaggagcccaacttttctttaaacggagttttcttagaagagttataatcaaacggatctatcatgaacagtggtttcgtggttcgagacttgagatccgttttgttttctttaggaggtaatgagattgcaaattgtgaaacattttctcgaacatgttctagatcccttgatttgtaaagtggtcaaagaagaaatagatttggctcttgaaaagcatctagcaaactgtgattcatcctttggaatagaaaacgaaacggatctcacgtctcgaaccacgaaaccactgttcatgatagagaaagtataaacggatctgcaagagccacaacatatccgaactcgtaaaacgcagatacaagccattacgtggtgaggtggtttccagatgactctcaaagaacctcgtgatgataaacctatccacgcgttgccccaggagtcagtttctcaaggagcccatccttgctttggacagaattgcctgtcaacaaaaatcatcaaatctctacaacaggtagaacatgtacgaaatcgtaaagtgcagattcaagccactttatgataaggtgattttccagcgacattcaaagaacctctgggagtaaaacctatccagacgttgccctgataatcagctttccaagtagcccaaatttgtttattggagttggatacggagagttatcatcaaatctttgcaacagatgtagtctgtagaaaattcccgaaatgcagatccgcctctatcaatcaagccaatgtcaagaagagttttacggtggaccagatataacctcaaagttaaactacaaccgcgtttcccaaagagtcaacttcctaaataacacgactttacttcaaacaaatatgtctgctaagaattatcgtcaaatctatgcaacaaatgcaatccgtacaaaattcaaaaaacacaggtccgtgcatgtcaaacgatcccacttcgggatgagtcccggcgaactacatggaaccacaagactatctacataccggcggaaagccccaagacttatctttccaacaaaaccaagcttgcatctggtgataagtctgcgtggaaatcctcattatatacgtgcaatcgcttcgttttggtgaaatctaagtgttgagtttgctcttcacaaaactagatttcatccctcgaggattttttcgagttccaactctcggaaaatgtattcatttatgtgaaatctaagtgttgagtccgctcttcacaagactaaatatcatcactcaaagatttttccaagttccaactcttggaaacatgtattcatttcggtgaaatctaagtgttgagtttctcttcacaaaactagatttcatcccccaaagatttttccgtgttccaactaatagaaaaatgtatctattccggtgaaatctaagtgttgagtacgctcttcacaagactagatatcatcactcaaagatttttccaatttccaactcttaaaagatgtattcatttcggtgaaatctaaatgttgacttcgctcttcacaaaactagatttcatccctcaaggatttttccgtgtttttcaattaaaaataaatatttatatcttacatgtgtataaatttggatcctttttatataatttttaaggaaataagacctaattgcttaaagaaatctaagtaaaaaatagtggaccctatacaaatgctcctttggcacactctctaagtcggctctggaagaagagaaacggtcaaaggcatgggactcacccacgtacgattacacacatggctcgtatgatagagaaaacggttggagaacgagtgatttccctttgctaccaagactcactaagcttgagacccccttttagagattgtttgctgtatttgctggacagccactgagattcttcctgcatgaatttgttgttgtaataggcttgtcctacgacaaattttctgaggagtaagacccaaaagatgatccaatttatgttgatggaaagaagtgttattggaacgagataatctacctccatgactatcctccattagaaaaaattaactcagttaaaacaattatttttgcttcctcatatttacgccctataaaatgaccttaaggtatttgtatttttaacatgtttctatacatcccgtcttatttactaatattagctttggacaaatgccagtggatccgctaataattactgatgataatgtagaccaaagttgagcacagtgggatgatggggtgaaagacatgaaagtttcatatatgtttgagttgataatgaaatctcatcaattcaaaaaagtgaatggccaggaggtgatgacacattaccattcatctcaatctcaaagaagaagctttctattgttcacaaaaggcacattgtcgattgtaagaagaaacaactgaaaaagaaatcaaatacaagtcaactatgggtgtagtctaagcttcccaaaccaaagcattggtattcgactcatacaaagtcagaactcaagctacctgatgatgagaagtccagtctcctcgttgaactataaaacaaggtggcaaagctatcaaagcgtgtaatgactgtgtacaagtcgaatacctatgctttgatttgtattttacgctctagaaaacactcttctagatttgctgaatgttcttctagatcaaggcgaatgctgctgcgtgaagtaaaatacagaagccacgatctccacagactccattgttttttttgtaggaatgaataaaaactttgtattcaataaaaaaagggttttcactttgaggttgattttttgtaattacatctcttgggcaatgctttgatcctttttcttaattggttgattttgtgtacacaaacttcattgttgctctcatacatactcaacatgattttcactaattctaaatcacctaccaaatccaaacgctctcatgttctattttgcaaggaaagagagaaagaaagttaagatgaagagagagagagagagagaaagagagagagagagagagagagagagagagagagagagagagagagagaagccgacgaagaagggaaaaagtgtatgtaatcttatcgatcagatattaactaccacttccatccaacgactcatcatatgccaacatatttgttcttttttaactcacaacaaactaaactcaaacgctggttatcttccttccttattattcagtggcaaattggtcacaatttcactcaaagagttggaaaagtgtcctcttcctcagacgtgtcccaaacatataaactttcctttaagtgcctctttgtgcaactcacccttattaaaatgaaatgataaacaattacacaccaacacattatagacacaaaagacctaaagtatctacactcatgacatgagcaactcactcggaacagagtcatatatatgaaaacctaatggcaaagaaaaagcaaatttggctaaccagtatgcgagacagttagtctgtcgacacatgatccattcagactatcaaattctttgatatgaagtcatgacataagcataccgagaatgacatcgaatgagaatcacaaaggttatggttggcaaggaacattacactccaaaaaaacatgtgatattccaacatatgtttccaataatcgtattttgttgaaactatctaaccgatatcctctaaaattgcattaaatattttgtttattgaaaatttattgcaaatttccaattaattttgataatggtaaatttatcacaaacgtagtaggaatattgttggaatttgccaacaaatatgatatttttgaaaattagcaataatttttaggttgttggaaattattaacaaaatatttgttagactaattctaacaatttgatgacaaaatatttgttgaaaagtggaaaaaaacaaaaaataaacaaaaacagggaaaatttagttagcatatatatgtacatatcaaaaaaaataaaaaaaaataatacacaaatcaaaaagaaaatggaatagaagaaaaggaaaaaaaaaagaaggaaaatattctaagttaaatatgattcatcgtcttctccttttatcttttttttttttttatgtgaagctttactttctctaaatcagaggaaaaattgaaaactgttttcaacgacaataccaaaaaacaaaaatcgtgagtggatggataattatacagatgaaggtaccagaaaattaacaaaggaatataaagaggtcttgttgactttatgtgttttgctgcaaatgatgagattccattggagtgtggtaagatgtattgtcctagacaagattatcaatacttcttgtgctaattcacattcagagttaagtcgtccttggaatttggaaaccatcttgtcaatgaccatgggaaggtagctcttaggttgagtagatgttcggtaagccaagcgtgcatctcgtagattttgtctcgccattttgatggaggaatttcgtcaagagagaaaccattatgtggttcggcattaaatcttggattccaatctagcggaggcttacgagattcttacctttcttcatagattctgccatcatcgctctccatgtccttttcttctacagttggttcggccatcatgaaatgcgggattaagacctcttcggctggttcatcctttatattttcagacattgttgtcgtggtttgccgcttaggatttctttcttgataagcaaccttctcaaggaaagtagtgattgggttggcatgttccaccataaattgtttgtcatttctttcgggtggagtttgaggctttgaggtgcttgggatatgttctttttctttgcccgttgattgcttcctttttatggcttgtctttctatagcaaccctttttggtaaaaaggaggatgaaccaaaaatacttggatcttgagaaaaagataaaggttgtgtttgaactgcataaggcgaagtataaatggggtaaagtgtgaaaagatcatattgtattggctggttttttggctagttttgtatggaatttaactgggctcttagggattttagttctgattctttttgggacatgaggggtgaatttatgaaaactgtattggctagatgaaggagttctttgtgtagagaggaaatttgtttggtaatgtctttgatataaaggtctatgatggatacctttttattaatttggctcaagagatagttccggctgctgcgttctctcattgccaatttagtgttgtttctgctattctaacttgttttatcgacccatctagatttttttgtgttcggatttcttatcttccatgagtgtttgatattgttttcttcaaagtcttgtgatgggaatgatggtcctaaacttggtgggggaccaaacatgtagctcaaccggatatcttatatatctggggttgtgggagtcgagttgcttggataccagacataatattcaaaatttcttccgcttggttctctgagtaaaccgtctgcgggtctccggactcatatcgttctttgagaatttgctgggaagattttttttttcttcgtcttggtgtttcgtcttcgtcagaactattcattaagcatttttcacaatcacaaatatcgaagaatttgtgacctgtctcataagcgaacgagtagacgggatctccgagtgaataaaaaaattctattggaatgccgggtagatgctttgctaactccttttgttctttttggttgttatcaattggagagattgtattgatttccgtatagaaagctgcaggtcttggcttttcttcttgttgtttaaaagcaatttccatcgctccatcttttcttctatgaatagaggaatccattgattgaattagggtacttctatcatggagtttttcgtaatttgtcacccatgactctggaaatagtttgaccagttcatctctaggtatttgtcttaggatgtggacgcatgatggactgtgttgtgactccagttggacaagtagggcatcttctgtgtctcttggtagacttagatccataacatgattttggactcgatacgccacctcgtggtgaagtgttgttgcataagtatttccaatttgtggggcacccgtgatttgtatgttgatttgcatgttctgatatttctggggatcttctagtaccacaataaagtttggaaataatgtaaaaaatattgttccagcgtttaaggttgtttggattgttgcgatgcatgcatgttgatattctttgtatctggtgtcgagaagggcgacccttgccacaacacgtagacctttccgtccatgaagagttagtgctagtcgtattgctccatagtaaagatgggtgtaaccatggactctccattgatgcaacattccttcattgagtcggaggggaatcatttgttctgtcttaattgccggattaagatgttgttctagttgagaggctagaagaatttcttttgccgcatgtttcttaggaccgaatccatgccttatgaattttgggaaagtggagtttggttttgtgaaggctttgtagggcttgagtaaagggagttgggtaatagggactttgctctcacatattctacttcacatagataatttacgttactagcattggattttctgaaagaagaggatgatataaaagaagatgtactttccatagtgtatgtggaagtcagaaaccataacaaaatactttgcttcttatctctcttgaagtaataacaaaccttgaattgtttttcttattataaataagtgctaagattaagaaattaatcaagaggtacttagctacgcaaactaaggcaaaacacttatcaaccttaaaagtctcaaggtacttcgagctctaagacctcattgatttctttttttatgttctctttttcttgctaaaacggatttctgatgtagaggatccattaatatggcaaccatagagcatactttccataatagcatatggtagaaaacagttataagatgtatcacgacttgagaagttaagagccaaagtttagactgccatagctctgataccaaaattacaaacacatagtaggtacaatcatgaaggaggttttataagatcgagatatataaactagtatatgaaagggatgaagtgtttatggaagagattagagtgggataagtatttttacaagagaaagcttttattatacaagaacactctcaagagaatacaaaggactcttaggattttagacactcacgcttgtgttcaactctcttcaccaagcttggtatctatagtaaatggcttaaggaatattacaaagcatattcctttcacacatatttacacacatactacacactatacatcaagtcttcacaccacatattttacatcatatcttcacaccacacatttcacatcaatgttttatttcacatcaatacttcatttcatactttcacttcatgtctttatttatattacatcaattcttcatttcacttcatactttatttaaattacaaacaaatagtaggtacaaccacgtaggatgttttataggatcgagatatataaactactatatgaaagggattaagtgtttatgaaagagtctagagtgagataagtatttttataagagagagcttttattatacaagaacactctcaagagaatacaatggaatcttaggattttagacactcaaacttgtgttcaactctcttcacctagcttactatttatagtaaatagcttaaggaatattacaaagcaattcttttcacacatacttacacacataccacacactttacatcaagtcttcacaccatatattttacatcatatcttcacaccacacatttcacatcaatgctatatttcacatcaatacttcatttcatactttcacttcatctctgttatgattatgatccaattccggtttaatgttggtctagtgatattcggtttagcagcagattggagttggttattgaagcggttagctttggtttacagaagaaggaagtttgattggaagactctcattcagaaagaggcttcgagactcgaagtcaaacacatataaatagaagtctgttatcttcttcttcttcattccgttagaaaagtgttgacgatctctcttaaacccagaaaattagggttcttagttgatcttgtattgagctcagagaagcttgtaaacatctcatatagtggattgccggatctatctggccccagacgtagatctaatcacaccgattagattgaactaggtaacaaattcttgtgtgttgttctctgtttcttctttgattcacacaaacaaacttcaattgagagtttgagagcaaacagagtgaggctcgtgttcgtattgggatctgttttacaacaagtggtatcagagcgaggcttactcgtttcttgattctgatcgatggcgacgactacaactagagttgagataaaggtgtttaatggcgatcgagatttctcgctatggaagatccgtatccaagcacaacttggtgttttgggattaaaagatactctcactgatttctctttaacgaagacagttccgcttaccaaaagtgaagcaaaacaagaatcaggtgatggagaatcttcaggtactaaagaagtaccagatcctgtgaagatcgaacaatcggaacaagcaaagaacatcatcatcaatcatatctctgatgtagtactattgaaggtaaatcattatgctacaactgcagatctctgggctactctgaacaagaagtacatggagacttcattacctaatcggatttacacgcaattgaaattgtactcgttcaagatggttagcacgatgactattgatcagaacgttgatgagttcttgaggattgtggctgaattaggcagcttagagattcaagtggatgaggaagttcaagccatattgatcttgaattcgttaccagcgagtcatattcagcttaaacacacgctgaaatatggaaacaagactcttacggttcaagatgttacatcctcggctaagtctctggaaagagagctggcagaagcagttgacttagacaaaggacaagcagctgtgttgtatactacagagaggggaagacctcttgtgagaaacaatcagaaaggaggtcaaggtaaagggcgtagtcgctctaactcaaaaacaaaggtgccttgctggtattgcaagaaagaaggacatgtgaaaaaagactgttactctcgcaagaaaaagatggaatcagaaggtcagggtgaggctggtgttatcacagagaagctagtgttttctgaagcattgagtgtcaatgaacagatggtaaaagatttgtggatacttgactctggatgcacttcacatatgacttcaaggcgagactggttcattagtttccaagaaaaaggaaacactacaatccttcttggtgatgaccattctgtggaatctcagggtcaaggaacaatcaggatagatacacatgggggtactatcaaaatcctagagaatgtgaaatatgtccctcacctcagaaggaatttaatttccacaggcactcttgacaagctagggtacagacatgaaggtggtgaagggaaggtcagatatttcaagaataataagacagctctgcgtggaagtctgtcaaatggattgtatgttctggatggaagcacagtaatgtcagaactgtgtaatgctgagactgataaggtgaaaactgccctgtggcatagcagacttggacatatgagtatgaataacctgaaagtgttagcaggaaaaggacttattgacagaaaagaaataaatgagttggagttttgcgaacattgtgttatgggaaagtccaagaaggtcagttttaatgtggggaagcatacatcagaggatgcactgagctatgtgcatgcggatctctggggctctccaaatgtaaccccatcgatctcagggaaacaatatttcttgtccatcatcgatgataaaacaagaaaggtatggctgtatttccttaagtctaaagatgagacttttgataagttttgtgagtggaaaagcctagttgagaatcaggttaacaagaaagtgaagtgtctgagaacagacaatggtttagagttctgtaactctaggtttgattcttactgtaaagaacatggcattgagagacacaggacctgcacatacactcctcagcaaaatggagtagcagaaagaatgaataggactattatggaaaaagtaaggtgtttgttgaataagtcaggagtagaagaggtcttctgggctgaagcagctgccactgcagcatacttgataaatagatctcctgcctctgctattaaccacaatgtaccagaagagatgtggcttaataggaaacccggttacaagcacctcaggaaatttggatccattgcctatgtacatcaggatcagggaaaattgaaaccaagagctctaaaaggtttcttcctgggatatcctgcaggaaccaaaggctacaaggtttggttacttgaagaagaaaaatgtgtcatcagcagaaatgttgtgtttcaggaatcagtggtctacagagaccttaaagtaaaagaagatgacactgacaatctgaatcagaaagagactacatcgtcagaagttgagcagaataagtttgcagaggctagcgggtcaggtggagttattcaacttcagagtgacagtgagccgattacagaaggtgaacagagttctgattcagaagaagaggtggagtactctgagaaaacgcaggagactcccaaaaggacaggactgactacatataagcttgcaagggatagagtcaggagaaatatcaaccctccgactagattcacagaagaaagcagtgtgacatttgcattggttgttgtggaaaactgcattgtacaggaaccacaaagttatcaagaagctatggagagtcaggactgtgaaaaatgggacatggctacacatgatgaaatggattcattaatgaaaaatggaacctgggatcttgtggacaagcctaaagacagaaagattattggatgcaggtggctgtttaaattgaagtctggaattcctggtgtggaaccaacaaggtttaaggcacgtttggtagccaaaggctatactcaaagagaaggagtggactatcaggagatatttgcacctgtggttaaacatgtttcgataagaattctaatgtctttggtggttgataaggacttagaactcgaacaaatggatgttaagacgacgttcttgcatggtgacttggaagaagagttgtacatggagcaacctgaaggctttgtgtcagattcaagtgagaataaagtttgcaggctcaagaaatccttgtacggattaaagcaatctcctcggcagtggaacaagagatttgatcgttttatgtcaagtcaacagttcatcaggagtgaacatgatgcatgcgtctatgtcaagcatgtaagtgaacatgatttcatctacttactgctttatgttgatgatatgcttattgctggagctagcaaggctgagattaacagggttaaagaacagttaagtactgagtttgaaatgaaggatatgggaggtgctagtcggattcttggtattgacatttacagagacagaaaaggtggagttttgaagctgtctcaggaaatctacattagaaaggtactggacagatttaatatgagtggagctaaaatgactaacgcaccagttggtgctcatttcaagttagctgcagtaagggaggaagatgagtgtgttgacactgatgtagtcccatactcaagtgcagtggggagtatcatgtacgcgatgcttggtactcgtcctgatttagcttatgctatttgtctgatcagcagatacatgagcaaacctggtagtatgcactgggaagcagttaaatgggttatgaggtatttgaagggagctcaagacctgaacttggtctttacaaaagaaaaagacttcactgtaacaggatactgtgattctaattatgcagcagacctagacagaaggagatccataagtggatatgttttcactattggtggcaatacagtgagctggaaggcgagtctgcagccggtggtagctatgtctactacagaagcagagtacattgcactagcggaagctgctaaagaagcaatgtggattaaaggactgttacaagacatgggaatgcagcaggataaggtaaaaatctggtgtgattcacagtctgcaatttgtttgtctaagaacagtgtttatcacgaacggactaagcacatagatgtgaggttcaattacatcagagatgttgtagagtctggtgatgtggatgtgttgaagattcacacgtcgagaaatcctgtagatgcattaaccaagtgcattcctgtgaacaagttcaagtcagctttaggtgttctgaagctgatgaagtgggactgagtttgctcagctcaagccagaggtaaagtccaagtaagtgcagttcatgatattgagatgggaatgggatcaaggtggagattgttatgattatgatccaattcgggtttaatgttggtctggtgatatttggtttagcagcagattggagttggttattgaagcggttagctttggtttacagaagaaggaagtttgattggaagactctcattcagaaagaggcttcgagactcgaagtcaaacacatataaatagaagtctgttatcttcttcttcttcattccgttagaaagttgttgacaatttctcttaaacccagaaaattagggttctttgttgatcttgtattgagctcagagaagcttgtaaagatctcatatagtagattgccggatctatctggcccttgacgtagatctatcacatcgattagattgaactgggtaacaaattcttgtgtgttgttctctgtttttcgttctctgtttcttctttgattcacacaaacaaacttcaattgagagattgagagcaaacagagtgaggctcgtgttcgtattgggatctgttttacaacaatctctttatatattttacatcaattcttcatttcacttcatactttatttaaattacaaacacatagtacaaccacgtatgatgttttataggatcaaaatatataaattagtatatgaaagagattaagtgtttatggaagagactagagtgggataaatatttttataagacaaagcttttattatacaagaacactctcaagagaatacaaaggactcttaggattttagacactcaagcttttgttcaactctcttcaccaaacttggtatttatagtaaatagcttaaaaaatattacaaagcatattcctttcacacatatctacccacacactacacactttaaatcaaatcttcataccacatattttacatcatatcttcacacaacacatttcacatcaatgctttatttcacattaatacttcacttcatacttacatttcatgtctttatttatttcatatcaattctgcattacacatcataatttgtttatccatgtttccaaaagagaggtaatgtccaccatagtcgttgtcgtcttcttcactgtcagaggcttcaaccgtcacatagatgttttgtccgagatgcattttttgaatttgtacctttttccattgactttgtagataggatgatgtggatgagagtgtggccacgcttattgatcatgaaagcctgctagtactttttgtattttgtcctcaactcctaatggaaacacgtctctattatgccaatgtgccgtatatggacaaaaaagctttatgtcaaggtgtgacacatctaacccattcaatgctgctataacttctgctctttggtgaaagtcgttttcgctaatgtcatcattattgtaactagtcgtgacatgtgcttcatatatcttctttattgtgactccattcttttcttggttttggattgtagtatcttgaaagtgactaggatgatcagctctggttgtgcacgaatctgttcttgccaccacgtcacattgttaaacaatgtcagccacttgtatagtagcatgtaatgaggacttcttctggtcaagatgcacttcgccaagtattgaagcagatcctttttgtgaacaaggacaccaatagtgtaaaggtgtgccaaataccagaacactagatatgcttttattgaaaatcttctatagtgaaccggattcaggtttatggtggtgagaaatggatacatcgggtcataagataaaccaaggagtggtccttgatcaagaccattatccagcatcctctcccgtaagccttgtggcattcttgcgatcatgcttcttaaaaacctattatccatttggcgccgttgccaattgggtgtttgtttgttacatttgagatttcacacttgcttagatcaagttctttttcaattttcaattcagttactaactgtgtgtttttcttgttgtcttcttgatccaggtacaactctgctgcatgcaaactcgatcaacagacaaccagaacctcctcttcaacgacaacttcgaccgcgtaactcgcgaactcagagaaaggagaaacacagtcaaccttttaccctaacaaccactcgaaatggttgacgaacaaaatcaatagaatggccctgccaacattggtgctgaagatgcaccacgagatcaccgtcagaggaaagatattgcacctccttctatccagaataacaacttcaagattaagagtggtctcatctcgatgactcatgggaacaaattccatggtctgccaatggaagattccctcgaccaccttgatgaattcgataggctttacaacctaacaaaaattaatggtgtcagtgaagacggatttaagttccgtttgtttccattctccttgggcgacaaagcacacatctgagagaagaatctaccacatgactcaatcaccacctgggatgattgcaagaaggcttttctagcaaagttcttctccaacgccagaactgcaagactcagaaatgagatttctggcttttcacagaagactggtgaaagcttctgtgaagcatgggagcgtttcaagggttacaccaaccaatgccctcatcatggcttcaagaaagcctctctgctcagcattctttacagaagagttttaccacgcatccaaatgcttctagataccgccagcatgggaatttccagaacaaagatgttgaagaaggctgggaattggttgagaatcttgctcaatcatatggtaattacaacgaagactgcgacaggaccatcagaggcacagctgattttgatgacaaacacaggaaggagatcaaagcgctgaatgacaagctggacatgattcttcttagccagcagaagcatgtgcacttccttgttgatgacgagcaatatcaggtccaagatggggaggggaaccagttagaggaagttagctacatcaacaatcaaggattcaaggtggctacaaaggatacaacaatttcaagactaacaaccccaaccaatcttaccgcaacaccaacgttgcaaatccacaggatcaagtgtatcctccacatcaccaacaaggtcagaacaaaccttttgttccctacaatcaaggttttgttcccaagcagcaatccgcatctacttctgctcccaaagttacgggacttccagggaagtcaattcagaatcccaaggagtatgctaatgttcatgttatcaccataatgagtagaagagagttatccactagagagagacccaagtcagtcactaaggacagcgcataccaagatggggaggatttcagtctcaatgaagatcaagttgacaaaccaactgaagtacttgagcccatactcgaccttgatactcgaccaacaaatccattaacatcatccgctgctctaaaactagttgctgctaaaaacagtgagacatcattcattcctcctcacaagcccccacttccatttcctggtcgacacaagaaagagttagaagataagtacagtgctatgtttgccaagaacatcaaggaagtcgaattaaggatacctcttgctgatgctctcacgcgtatcccggattcccaaaagttcctcaaagacttgatcatggagacaattcaagaggttcagaaaacaatagttctgagccatgagtgcagtgccatcatacaggagaacgatgtctcagaaaagctaggagaccctggttcattcactctaccatgctccataggttcattgactttcaataaatgcctttgtgacctaggagcatcagtaagtctaatgccactctcagtagctaagaggttaggtttcaacaaatataaatattgcaatatctccttgatcttggctgatgggtctgttagacaacctcatgggttattagaagatttccctatcaagattggaaatgtggaggtgcctatagacttcatagtgttgaacatggatgaagaacgaaaagatcccttgatcttaggaaggccctttttggctacagctggagcaatcatagatgttaagcaaggaaagattgatcttaatatggggaaggaatttaaaatgaagtttgacatcaatgatgctatgaagaagctgacaatagaaggacagaccttcttagttgaggaaatggatcggctagttgattaactgctcgtggaacttgaagaagcaaataactcaaaaactattttgaccaagagtggtaaagctgggtatctccctagtgaaactttgagttctgagaagtcattagactcacacaagtcagtagttggctcaaaggtttacaagggcttgctggggtctgacacaaaggttatgaaagctaatgaagtaagttcaacacatgctcgaccaactgattccaccaacaactcgaagaagcctccaacttgccttgaaagctcatgctcgaccaaacaactcaaggcaaacactcagacgtcagatgattggttagaactcaaggagagatctaaatggcaggacaaagccatacaagagctaacacatattgtgaaagagctgaaggatcaaatcaaggagctcaatggaaaagccaaccaagtaccacttaacatcaaggacgcccctgacgatggagctactattcttgtcagcaaagaaggatgtgaattcacatcaaaatggtctagaggagaaggttatcttgataaaaaagaagcttactgtgaggacatggccactgagtacccaattgtagacctatcaagaaaccttaatgagtatgatgatcactctactcaagaaggagaggagacctcatttcctctcttcaacccaccctaagcctaatgagtatgagaagtcaagcttagagacttaaaacaagctcacttgggaggaattcccatgtctatctatgtacatatctttatttttccttgttgtttttgatgcatttggttagtgtcttcaggagataagtataaagagctgagtgaagtggattctaggtctgagggtacagtagtatactcgaccacagagcaatgaaaactacttgaccatgttttagcttacccacgccaggagatcccttgaccgcggtgctggatgcagcagaagaatggaagtcgagtatactcatggcggtgctggtcgccacaaaggcaatgaggtacagtacccacatgctggagctgagacagaacagggcgactcttcaatggcctgggagcaatcacaggcagccattgacgaccaactccgttcattctttgactgaggtaagcgcctcacttcaccattgtactataccatctcttgtttatattttgtttctgtgatttgacttgtcctgagtactctcttccaagtttagtcacacagtggactatgtgatttaagtttgggggagggctcaggaagtgtgtgctacattgtatatactcttgagttgagtctgcattcatttaaggcatagaaaaaaccaaaaaaattgaaaattttcagaaaatgatttcacaaaaacagagtgttcatgtagttgcattacatttaggatcgagtctagagttttcatttaggattgttgcatatgcataggggacaatgcggagataaccttgtaagcatgatgattcactaaatgagttattagttctctgatgcatttgaatgactttgaagtaaaaccgcaccatgttctatagaaaccactcattgcatgtcatgacacctttccctgtcaatttgaacttgaatctgacttataattatcatgtttgcatcggttttgaactcatggatagaatatatatttggattttctttcacttattcaccactcttgctaatccaagtagctgcttctattattggagtagttcccccacccttaaccaacccttctttcaagccatgttatttgtgagagcatgtgaggcctattttcaggactgagcttggtagaacgtgttaggtttgagccgacaagagtagtatcccatgtacttccaatccgcgttttcggacttggtaggactaggtgggaacttatttgggaattgagattgaatgtgaaaagaaaagaaagtaaacgagttagaatctttaggagaaggaagctaaaaatcatattgaggtctagtgaatgtttgggaagcatagaattgataagatatactctaaaaaaaaaaatggcaacaaaaacagaaaagaaaagaaaaaaaaaatcataagagccattagagtttaagaaaaactcaattcactagactagactcatagagtttaagaaaaacttctccttaagaggaagagccaaagaaatgaaaggaaatgttttgatccaagaaaaaattgaaatatgcctttagtgcaaaaaggtagacttaggatcatcattgggtttagagataggaccatctacttgttattcacggtttatgtcattgggtagatggggtgctattcttgtatgcataggttggcacttacctttagcattcttctaaagctcagtcatttttcattgagagtcccatgttattaaagtctgaaccatcttaaagggaccatctttgtctcataacccgtctttagccaaatgagttcactagcgatgcatatcttgattcatgttcttgaacttaatgaatgttaaagtgattggttgatcttgacgtattgtgcaattgagtgtgaatttggatcataacagagcatggctaaagtttttaagtagaagtcgatcacctcgcattttagaactgttagcttataaatttatcttaattgtcatgtctcatgctttggttcggagtccccactttcaaacctcacctccagcttgttcttaattgtttgcttgagggcaagcaaatactaagtttgggggagttgataagtgtgcattttacacgttttgagcatccatttgtcatcactttaacatcatatcaccactgttttataccatttctcttcatttgtcatcactttgcatgcttaggatagttttgcatgcatattgcgtatttgtgttgtttttaggtgattttgagctgctaatgagctaattggaagaagtggacctgatcaaatcaacatactcgaccacgagctcgagtacagtcatcctggagttcctgaagtactcggccacaacctctacaacaattcactcgaccaatcactctaccaaaaggtagagtatcaccatcatcattcactcgaccaatcactctatcaacatggccgtgtcccaccatcatcactcgactaatcactctaccaacatgaccgagtatcaccatcatcattcactcgactaatcactctaccaacatgaccgagtatcaccatcatcattcactcgaccaatcactctaccaaaaggtcgagtatcaccaccatcattcactcgaccaatcactctaccaacgtggccaagtatcaccatcatcatccactcgacagaatactcgactgctagcttcagagtcttctccattctgcactcaaccagagtctcgggcacaaggaagagtagaagactccagcttatcactcgaccaatcactcgaccacatgggtcgagtgccgttcttaatccgtcccaatactgtgtcgttttgagtactagggtttcagaatatttcgctataaatagcatgtatttttattctcgtttttatctagtttttattccgcagataatgtgttcttgaccttttgtaatcgggatttctcttaatctattcattattcaacattttcttttgatttcgtttactggtgttcatcttgttatcatcttgtgctattactctgttgttatcatgttttcattctattcaacgtttatgttttctcctatgatgtctgagtagtgaataggtttatgaggatgggttatagtagtttagaattctcagtatgctaggtggttgagtttgatttatagatcccttctggattagttgttcttaatgcctattgctttctgatcaactggaatttgaacccagacatttccgcgcccaaatggtgttcgatgaaatgtctaaactagtaccaaggtattggttacaaggagcgttttggctttaacttgttgattcgtaatgcctgttaggctagctctcgtcaatggtgattgagtctgggactagtttaacttgaggatctctattgcggtggcacttagatttggttaccgaacttattgtctagggataatttattgagcatgttgtttactgcatcttgtcacctgttgcttagtttctacaattctttcctgttactcgacccgatactcgaccacccagttgtctggcaacaaactctacagtcgagtatctttgttttattgactacttgttactcgaccagtcactcgaccacacccagtgctttacgacgagctgtgttggtcgagtgtctttttgtttctgcttgattttcggttttctacatgttcatttaggactgctagaaacaccaaaacctgttattgcttggcttgactctgtgaactctgattgcatcttgattgttagcatcacacccatttggattgacaaccttcaatactagaacgacatgatagtgctttacgattaattgatcttaaaaacctattatcagggttctccgaactgagagtacaaatcatcaggacaatggttgagatttttcgttgccttcttcataggaagtcaaggaggaagttgtattttcctttgatatgtttcacatcaaacttccattgtgaaaaccaactcgcccacctaagtagttgtgcttatgggtcatttttggaaatgatgacatgtccatctcaatacggaagtgatggctcaccatgagaaactcagtttttttaatacctctttttactgcgagtatctccttgtaagtggaatggtagtgttttcactatctttgaagactccactcttgtaaccacatatatgcctttttcctttttcatcttcttccaagaggactgctctccagtaagaatcacttgcatctgtctgcagaatttgttttcttctggatggaatcttcaaggctagcaaggtcttggaaattgtttttaattttttgactgcttctatgtatttttgatcccatggaggagcgtttttcttgagttgagctgagagtatggatctgtgttcgccagagcatggaggaattctgacatttagttgacaatgccgaagaattgctgaacttgcttgaaagagagttcttcatcagggaactcgtcgagctgcgttgcaatatgaggctgaaaatagtattcttctttagaaatatgcattccaagaaaatctatctcagggaaggtgcaatctttaatccaaacggcatgactttccaatggtaatgtcggtcttgtatgcaaaaccccgtctttggtctatcttctggtttgattccaagttgccaaaatcctgcttttaagtcaaatttcgagaagacttgtgcttgggggagcctctggaatagaaattctcactttggtagaggaaacttgtcgtttgaaggaaatgattgagcggctggtagtagataactaacctcagttttcctcgtacttgttcggctcttttgttaacatagaaggcttcgcatgcccatggggaggtggttttctcactaaggtcttctctttggagttagtcgacttcttcgagagtaaaattataacggtctggattcattcctggatggcttgcttttgttggatagatatcctcattcttcttgaagggtaatgatatgaagaagtccaggttcttccataaaggtgatgaacatttggtgaggaactctgaatgtgtgtagcacaagaagtattgataatcccgtctttgatggggttaatatctccatgggatagagatgggagatagtagtccatggtagcagttggttcttgtgcttaagtccctttggatgccaagatactctcttaaagctatgaagtacatcaaatccaagtatgaaatattttccagggagttcggactcatatactttggctttgatcatgtatccttaaaagagttggatgtaagtgggcttgctgactaaggagatgtggaagatctggccatttgctgccttgaaagctactgaataggaattccaatgagaggctggaagtatgtctggcttgatgatatatgatgctgctccagtgtcgagataagcaatgacttggatgagcttgtcatatttgttgggaaagatgtaacttttggcgtttgctgatggttgagatatatacgtcagttcttctttctgcggttgttcgactctacaagcatcaaatgtgtagaggtcgaataacatgaattgatcatctgtatcttctttttcttcttcagtgcttgattaatatgaagtcttctttttgtttgatatccattgctagaactatatcatcggttggttcatcatcaagggagaagattgattcaatgtcggagtcatcaatatcttctatctatgctaagtatccaagaagattatctcttttttcttatttgggcattgttttgcatagtgacctttttcttgcagatgtaatacctgtctgatttcttgaaatctctttgtgactttttcctgaagaatttccacttctttttgctagacagatgaggatacttcttctgccattttttcttgaattttttttctttctgataatttgttgaacatccacacttcttctctttgcattttatagagaaatctgaacgatcacatgctctccttagtagttttccttcctcatgcatctgcttgaagaacttctggtgattgcatagcttttctagtgtcgcaagagacatctggaatatttctcctaatgaggcttgagcaactgttgcatttttgaaggataacaaccgtgaagttttatttccaagtggctctggtaatgaattcaaatacgtctgtttgagattgacatcgtctatactgtttaaagcgtagaatctttttaacatcctctcataatgtttttctagatcctttcttttgaaagagcaacacttcatgttgaggtattcttctcttgcttgaatggtgtagtgatcccatgttctctaagaaattcattgtggatgtgtccaatcaatgcatcaatcgaaggagtttgacattcttcttatggtaatgagaaacttattttagtagataatatttggaagcatttttatagaagaggatttgcgcctggatattacatatgatttttacatggggaagattttcaaacttagtactaaccaaaacaatggagatgctgaaaattgtgaattggaacttggaaataataatagtactgataaggaagagaatacaactagagattcaaccggtgtaatacagatggtaatagatgcttttcgcgaaaagactgaaagtggaactggagaacaaaacttagatgcgaaaaagttttttgatatgttagatgcagcgaagaaactaatttatgatggttgttgatatgttgcatttttagtgtcttaggtccctttgttttgagtcatttatcatgtcgtagtccgtcttttgcgtttttttcgttgtgtcttgagtcttttgcaggttttagatacttctgacaggattggatggtttgaacttgctcaggtcgagagagggtgagaaaatctcaagtggggagaaaacggtgtagaccgattggtcctgataggactgatcggtctatgcctcgtcgattgggcagagacggttggaccaatcggtccagcactaaatcgatcggtccgtgcttcaacagacggccagagacggttggaccgatcggtttgataacatgacgcaagatttcagttttccttaactggatttatcttatattttctgtaattgggtataaaaactccagagacctaattttctatttacgcttctttttctaaaactttttgagagcgtttttatgtaaacaacttttggagaaggatccatcctctttgacactttggaaaatatttctaatcccttttcttttatattccattaatctattatatcttcttcaactctttgtgttgtttattttcctatgagagagtagtctcttaattggattttaaggttctaagtaggagattaaatgaattcatggtttgattgttgtttggagttttttatcttgaagttctttgattcacatgttcttaatgctagaataggattgatcaccctattttagagtctaggtttttctatgcatcaaaagtgtacgatagaacatttgaaccaatgcgaattgagcattgtatttctagccaacgagagttgacgttagaatgaatcgtgaacctaatgaacctaattctaatgcgaatttgactagaaaattacaaatgacaatttagtagtcaagtaatcaaatttagtgattaatgtcttaagagggaattagtcttaacttgtgttcatgttcgagaacggctctttatgttaaatttcctgtctaatattttcattaatcattgatctccaaaatatcctatggcccaatgctttttatcatataagtttaatcgtttatttttttataatttaatctacaattctgaaaataaaacaaacaacctctttagttttagttaagaacgagtcttggaaatccttagagtatctttgatccttgtggatcgacctcgaatatactacctagcggttaagtatattgagtaattactcgagcaatcaagttggcgtcattgtcggggaccaattgtgttacctaaggatttaggattagtttctaatctaaaatatttttatttactgttactgattatcattttcgccttttctttatatttttcaggtgtatgatttctgtagccaagactcatcacatctagcagactaccataaggatggatatcagaaagtttaaaagagagaaaaagaaaaagaagcagttagctgagtagagagaagctgaaatgtctgattgtattgctgcaagaaatattttgagtgatgatggactccaatttgctggagaacatcatggagagtttcaggatccaccacctcttggaaccattaatcctcctgttgctactgaaaacgttgcccgtgtagctgttgctaatgttgcttctttagctgcgttaaatgctaggcatgcgcctcgacaaactcagagggattataatgctcccaatgttgagcttttatgagatatgaaccaacaactccctatcaataggaatgattttgagatgaaaattgggttgttgtctcttgtgaatctgagaatctggtctaccatttggataattttgaggatatatgtgggacgacgaaattgaatagagtgccaaatgttctaatcaaccgtaaattgttctcattctccttggcagacaaaacccatcgcttgtttaagtctatgaatccggagaatctgagaagttgggaagattacaaagctgcattcttgacacagtattttacccagtccaggacagccattatgaggaatgagatctcctcctttcagcaaaccggtactaaatcattccatgaagcttgggagcggttcaaagtttactatagggaatgccctcaccacggatttcgatatgccacattgatcaacactttctacatgggagtcgataaggactacaagatggcgttagacactactagtaatagggactttatgaccaagactgaggaggaagctacacaactaattgagaatcttgcacctagcaacaacaaccacagtgttgactataataggtcacataaaggtgttagaggaggaaaatcaaagcaaattgttgagttaactaccaatgttgtgcaactcctgaggacatatcaaataactgtcaatttttgtgagaattctggtaaaggtccagtacatcaagtgttcagcggagatggttctgaagatctacaagcagtgttgaactttgtgaatgggtatgagaaagatcaagacagagggttcaaccagaactacatgaaccatcccaagctttcctacaggagtactaatgttaagtatcctccggatcaagtgtatcccactcaggcagggtcacagggtcagcaatttcagcctcataagagttttcagaataaaggtagctaccgaggacaattccaacttccaacatgtactgctaatgcgtcttcatctgggataatcagatgaaattgatggtgcagcagattcttgaaggtgagaagaagaatgctgctaagatcaatgtaaaggtggataaaccgtacaatgatctcaatgggaagtttagaacactatcctcacaaagatccttgagagtcaagtctctcagactgtttttgcctctacgcgaccaactggtgctcaatctgggaaagtataacccaagagtaaaaagtagtgttatgcgattatgatccacaaagagcctcgagagattgatgtcgccaaacaggtggaagctaatgttgttgttttttagacacttgtagaggacatgattgaagaggatgatgaaccaccatatgtggagccgccaccctatagccctaagcttccatttccaggccgtgagagacagattcaaagtcagaaagagtatgcacgttttgctaagatcatgtaacaactttacgccagactttctttcttacagtttgttctccatgttccaagctatagaagttaccttaaagatatcttatccaacaagaggggcattaaggaaggggttatgttagtttccaaaggagaagagtatgctcagctggaggaatatcagagacaataaaaagaagcttagctcactgatctagtagaggtgttagcaggtaaagagatggtcaacatttgtagtgccatccttccacctactattcccgaatagcaggtgattcagggagttttgttttattttgtcggattggaaaatctttattcgagagatgtctttatgatttaggagctggagttaacttgatgcctctttctatgtcaatacgactaggcatcaccaatttcaaccctttatagatctctttaattctagcagatcgctctatgcgatttccagtgggtttggctgagaatgtgcatgttagagttggaaatttttacattcccactgattttgttgtcttggaacttgctaaggaaccacatgaccctctcattcttggtaggctattcttaaataccacaggagccataattgatgtgagtacaagcacgattaaccttcagattggggactttgctttggtgtttgacatgagaaggacaaggaaaaatcccaccattgaaggtcatgcattttctatagacaaaaatgataagcctggtgctgaatgtataaaggattgtattgagtggagtgatattgaggaagtcctggatggagacacgaaagattctcatgttacattgacaccactatagcgtgtaggaaacaccatcgagtataaggtgcaatgtaaggaaacctcgaaacctttctccaaagctaggagcattctcacttcagagtggaaagagaaaggtggaaaagctgtgaaatgagtagttggtaaagttctaaggatgaagttgaatgattgggaccggatcaagtttccgcactcgtgcccattgattaacaagaatccggtcaagctagtgacacaaaacaagcgcttagtgggagacaatctaccaggtattctctttacatacattcatctttgttcttccttatttccttttgagtatatccgacatctccttttcaaattgttctcatactgagacggtgtgaagcaagtcgaggagaggatgtcatttgtctactaatcgagtttcctttgattgttttcttttgttcattcgtttgagtgagtcctttcgattttatcgagtcaaaatggtgtctttttattgagtcaaaatgttgtaagaattgtgatatttttttagaaaattgcaccttgcttgatttcattgcctagggaccattttagcattattcgataacttagaaggtcagaaaaatccatcactagattgctttatagtagtccctatctctttgaaatttgcaatgaatggagctttattttatatacttgaccttaatatggacttaatttatttcacttaaaggcttgagaatcatgtaatggatatacattcaaagtattccttgaatcagttttatcattctttgctaactttgaatggctagactcatttatagtctagtaccacacctattcccttacctattgtttgaaacctcatgcactcttatatagtcattatgatatgcatccatgtgcaaaaactatggagtatacgaaccaacatagctctccttctactaggatagtgtaagagcatcattaaaagagggaattttagaggtttcttagggtaattaaggatttaaattcaatgttaattgatgaatgaactttagagccgctcttagcttggaggtgctctgaggtttaatgcggggtgacgtggcaacaatttcttagttgtattgggaaatattaaagccaaaaaattattcccgtgcattttcttcctcctctctttctctctctcacttcggcaataacgccgagccaaagcaaaaaaaaattgacgcgatttgtaacccaccagtgtttctaatgagaatcatcttcatcatgatttgttatccgacggtgctttatatgcgcgctcttcttcctgggaatctccatcatcatcatggttgtcgtcatggtcaactattttcaccagatctccggtgaaagcttggaaaatcggagtcaaatcgtcagcaatcaatttgttaagataagaacgcctctcctcttgtattaattgatgtgattttagtttttagaaattagggttcaagggaattatgggttttgagtattgtcgattaaattgatcctcttttgtttgtaattgtttgattctttggtatattttgtgcttattccataataggcaaattgatcggttaaaggaaatgataagaaaggagtagatttatcgttttcaatgcttggctacttgcatttctgtgattcatttctttcaaattggttatgtttatagttgggatcagatgctgtcaaccaaaagaacatgatacttttgaggacgattcactgacttttcatgcatcgtgttatgtagcaaaagtaaggaaatgataactaacttgcttgatttggcaacaatatgctttctatggttacacattttagtctacaattaatttttggattttggcatcgaaggttcactcctttatttgttctgtttctagatcactttgaaagcattggaagggatgtttgaagctgcaagagctatcaagagttggtttggtaattgtgcaagagctatcaagagttggtttggtgattgtacaaaggtcacttcttttaaaaacaattagtactatacttgatttgattggtcttaatgttgctatctctaatatgtttaagtttaattacattgcagttgtaagaaggagtgtgcatctgttggaatagtgttgtcttcttaaagaagttatgaaacagaatatggttagaaggtaaacgtctcttccttttttcatttactcatcaaagttgagttgagaattaaaagtatttactaggtcacatttattgcttattgcttgttgaatttaatttattgcttatttactttgattaggtaaagtaataagtgttgacattgattgctatttcaacaatccattaaccaaaacttaaaaagttaccttatataagcaacaattataatcggagttgtacaaacaccttcttaattctcttgcattttgttttcaagctaaatgaatccctttcctaaccaagccaatttcattgatcttttaacaagtcaacatgaaaccccaaaccgtcaacccaacccttatgagacacattcaccaagtattaaacttggtgaatctgaattccttgtctttaacacccaatggcatgaatcacatcttcaaggtggaaacacaactactaagcgcacaactactacgaggaacaagtggacaagtaaagaagatatcgtcctcatatctacttggctaaacacaagcaaagattcagtagttgggaatgagcagagagctgatgctttctggaagcgtgttgtagtttattttgcaagtactctgaatgtttctagtcagataaagagagaaccaagccactctaaacaaaggtggggaaaaatcaacaagattgtatgcatgtttggtggatcacatgaagcagcaaacactcagatggcgtctggaatgaatgaggatgttttgatgaagttagccaatgagatttacgagaatgattagggttttaagtttagcttggaacatgcttggagaatattaagacctcatcaaaagtgatgtgcatcactgcctactgaagtagctatcacgagtaagaaaaagaaggctgaggcaaagaaggctgaggaaaatgagtctccatctgttgtgaatcttgacgatcaccatggagagactgaagctcgcccacctagtgtgaaggctgccaaaagtaaaggtaaaatgaaggccaacacttcagcaacaatggaaggagatgagaagccaacggagaggttctagagtatgtgggaaataaataaagaaggtttgtctttgagagacaagctcaggaaaaaaaattgctagacaaccttctagtaacacaacctcttagtgcaatagaggaattagagacttgttcttcaactaattagcttcagtttctgttttcagcaaatgtctttaagtttatttttctgttttcagtttatgttcgtcttatctctacttgtttaagtaatgtatctacatagttataacttgtgtgtttgcagacttctatcgaattagcttcagtttctgttttcagacttctatcgaattagcttcagtttctgttttcagacttgtgtgtcattgtgtttatgtaatgaaaagctgaatgaatgtttgtgtcaaacacatccttgagctcaagctaattgtgatacatgtctttaactttaaatttttgtgtttttgtttgtgtcaaagcttatgaaacataacttcgaatgttctgtctttgtgtaagtgtgaaagtggacttccacaagtggtgaaagtagacaaaacaaagttgaagctagaagacaagcatatgcatctctttttctaatctttgtcaaccacatatgtaacaattttgtaacccacaagttatgaatgaatttatcctaaacaacaagttacgaatctcttcttctttttgacttgctataatttgtaatatagtacacaaataatatgcattcttctcttgttcttgaaaaccttcttttcttttctggtcaaaacacaatattgaatgcaaaacacattcttttcttgttcttgcaaaacttcttgcttttctaatacttaatcaaaagaaattttatactaaaggcccaaatttctcttctcataactttttttattatactccatcatatcttcgaaactaatatggcgtcttcttctcgtgataacttttatgaagagttgaatgaagaatttgataatctttttgatgaaacatttgaaaatgaattgtattcatatgatgaacgtcaagtagcaaccaaatcaaggaaaaaacgaggtatattgaaagagattgtgaagaaggacacatcaagttatggaaggattattttagtgaaatgcaactttctctactaatcaatttcgatgccgttttcgaatgaacaagcccttgttcatgcttattgttgatcgacactccaatgaaattcaattttttcaacaaagaagatatgcaaccggaaggttaggtttctatacactacagaagtctacaacagcaacttgcatgctggcatatggttgtgcagctgatgtagttgacgaatacctttgtattggtgaaagttacttcactatcatgcatacataattttgttgaagcaatattttttttgttcggagatgagtacctacaaaaatccactgtagaagatattgatcgatgactaatgattggagagattcgaggttttcctaggatgatgggaagcatcgattgtatgcactaggagtggaagaatttcccaaccgcttggaaagggtaatatgcacgtggatctggaaaaccgacgatcgttttagaggctgtagcttctcaatatcattggatatgacacgcattttttggacctccaggttccttaaacgatatcaatattcttgatcgttctccaatttgtgatgatatcttacaaggtcaagctccaacagttaattatttagtcaatgggaacaagtatcatttgggttactatctcacagataaaatttatcttaaatgggctaattttatcaaccctattccgaatcggcaaacatctttatttgcaaccactcaagaagcttgtcgtaaagatgttgagcgtgcttttggagttttgcaagctcgatttgccattatgaaaaatccagctcctatttgggataaggtaaaaataaaaaatattatgtgagtatgtataaatacttcacaatatgatagtaaaagacgaacgagatgtgtacactcactttgatgtctcttcattcgtacaactggaatcaactagaagttcacaagtggatttcacctattctacaaatatgccttcaaatctcgagaatatgttggacactcgaactcaaattcgtgatcgacatgcacatcaacaattgaaatctgatttggttgaacatatatgaaaacaatttagcagaaatcaatagttaaattttatgttttcatgtatgttttaattttttttatgtcatctatgtatcaaatattatgaattcaataatgattaagttgttaaaaattaaaatatttctatattttattttgaaattacatttttttaagaaccctaatttaatatactaccattgaggttgccaaaaattaaaaacttaccaaaactcttaacaacaaaattttaaaaaaattattcattaaatatggttaaaaaccttaacttatatcccaccattaaggatggtctaatgtagtttatttgttattcatatgtgatgaaaattggccattatggtttagaggttgtatacttgtattcatgggtatgacatgttatactgtttgagtttttcctgatgcacatttggttagacaccggttccactcccatgtctctaaaaaacattaaaaaaaagaagggcgaaacagctaaggagaatgaaggaaccgaaaatgactagttgttattattcatatcagtaagcatcaagggtactcatcgttttgattagagcatgtgcaacagtgatatatccctatttttactgtttttagctatgatttagatattagtttcagagtccatttgttatttttagagtctttttttgtttttttacaagtttgggattcatttggagataatgcagcattctcgaggaaaaagagaatttatgcagctgaagaaatcagaagactaaaaaccgcgtaggtgtcaaacgacaccacccctggttttcgagcgacaccacccctggtgtcaagtggcaccactacctgacggtaattcgaagacgcaacttattgaagttttgaagatttctaaattcggctcgtaacttttcctttcggctcgtaacttttccttatttttaaagaaggcccatcacttttttaggtcatatatatagtttttagctcattgtttagacctaagcttggagaggctattctcctttatattttttgttcttgggagcaaaaccatgtggagactccctttagataagatctttcttactctttctcttgatatattgactaatgatttcttgttcatactatgatttgtgtttcttttatcatgtttgagttatccacttgttaggttaagggtttctcattagggattcatatggtttagtaaatcgatccctggtaagttatctatagaattcttgtatttttctcgcttactccagatttgaatgccactggggatagtgacgtttaagtctgggagaggcacgtttttctttttgagtcttattcttactcttatttttcttatttttgagtcgttttattgaatcaaaattttgttaggaattatgatctctattctttagattattgcctggttgattaatgctgcaggtttgaatcaatccgactattggaaaatccagatggcaaaccatgagacttgaggatatcctggtttctaacacaatcctttaaggttggagctaatctcactgcttttccttttacctcatcaaaacagttagtgttcatagaacttgactccttgttcatacctgatattgaaaccaatgtgaaaaagaaaagtattcctctccccttatattaaaaaaaaaaagaagtaagatattgatatgattttcggtagtgtataggggtaggaatttttcccatgacctaataacactgtattttacttattttaggtgtatgtttatcatcatttagctttgcatttgctcattgtatcatttcattttgcaccattttagcttattttgcatacttaggcatctaggatcatcttgcattcgcaatgcatgttttggtgtgtttttaggtgtagaaagagttaaaaaaaggactttactcgatccattcactcgatccagacagctacagaataggcatcaattcactcgacctcttcactcgatccaggatgctacagaggaggctgccgtttactcgaccctcttactcgatcaaggcagcctcagatgaagcagcagattgatctactcgaccctcctactgatcctctactcgacccatttactcaaccaagggtgaccaaactacaagacttgttgagctatcaaagcgtcttcagatcctcctcattctccactcaaccagacatctgagcatacggataggagaggaagaatcatctactcgatcaattgatcactcggagcatagacacaaaagcgcagactctgcagcaccctctttactccatccccaagatcaagtattcgcccaaaccgcctcaagtctcttgtcgtctagtgaatctagggtttcaacattttactataaatagatcactttggggtttgtccaaaggatctagcttttatctttcagtctttctttgtgtttatgaatcttgaaaccttaattactcttaatctatttcgtttttccatttagttgtttaagtaaagttgtttagcttgtttagatctacattatggtatgatttcagtaatttttgggtttgtgttcttgagaatgttgcttgagtagtgattagggttcttgaggatggattagattagggtaatctctaggttagttaggtggtcaagattaggttagaacccttctggattcgcttggcccctatgcggttttcgctggctaatgtggagattcgatcatagacgtccagcgtccaaaagacgttcaaatggatgtctgatcatcgaattccagagatttgtagtctcgaccaagagattggcttgtctgcttattggctttggtagattgtttcttaaaccctgctctgctatgtttcatcaacgacagttgagattaggaatttgtagagttatgggggtctctatcacgagagtggattgacctggtttttgaatctatcgtcaagggtatctacctttcacctattagccatctgatgaaccctagagttgcccttatcaatgaatccatccttagaacttctattagatttatttgtatcccctgttgattgcacttttatttacctgttatttgtatcccctgttgattgcattttagttctgcctattggttctactcgacccaatgatcgagtagggctcttaagttctcatttttacttgttcgaatcccgacctaggattgttactattaacccaccatcattataatctggcttgacttaattgtttctgtacacatcttgattgctagcaataatagtggactggattgacaccccctatagctgcatcgacatgtttgtgttttaggggaattgaactgaaccacacattctgcatataagtaggcatagtaaacctgcttatcaatttattgttgcggttgttacattcaagatatcagaaacttttaagatcaagttcttttacatttatcaagttactaactcatattttcgtctgcttgtttttgtggtataggtactaatctttgtgcatgctagattatttcccttctctttgggagacaaagcacaccactgggagaagactttgtccccagactccatcacctcatgggacgattgtaagaaagcttttcttgccaagttcttctctaacgctcgcaccgctagattgaggaacgagatctcaggattcacatagaaaaacaatgaaactttctgtgaagcttgggagaggtttaaaagctacaccactcagtgcccccatcacggtttcaagaaagcttcattattgagtacactctatagaggagctttaccaaagatcagaatgctactcgacaccgcctccaatggaaacttcctgaacaaggatgtagcagaaggatggaagttggtcgaaaatctagcacaatctgatgggtgctacaatgaatactatgatcgcttagtgagaggaactggaggtagtgaggataaaaagagcaaagatatcaaggctctgaatgaaaagctagacaagttgttgctggctcagcagaagcagatacactacatcactgatgaagagcacttccaaatgcaagaaggggggaatgatcaaactgtagagttgtgctacattcagaacaaaggaggtttcaacaaggggaacaacaactacgatcccaacccaaacctctcataaagaagcactaatgtagctaacccccaagatcaagtgtatccacctcaacagaatcagtccaagccttttgttcagtacaaccaaggttatgtccctaaacaacagtttaatggaggctaccaacagcagaatccaccaccagggttcactcaacaaccagaaccagccccaacagctcaggatcctgaaattaagcaactcattcaatagatcatccaaggacaagctactggagccatggcttttgacatgaagatagctgaattacataacaagatcggttgttcttacaacgatctgaatgtcaagtttgaagctttgaattcaaaaatcaagtatgtggagagtcaatttgcatcaacctctgctctggagcatcctcaacaacttccagggaaagcagtccaaaatcctaaggactatgctactggtaatgctatcaccatccaccaagaagatgagtctccaccaagtcgtcagactccccatactgaggaaaatatgattcaagaaggggggggggattcaactcaaattgctgcacctgccacccagcaattcatctggactataaagcacacacctttgctgaatactcaccatcctggaaaaaagttcaaaattgaaaaactcaagaaggatcagaatcaagagatgatcagcagtgcctctacccaagaaacatacaagaagaaaatcatccaagaaaagcttgatgatcccggttcattcactctgccatgctctctaggaccattgacattcaataggtgcctttgtgatttgggagcatctgttagtcttatgcctctctctacagctaaaaggctagggattatggaatacaagttctgcaacttagctttactcttagctgacggttctgtagcacatcctcatggtttaatagaaaatctgcctgtcaagattgaaaatgttgagatacctacagattttgtggtattggacgtagatgaaaaaggcaaggatcccctgatcctaggcagaccattcttagcttcagctggagcagtcatagatgtcaggaacggaaaaattaatctgaaccttgaaggcatcaagatgaagtttgacatcagagaatcttcatggaaatcaacaacaggagttcagaattttggggttcagaacatggatgttgatgaagaaacagaagctggaaccccaccaagagttaactatacttctcaagttagcaagctgaagagaacttttgaccacatgaagagaacaacagaaaggctagctcagactgaagatcctacagaagatgactggtatgagatgagaaaaataaataaatggcaaagtagagtcatagaaggattgtcttcaagggtgatgaagctgaaagatcaactttggatgtttgaaaaaagagttaaaaatttttcaaatggtattgatctagagaagatggaaactgcactagctatcaaggaggacgaaaatttcacaacagaatggtttgcaccagaagatcagaaagtagttcacttagaggaaagaagcctagagagcaagttgttgagtgaggaggaaactcctattctgatttattctccaggagtgcctaaacagcccaccaacacctctgctgaagaagaatacttgattcatgattctgttgctgaagaacttctgaaactctaagttggatacaaagctcaagaggataccattggggagctaacttacaagatggaaggactgaaccatgcaatcttggaacttcaagaaatggttaaaggctaccccagtttcgaattttaggattggtcaaaacagcctggttcagaagaagaagactactctgctgatcagaaagaagcttattttgaagaaaaatcaaataagtactcatcctaccatatctcaagagacgatgcagagtatgattcaagcactgaaaattcgaccactgaagatgaggacttctctgttcctctcttccatctcttttctgactaagctctgtaagagtcaagcttagtgacttaaaaaagctcacttgggaggaagtcccatgtctatccatgtatataactttctatttttcttgttattttgatgtttttgtttaagtgtttcaggtttatttcattattcattatggagtcaacggtcgagtaaattcaaaccaagtcaagaaaaatatcaaccgttgattgagtagaatgaggaggagtattttgagccattgatttgaatgactaaatgtgggaaatcaccctcaccgtttgatcgagtgaccaagggagaagtattctccaccgtttgatgaagtatttcacacttcaagaagatactcgattctttactcgagctctcatatttcgaagaccaaggcataacttcgtgatccaacttgctccccaaacactcctttactcaacggacaaagagattacccatgcccctcaccatttacaatcaacttttctatcctttcccaaagaaaccaaacaccattctcctccacccattgaattcgacaaacccacttttgaaactctctctttcatcatctcattttcgcaaaatctccatctctcacaaagcttcaaagtttcactccaaactcttcacgaattcgttctcacttcatcataattcaccaaagtcactcgatcacttccaagttcatcctcaagcattcaatcagtttcaagctcaaaatttcatcaccaaagaaagcgattcccttcccctttgatagctcttagagaagtgttcttgtttgtcctgtcaaagctcaccaccaatctccatggattcaagaaggaagagttcaccacgggcaagaagatcctctattgataatgaggaagttgaggcgtttgacatgagtggcatgactgaacgccaaattcgccaagctcgccgtgctcaaagatcaagcttgattcaaggtggaagctcaagccgctcaaccatgcaaagagaagaagtagctcgaggaaagagggtcgttgaagctgaagaagaacaccatgaagaagcaccttttgaagaagcggtttctgaggaagaggttgagatcatcggggatgatacaccaacccctgttgggagaagaaaccggcctaggaggaagagagagccaaccgagcgagtactatcaatatttgaaggagttgaagtttgagggaactagataccctcataaggaaacgatgcaagagcttggtatttgtggtgatgtggaatacttgatggaattggccaatcttgcaacattcatgagctgccaatgtgggggatacaaagaggagagctgccaactctttgcaaccctcaaggttcatttttgtttgggggaggattcaagacatgtttaacattgtgttctcttttcttatttcaaattttgcatcatctaaggcatagaaaaacaaaaaaaaattgaaaaaatttcataaaatgaattcatcaaaaacagagtgtcatgtagattgcatatcattttaggattgtatatagagtacttgcatttaggatttgctcatttgcataggggataatgattatttcaaagcgataagcatgttttgattcaatgaagtaagttcaatgcccaggttgttagttctcggttgcataaccgactgtatctatgaagtaagactacaccctgctttgaatttgtaacttgactatactgctttgattcgaaactcgcttatctgatgccattccatatctattagaacctgaactgaatttgcaattatcatgtctatgcattgtttgtgaactcatggctaccatatacatacttggattatcttattcacttcaccaccctctgttaatccaagtagctgtctctcatttttagagcagcttctcatacctttagcctagctttatttcaagccaaagatcatttgtgtgtgattgtgaggtctttttcgattgagcttggtataacgtgttacgtatgagccgacaagagcagtctttcatgtagacctagcccacgcttattgggttagctaggactaggtggacacttgtatttgggaatgagattgtgtatggaatgaatgggaatgataatgagaatgaaaaaaaaaaaaaaaaagagagtaagagtttagagttctaaaggggatacaaaagtgttaagtttagtaaagggtttggaattcaaagaagttagggattgtgattcaaagaaaagggtaaaacgccctatgtgctaagattagaagaacagccttaagtttgtcaaaatataaaaccaaacccgctagactcttaaatcgtttcaaagaaaaccccttagaacttgaaccaaaaagagagaaagaatgagaaaaagggtagagtaaggaaatctatgggactgggatcatcttctgagctatcatactatatcattgggtagatgggagtctgttcttgtattggtccattggcttttacctttagcattctgctgaagctcaatcttttctctgagagtcccctgttactcgaccaaacctctagagggaccatttttgtctcttagcctaagcccgaaacaaagtgagttcataaccattgcattgcttgatccactattcgtgcttaatgaatgttaaagggaactggttgatgtgaatgtttgaatagattaaggcaagttgttaggttgcattgtgacgagtatggctaaagtttttaagtaagagtctatcaccttgcaacctagaattagctacctggacatagagcttacccgttttatatgcatgctttggtttttgaatccccaccttcaaacctctccttcaacttaagattttttgtttgcttgagggcaagcaagatataagtttgggagagttgttaacactgtattttactcattttaggtgtatgtttatcatcatttaactgtgcatttgctcattgtatcatatcattttgcatcattttagcttattatgcatacttaggcatctaggatcatctcgcatacgcattgcatgttttggtgtgttttcaggtgcagaaggggctaaaaaggactctactcgatccattcactcgatccaggcagctagagaagaggcatcagtttactcgacctctctactcgatcgaggcagctaaagaggaggatgcagtttacttgaccctcttactcgatcaaggcagccttagatgaagcagcagattgatatactcgcccctcctactcgatcctctactcgacccgtttactcgaccaagggtgaccaaactacaagacttgttgagctatcaaagcgtcttcggatcctcctcattccccactaaactagacatttgagcatacaaataggagaggaagaagcatctactcgaccaattgatcactcggagcatagacacaaaggcgcagactttgcagcaccctctttactcgatccccaagatcgagtattcgcccaaaccgcctcaagtctcttgcctactagtgaatctagggtttcaacattttactataaatagatcactttggggtttgtccaaaggatctagcttttatctttaggttttctttgtgttcttgaatcttcaaaacttaattactcttaatctatttcgtttttgcatttagttgtttaagtaaagttgtttagcttgtttagatctacattttggtatgatttcagtaatttctgggtttgtgttcttgagaatgttgcttgagtagtgattaggattcttgaggatggattagattagggtaatctctaggttagttaggtggttaagattagtttagaacccttgtggatttgcttcgcccctatgcagttttcgctggctgatgtggagattcgatcatagacgtccagcgtccaaaagacgttcaaatggatgtctgatcatcaaattccagagatttgtagactcgaccaagagattggcttgtctgcttattggctttggtagattgtttcttaaacccttctctactatgtttcatcaacgacagttaagattaggaagtggtagagttatggggatctctgtcccaagtgtggattgacccggtttttgaatctatcgtcaagggtatctacctttcacctattagccatctgatgaaccctagagttgcccttatcaatgaacccatccttagaacttttattagatttatttgtatcccctgttgattgcacttttatttacctgttatttgtatcccctgttgattgcattttagttctgcctattggttatactcgacccaatgatcgagtagggctcttaagttctcatttttacttgttcgaatcctaacctaagattgttactagaaatccaccatcattataatctggcttgacttagttgtttctgtacacatcttgattgctagcaataacagtggactggattgacaccccctatagctgcatcgacatgtttgtgttttaggggaattgaactgaaccacgcattcagcatataagtaggcataaaaaacctgcttatcacttttctagtattttcaggtctttacaagtttgagattcatttggagataatagagcattctggaggaaaacaaagggtttatgctgctgaatcgcgtaggtgtctagcgacaccattacctgacgacaactcgaagacgcaacttattgaagttttgaaaatttctaaattcggctcataactttcccttatttctaaagaaggcctatcacgtttttaagtcatatgtaaagtttttaggtcattgtttagatctaagttggagaggctattctccttatctctttggtcttgggagcaaaaccctgtggagacttcctttagataagatctttcttactctttctcttgatatattgactatttatttccaattcagactatgatttgtgtttctttgatcatgtatgagcaatccacttgttaggtttagggtttctcattagggattcatatggtttagtagatcgcccccctgctaggttatctgtagaattcttcatatttaattgttcttaatgctagttctagagtaataaactagaacttgaatccaaacaatagatataaccgccataggtatttatagttggatctattatttgatgagcctggtttatagctgtgtaataagaatcagcctatctactaaggtgaacaattaaactcgtttagaatgcatgtctaggtataagatctctcggcttctcgagttactctttttgttttttgaaataaagttaaattagtttcaaaaaagaaaagtatatgtgtttacaacttgtgcaacgtttttgaagaacataaaaaccaagaagaagcaactttttaccccaactctcttgtttgaaaccaaaaatggagagctcgatcatatcttttgtctccactaatattaatagctgatatatgattccgaatgtgcttatcaatccacttaactagtcgggctacaggatttgggagactgccgtgtttacgctcatttcgttcccgccatatggtgtgtaccgttgcctgcaaaacacaacgagctaagaatccttcgacacgattctcgaccaatagttagcgatgttgtgtataatctcctgccaatccgtggaatttctctatacttgagaattgttttccacatccatgaaccaaggcaagtgatatctattactgcccaaagagacccttgtttgaggagggaagttctgacccatttcacccacagcgaatccttgtgggataagataagccaaatcaatttcaagaaatagacatcattcgcttctttaagagaccgaaacccaagtcccccctcttgtttcggtttacacacagcttcccatgcgatctttgcttttgttgtttgtaaatcaccaccggaccacaagtacgcttaacacaactgatctatttctcttatgcatgctcgaggaagacgaaatgctcccaaccagaagttacatatgctccaaagacaaatatcgtgccgaccaagaacgaatcttcttctttatttgttccatgagagggcgataatctgtagaagagagaccttttatgaccaaaggaagtcccaaatatctcaccgggagtgtaccaactgcaaaaggaaatcgatctgctatatcttgttgagaaatgtctgtcactcctacaagataaactgttgatttttccatacttatttcttagtcccaaacttttagcaaaagcatcaaacacttccacaatgccttctatagatcgcattttaatatgggcttatatcgagtccgttaaaaaaaatataagccctaaccctgataaaattaaataaaagattttgggctaagatagggctatactcaaattgttatgggctaaaatagggttggccctattacactcttttattattccctgtcctttttttcttcttctctttctcccaattcccaaacgcgtcttcttcgactcttcttcttcaatctcttcttctttgatttcttcttctttgatttcttctctgaaaccataagagtgaaagatttcatctgaatatatagagaaacagaagcttggtgaagtagcaacaaccctaattgcagatacttaggtttataacaaagtggatcccgtcacggccgacggaaaggttgatattgtgaggaataatttgatctcgctttatgaagaataccagactaaatctgcaagttcttcgaactcttcaaccacacttactccacacgagcttctcaatgaattgccacttgaagcagatgtgaatgatgtaagtataataatatatttgaatatctttcactagttctggtttttgtttaactaattgtgtgtctatttgtgtatttacaatatctttttgagcttgaaagtagtctcatatctgcttcaaaaagtaccaagtcaactttggaaatctatttggatgatgaaccaagattagagatgaagactttctctgacatggaaattttaagcttttggaaagagaatcaacatagatatactgatttagcttcaatggcatctgatttgtttagtatcccaatcacaacagtagcatcagagtctgctttcagcgttggaggacgggtgttaaatccttttaggaatcgtcttcttccccaaaatgtgcaagcattaatttgcacccgcaattggcttcgtggatatgcagatcttgaaggtaaaattgtaatttgaagttataaaacttacataaatcattgtcttattttaacttgtatcattaaaatgcaggagaaatcgaagaactttttgctgaagaagataatgatgctacaaagatgacaagtagttcaggagttggagattctaacatatgatgagaagttttttttgctcagtttttttttggacaaatatcggtaacaatgttttacatttcagcaaaatgacaagaaacaatgttttatatgttgtggtgttatagtgtttccatttgataataaacaatagtattattatcttataattgtttttgtttgaaaaacccttctctttaaataaaaaaaaaaaacttaagggctacaaaaggccaaaaaggtgctcaaccctgttttaaatttttttagggattaaaaagggttagggctcacttagggctgggcttaaaataaatagggctgggttgggctggaaaaccctttttaacatccctacattttaccatccgaaagaaccttaagattatctgcaaaactaaggtgagttaaaccaatgttcttacatcttggatggtaaccaaacttcctcaaacctactgccttatccaatagtttggagagaacatccatactaacgacaaacagatacagagatagagatagagaacatctctgtctcaaaccccgcacactgttgaaatatcccaccagttccccattgacttgaaccgaaaaagaggttgtggtgacacaaagcataatccaatgaataaaaaacaatggaaatttcatggcttcgagtaccttacggagaacagaccattgaaccgagtcgaaagctttagagatatctattttaattgcgcagccagtcgataccgattctttgtgataatcttttactaactccgtcgcgagcagcacattctctatgagcagcctatcttgaacaaaagccgattggtttcctacaacaaaatttggtagcactcgcttcaggggattagctattatttttaatatgactttaaatatgacattgcaacacgatattggcctataatctttcatctcattagtcgttgccttctttggtatgagagcaagaatggtggaattaattgcctttggtaagaatcctttcacaaagaaggatttaatcgcaagaataaactccttcccaatgatatcccaagtcgatttataaaactccattgtataactatctggtcctagcgacttatcttttggcattgcaaagagtactcgtttaatctcctcctctgttactgacctagtcatctctgttttctcctcctctgagcatcgataaggcagcaagtcttgaagttcactaatggatatttcctcatagtcatgtgaaatcagctgaagaaattctctaaaaaagtgttctgcttcctcttttatttctactactttttttgtaactgagccatctggtctttgtatttccctaatcgagttgtgcgctttccttaaagtgaccgctctatgaaatgtcttgtttttttgtcacccacatcaagtcaatgcaacttagatttctgttttagaaacttctgttcaagacaagtcaccctttcccacctatcataagcctttgtttcctcctccattgccctaactgaaggattttgtagattcagttgctgctttatgcaaagatcctcatgtgcttcctttgccttcttgaccaaattttccaaactatctttggtcaagtttctaatcaccggttttagtgcctttagttttctaataaacgtcgatgtggacatatgaattggttccgcgtccccccccccccagtaattcgccactaaaggtctaaattcctccatcattgtaatagctgataataggtttttatggtcaattaatcctaaaataccaatcatgtcgttgtagtattttaggtgtcaatccaaatgagtgtgatgcaaacagatgaaatgtgatcagaagtcactaagtcaagccaagcaataacagttttggggtttctaacagtcctaagcgaacatgcagaaaacagaagtaataacagaattactaaaatcactcgaccacaacaggctgatgccagaagtaggatgtggtcgagtaacaggtcgagtaacagacaggaaacaagacaatcttactcgactgcacagtctgttgccagacactgggtgtggtcgagtaagttggtcgagtcattgtaaaaactaagaaacaggcaatgagaacgatcaagcgataacgataaaacagagaaataagatagacgagaaattcctaaggatggggtaatcgagtagagtggtatcctagcctattcgaatggttaacaagcgcaatcaagttatccctagacaacaggttcaacaacagatcaattcactcccgtgacagaaatcctcaagcaaagctagcccagacaaattcgcattaacggaatctaactatgcaagcaataaaaacagactgataaagtcaataaatgctctaaacggccaatcccttgggatagagacgcatatctcaggaactagtggatcaagcattccatcgaacaccttctgggtgcgcgaatgcttgagatcgaattccagttgatcagaaagaaacaagcagtaaacgcaactagtcctaaagggatttaatcaattctaaaacttaaccattctacagactacggattccacaactactctatcccatccctaagaattcaaagtcactactcagacaacatgctcaaagacataaacgcagataaacgataatattgcataagtaaagagataaagagtagagaaacaagatgacagatgaaatcaaatgcggaatctgaataacttggaaaaatctcgaattacaggttgcagaagcaaaaccggcgcagtagagtaaaacagaaaataaaactgaagcaaaaaaactcaatgtcgaccggatatctgaggacagaaccctaagacatctatttatacaaaacgaaataaaatgatagtagacgggccaataacctaatcgctcggcccatagagagataatgggccgagatgggcttcgtgatccgatggaggtccaggccgcttccaaacactttgtcttctcctcttctcttccttgtgctcagcttgtctggttgagtgcgaatttgagtagactgtgaagacgtgatcgagtgtccggtcgagtgatgcttatggtggtgagtgttgatactcgaccagggggtcgagtaacttggtagagcgaatggtcgagtgatggtgatggtgtggcgaagtgatactcgaccagggggtcgagtattgtcatcgagtggcctgagctgaggttactcgacctggtggtcgagtggatgggaagaatggctccaaagtcactcgacctgggggtcgagtatgtgggaagaatggctccaaagtcactcgacctgggggtcgagtatgtcttctggttctggctcgtttcttccaatttgcttgcaaacagctccaaatcacctgaaaacaactcagaaatgtaatatgtatgcaaaactatcctaatcatgcaaagtatgcaagaatgatgagaaatgatataaaacagtgatgaatgatacgaaactggactcaaaaccatgatgaatggacactgaaaacatgcaaattatagacatatcaactcccccaaacttagtctttgcttggcctcaagcaaataagaagacatagttgaaggagaggagtgaaggcggggactcagaaccaaagcatatgatagagcaaataaaatcattgtccaagttggtagttctaagatgcgatatgattgaattctactcaaaaacgttaaccatgccttgttatcaatcaatccgtctcttatactcgacctacacatgctttcaaatctaccaatccctttaacattcattagttctggaacgtgaatcaagcagtgcatcatcaatgaactcatttggctaaggtgaaggtcaagagacaaagatggtcccttacagaataggcttaagtaacaggggatccctcaagaatgattgagctttagtagaatactaaaggtaagtcccaagttatgcatacagagataagatcccatctacccagagtataacaatgaagttctaatggtgatcccaactcctgtcccaacttaactctgccctttgcactcatgaatctttcaaactctttttcatatcattcttttcttttctcttaactctaggagaagctttctcaacgctctgatacatctagcgggtttggatttctttaacaactaaggttcctgtttttttttttttttcctttaaaaccaaaggcttttaacccttcttctttagctaacaagaacctcattcttttctttaacattctcaaaacctttactagattttttttctaacttctttagcttacttcccctagaattctttccctttcctcatcaacaatgaattccctcttttcttttaaacacatcccaacccatgatataagcgcccacctagtcctatccagtccgaagaacgcgaactagaactacatgagacactatctctgtcgttacgtattaacactttctaccaagctcaatcgaaataagacctcacaaacactcacaagtgatatagggcttgaaagaaagttcaggtttgggtatgggttaactgctctaataaagagtggttaaaatgagtaagaaaatccaagtattttagggtatccatgagttcaaattcgatgccaagacatgataattctaaatcagattcaagttcaaattgatagggaatgatatcagtttgaacttgaatctaggcatggtgcagtttttacttcaatttcaatgacaacgcatcaaacaactaacaacgagggcactgagctttatctggtgaaccaaaatgcttacaaggctatctcatcattatcccctatgcatatgcaacaatcctaaacgaaacactctagactcgatcctaaatgaaatgcaactacatgaacactctatttttgtgaaatcattttctgaaatttttcaattttttttttttttggtttttctatgccttagatgaatgcacactcaagattatatacaatgcaacacacacttcctgagccctcccccaaacttaaatcacacagtccactgtgtgaccaaatttggaagagagtactcaggacaaaacacatctcaaagacaaaataaaaacaagagatggtatattacaatggtggagtgaggtgcatacctcagtggaagaaggagcggagttggtcgtcaatagctgcctgtgattgctctcaggccatcgaagaatctccctgttgtgtctcagcttccccctgggggtactcgacctctgctccttcgtcgcagccagcaccgctctgatgatactcgacctctcttcttctgctgcggccagcaccgcggtcgcgtaagctacgggactggagaagtcgtgactgcatcattcgctatactcgaccacatcgtcattcgatctctatagggtgtggtcgagtgatttcctggtgtgaagaagccagaacaatgtcgagtttgattgctctgtggtcgagtgtattgctgttccttcaaagccagaatctatttccatcaactcttcatacttatctcctgaaaacactaacaagatgcatcaaaaacaaccaggaaaatgaaagatatgtacaaaggaaggcttgggacttcctcccaagtgagcttgttttaggtctctagcttgactcctcatactcattaggcgtttaaaggctcctccaaaggaacagaggttccttctggaataaactgatctatcatgtatttcttgagccgctggccattgactgtgaagtctccattctttccagctagcgtgatagcaccataaggtcggactgcagtaacagagaaaggaccagaccatctagacttgagcttgcctggaaaaagcctcaggcgagagttgaacagcaacacttgatcaccaaccttaaaatctcttgagactatcttcttatcatggaaagacttggttcgctccttgtagattttggaactctcataggcttctaagcgaatcttgttgagatcgttcagttggattaaccgcttctcctcggcggttttaatgtcgaagttcaggagcttaactgcccacatggctttatactcgagttcaacaggcaaatgacaggattttccatagaggaggttgaaaggagtcgtgccaataggggtcttgaaggctgttctgtaagcccatagtgtgtcattgagcttagcagaccaatctttccttgtacttcccacagttttctctaaaattgcttttatctccctattggagatttccacctgcccgctcgtctattgatgataaggagtggctaccttgtgctttactccatgcttcttcaaaaggttctcaaaacccttgttgataaaatgtttccctccgtcactaatcacaattctcgggactccaaatctagggaagataattgtcttgaacagctttagcacaactctagcatcattggtgtggctggctatggcttccacccattttgatacatagtctattgcgaccagtatgtacttgtttccgtaagaggaaggaaacggacccataaaatcaattccccaaacgtcaaagttttcaacttctaagatcggattctaaggcatctcattccttctgctgatgttccctcttctctgacatgaatcacatttcgagataaattcctgagcatccttaaacattgatggccaccaaaaaccagcttgcaggattttcgacattgtcttgaacgttgcgaagtggccaccataggcaaacccatggcaatgcaataggatgccttcaatttcgtcttctgagacgcatgtcctgtagatcttatctttgcagagtgtgtagagataaggttcgtcccagtagaaatggttaatgtccttgaagaacttcttcttctcatagctcgacagattcggaggctcttcaccactaaccaagtagttgacgtgatcagcataccacggaagcttttcttcaattgcacatacttgatcgagtgatttctaaatttgagcactctcgttaagttgctgaattgccattagctgttcttctggcatggagtcgtcaataaggacctcgtcttcaatcctcatcctagacagatgatcagctacaccgttttcgattcccttcttatcaactatctccatatcaaactcttggagcaataagatccatctcaacagcctaggtttggtatccttcttcgcgtatatatgcctcagagcagcatgatcagtgtagattgtcactttagaacccactaggtagcttctaaatttttcaaatgcaaataccacagctagcaattccttctctgtagtggcataccttacttgtgcatcatccatcgttctgctcgcgtagtagatcacatgcagctttttatcaatccgctggcccaagactgctcctactgcgtactgaagcatcgcacatgatctcgaatgggaagtcccagtttggagcttggactattggtgcagtgatcaaagcttccttgattaacttaaaggctgtcaaacattcgtcatcaaatgcaaactcggtttccttgcacagcagtctggtgagcggtcttgccaacttggagaaatccttgatgaatattctgtaaaatcctgcatgtccaagaaaactcctgatgtctttgacagtttttggtggctgtaactgcatcatcacgtcaatcttagccttatcaacctctattccctcctcagaaattttgcggcccaaaacgatgccttctctaaccatgaaatggcatttctcccagttcagcaccaggtttgtctcttcacatcttttaagtaccctgcacaggttcaacaaacacgaggagaaggaagagccatacacagaaaaatcatccatgaatacctctaccatctcctctatcaaatccgagaaaatagaagtcatacaccgctgaaaagtagctggtgcattacagagaccgaaaggcatacgcttgtaagcaaaggtcccataaggacaagtgaaagtggtttttccttggtcatttgggtgaatagggatttgaaaaaatccgctataactatccaaaaagcaatagtaaggatggtttgctaatctttctagcatatgatcaatgaagggcaatgggaaatgttcttttctagaggcaacatttaacttcctatactcaatacacatcctatgtccagttatagtcctagtgggtatcagttcatctttagaatttttaacaactgtcatacctccttttttaggaacgcagtgaactggagatacccaagtgctatcagagatagggtagataaccccagcatctaatagtttaagtatctcctttttcacaacctctttcaagttagggtttaatctcctttgaggttcaatgctagagtaggattcattttcaagatggattctatgggtgcataaggtgggtgaaatccccttaatatcatctaacgaatatcctatagctttcctatacttcatgagctcagttatcagcaggtttacttgatcagcagttagctcatcattcactatgacaggataagtagagtttagtccaagaaaaacgtaccttagcccttttggtagcggtttcaaatctaccttgggtgccttgatttcagaccagtcatcggatactaagttggcttcagatgaggagttgtgatcgagtgacgtggtcgagtagactgaatgggctgttggtcgagtgatgtggtcgagtatatattccccccttgctctttcacccaaatcttcatattctcctggattctcaactgctttgttcatctaacagcttctggtaccccaaagtctccaaatgtaaatctccttctttgctatcctttgttagagcactctgtagatgatctgtttctcccagctcttctagcattttgtcagctaacatatccatctcttcaatccagaaaatatttccttctatcgtaggcttcttcatggtgttggtgatatcgaaggtcatcttgagatctcttccgaggttaagatcaatttttcccttcttaacatcaatgatagctctagctctagctaaaaatggtcttcccagtatcaaagggtctttgggttcttcatccatttctaaaaccacaaagtctgtaggtacctcgaccacgcctatcatgactggtaagtcttccagcagaccatgggagattctaacagatctgtcagctaggatcaaggatatattgcagggcttgtacttgttgaagcccagtttcttagccacagggagaggcatgagactcacagatgcacctagatcacagaggcacttgctgaaggctaaagggccaagagcgcaaggtaaggtgaaggaaccaggatctcctagcttttttggaatgatcttctgctgaatgatcgcactgcattcgtgacttagcaccaccattccttggacttctttgatcctctctgtaatcatgtctttcacatatttgttagagtctggtataagtgcaagacagtcgacaagaggcatcgtgacttcaagatttttcaattgtttctccaggagagctttgtacttctgtatcatgaccttcttgaatcgaccaggaaatgggagtgggggcttgtaaggtgggggaatgaagacgttttctttggttttggcggcagctggtttttcaacaagaggagatgctgcaggagctagtggtcgagtaggttggtggagtataggctcttctattgctttttcagcggaatttccattttgacagaaatcctccccatcttgatccagactgtcctcagtgttctggttcggactctcttttgtgggtaattctttaccgcttctaagtgtgatagcatgagcgtactcctttgaatttgacattgattttccggaaggtcctgtaaatttgggtgctgcggtcgacccagtttggccttctatgtatctgatcttagatgttagtgcttcaaccttgatattgatatcattgtaactgcagtcaaccttgttgtgaatttctgccatccttttggacaaatccattgctcctgttgcttgcccttggagaatctgttgtaacatgttcttcaagtccgaatctggagttgttaaagctggttgttgttgctgctgtgtgaacccaggtggtggaagttgctgctgatagttgccctgatactgctgcttaggaacatacccttgaccttggttgtatggaacaaagggcttgggttgattctgctgctgtgaagggtaaacttggtcctgccggtttgcaacgtttgtacttctgtaagacagattgggatggttctgcttgaagttgttgaaacctttgttgtaacctccttggttctgcacatagctgacctcttctaactgcagagtctccccatcctgaacttgtaacgtctcatcatcacccagaaaatgaatgtgcttctgttgcataaggagtagcttgtccagtttgtcattcatggctttcatttccctacggtgcttctcatcagaatcagagcttgtgcggatgcttctgtcataatcttcattatagttgccatccgactgagccaagttctctaccacctcccatccgtcttcaacatctttgttgaggaagttcccgttagaagcggtatctagaagcatctctgtagagagtgctaagaagcgaagctttggagaaaccatgatgaggacattgcgtctgataacccttgaagcgctcccatgcttcatagaaagtctcattattcgtctgagtgaaaccagatatgtcattccgtagtctcgcagtcctggagtttgagaaaaacttagccaagaaggctttcttgcagtcattccaggaggtgatagagccttgaggaagtgacttttcccactgatgtgctttgtctccaagagagaatggaaacaatctgagcttgaagccatcctcactgactctattgatctttgttaggctgcagagcctatcaaactcgtctaggtgatcgagtggatcctccatagggaggccgtggaacttgttgctctgaaccatggcaatgagaccgctcttgatctcaaagttgttgttctgcacaggtggaggcacgatgccattacgctgattgtggttgcgtggtgcatcgcctgcacctatgttgtttggttgcacctgctcatcaacaactgcagccattgtgtctgtttctgtctgtgttctgagttggcgtgcaatacggtcgatgttatcgttgaacaggagattctgatttcctcgtgatcgtgtttgcatacaacgagtaccaactggtgaagctggtgattcgtagtacctgaatcaaaacagacaaacaaaaaaaacacaaagtgagtaactttcagaaaaaatgaaaaagaacttgatcttaaatattctgaaatctcaaatatagcaaacaaacacccaattggcaacggcgctaaattgataataggtttttatggtcaattaatcctaaaacactaatcatgtcgttgtagtattttaggtgtcaatccaaatgagtgtgatgcaaacaaatgaaatgtgatcagaagtcactaagtcaagccaaacaataacagttttggggtttctaacagtcctaagcgaacatgcagaaaacagaagtaataacagaattactaaaatcactcgaccacaacaggctgatgccagaagtaggatgtggtcgagtaacaggtcgagtaacagacaggaaacaagacaatcttactcgactgcacagtctgttgccagacactgggtgtggtcgagtaagttggtcgagtgattgtaaaaactaagaaacaggcaatgagaacgatcaagcgataacgataaaacagagaaataagatagacgagaaatttctaaggatggggtaatcgagtagagtggtatcctagcctattcgaatggttaacaagcgcaatcaagctatccctagacaacaggttcaacaacagatcaattcactcctgacagaaatcctcaagcaaagctagcccagacaaattcgcattaacggaatctaactatgcaggcaataagaacagactgataaagtcaataaacgctctaaacggccaatcccttgggatagagacgcatatctcaggaactagtggatcaagcattccatcgaacaccttctgggtgcgggaatgcttgagatcgaattccagttgatcagaaagaaataagcagtaaacgcaactagtcctaaagggatttaatcaattctaaaacttaaccattctacagactacggattccacaactactctatcccatccctaagaattc

SEQ ID NO: 193 - DNA, 103931 bp, Arabidopsis thaliana
aagcttgggagaggtttaaaagctacaccactcagtgcccccatcacggtttcaagaaagcttcattattgagtacactctatagaggagctttaccaaagatcagaatgctactcgacaccgcctccaatggaaacttcctgaacaaggatgtagcagaaggatggaagttggtcgaaaatctagcacaatctgatgggtgctacaatgaatactatgatcgcttagtgagaggaactggaggtagtgaggataaaaagagcaaagatatcaaggctctgaatgaaaagctagacaagttgttgctggctcagcagaagcagatacactacatcactgatgaagagcacttccaaatgcaagaaggggggaatgatcaaactgtagagttgtgctacattcagaacaaaggaggtttcaacaaggggaacaacaactacgatcccaacccaaacctctcataaagaagcactaatgtagctaacccccaagatcaagtgtatccacctcaacagaatcagtccaagccttttgttcagtacaaccaaggttatgtccctaaacaacagtttaatggaggctaccaacagcagaatccaccaccagggttcactcaacaaccagaaccagccccaacagctcaggatcctgaaattaagcaactcattcaatagatcatccaaggacaagctactggagccatggcttttgacatgaagatagctgaattacataacaagatcggttgttcttacaacgatctgaatgtcaagtttgaagctttgaattcaaaaatcaagtatgtggagagtcaatttgcatcaacctctgctctggagcatcctcaacaacttccagggaaagcagtccaaaatcctaaggactatgctactggtaatgctatcaccatccaccaagaagatgagtctccaccaagtcgtcagactccccatactgaggaaaatatgattcaagaaggggggggggattcaactcaaattgctgcacctgccacccagcaattcatctggactataaagcacacacctttgctgaatactcaccatcctggaaaaaagttcaaaattgaaaaactcaagaaggatcagaatcaagagatgatcagcagtgcctctacccaagaaacatacaagaagaaaatcatccaagaaaagcttgatgatcccggttcattcactctgccatgctctctaggaccattgacattcaataggtgcctttgtgatttgggagcatctgttagtcttatgcctctctctacagctaaaaggctagggattatggaatacaagttctgcaacttagctttactcttagctgacggttctgtagcacatcctcatggtttaatagaaaatctgcctgtcaagattgaaaatgttgagatacctacagattttgtggtattggacgtagatgaaaaaggcaaggatcccctgatcctaggcagaccattcttagcttcagctggagcagtcatagatgtcaggaacggaaaaattaatctgaaccttgaaggcatcaagatgaagtttgacatcagagaatcttcatggaaatcaacaacaggagttcagaattttggggttcagaacatggatgttgatgaagaaacagaagctggaaccccaccaagagttaactatacttctcaagttagcaagctgaagagaacttttgaccacatgaagagaacaacagaaaggctagctcagactgaagatcctacagaagatgactggtatgagatgagaaaaataaataaatggcaaagtagagtcatagaaggattgtcttcaagggtgatgaagctgaaagatcaactttggatgtttgaaaaaagagttaaaaatttttcaaatggtattgatctagagaagatggaaactgcactagctatcaaggaggacgaaaatttcacaacagaatggtttgcaccagaagatcagaaagtagttcacttagaggaaagaagcctagagagcaagttgttgagtgaggaggaaactcctattctgatttattctccaggagtgcctaaacagcccaccaacacctctgctgaagaagaatacttgattcatgattctgttgctgaagaacttctgaaactctaagttggatacaaagctcaagaggataccattggggagctaacttacaagatggaaggactgaaccatgcaatcttggaacttcaagaaatggttaaaggctaccccagtttcgaattttaggattggtcaaaacagcctggttcagaagaagaagactactctgctgatcagaaagaagcttattttgaagaaaaatcaaataagtactcatcctaccatatctcaagagacgatgcagagtatgattcaagcactgaaaattcgaccactgaagatgaggacttctctgttcctctcttccatctcttttctgactaagctctgtaagagtcaagcttagtgacttaaaaaagctcacttgggaggaagtcccatgtctatccatgtatataactttctatttttcttgttattttgatgtttttgtttaagtgtttcaggtttatttcattattcattatggagtcaacggtcgagtaaattcaaaccaagtcaagaaaaatatcaaccgttgattgagtagaatgaggaggagtattttgagccattgatttgaatgactaaatgtgggaaatcaccctcaccgtttgatcgagtgaccaagggagaagtattctccaccgtttgatgaagtatttcacacttcaagaagatactcgattctttactcgagctctcatatttcgaagaccaaggcataacttcgtgatccaacttgctccccaaacactcctttactcaacggacaaagagattacccatgcccctcaccatttacaatcaacttttctatcctttcccaaagaaaccaaacaccattctcctccacccattgaattcgacaaacccacttttgaaactctctctttcatcatctcattttcgcaaaatctccatctctcacaaagcttcaaagtttcactccaaactcttcacgaattcgttctcacttcatcataattcaccaaagtcactcgatcacttccaagttcatcctcaagcattcaatcagtttcaagctcaaaatttcatcaccaaagaaagcgattcccttcccctttgatagctcttagagaagtgttcttgtttgtcctgtcaaagctcaccaccaatctccatggattcaagaaggaggagttcaccacgggcaagaagatcctctattgataatgaggaagttgaggcgtttgacatgagtggcatgactgaacgccaaattcgccaagctcgccgtgctcaaagatcaagcttgattcaaggtggaagctcaagccgctcaaccatgcaaagagaagaagtagctcgaggaaagagggtcgttgaagctgaagaagaacaccatgaagaagcaccttttgaagaagcggtttctgaggaagaggttgagatcatcggggatgatacaccaacccctgttgggagaagaaaccggcctaggaggaagagagagccaaccgagcgagtactatcaatatttgaaggagttgaagtttgagggaactagataccctcataaggaaacgatgcaagagcttggtatttgtggtgatgtggaatacttgatggaattggccaatcttgcaacattcatgagctgccaatgtgggggatacaaagaggagagctgccaactctttgcaaccctcaaggttcatttttgtttgggggaggattcaagacatgtttaacattgtgttctcttttcttatttcaaattttgcatcatctaaggcatagaaaaacaaaaaaaaattgaaaaaatttcataaaatgaattcatcaaaaacagagtgtcatgtagattgcatatcattttaggattgtatatagagtacttgcatttaggatttgctcatttgcataggggataatgattatttcaaagcgataagcatgttttgattcaatgaagtaagttcaatgcccaggttgttagttctcggttgcataaccgactgtatctatgaagtaagactacaccctgctttgaatttgtaacttgactatactgctttgattcgaaactcgcttatctgatgccattccatatctattagaacctgaactgaatttgcaattatcatgtctatgcattgtttgtgaactcatggctaccatatacatacttggattatcttattcacttcaccaccctctgttaatccaagtagctgtctctcatttttagagcagcttctcatacctttagcctagctttatttcaagccaaagatcatttgtgtgtgattgtgaggtctttttcgattgagcttggtataacgtgttacgtatgagccgacaagagcagtctttcatgtagacctagcccacgcttattgggttagctaggactaggtggacacttgtatttgggaatgagattgtgtatggaatgaatgggaatgataatgagaatgaaaaaaaaaaaaaaaaagagagtaagagtttagagttctaaaggggatacaaaagtgttaagtttagtaaagggtttggaattcaaagaagttagggattgtgattcaaagaaaagggtaaaacgccctatgtgctaagattagaagaacagccttaagtttgtcaaaatataaaaccaaacccgctagactcttaaatcgtttcaaagaaaaccccttagaacttgaaccaaaaagagagaaagaatgagaaaaagggtagagtaaggaaatctatgggactgggatcatcttctgagctatcatactatatcattgggtagatgggagtctgttcttgtattggtccattggcttttacctttagcattctgctgaagctcaatcttttctctgagagtcccctgttactcgaccaaacctctagagggaccatttttgtctcttagcctaagcccgaaacaaagtgagttcataaccattgcattgcttgatccactattcgtgcttaatgaatgttaaagggaactggttgatgtgaatgtttgaatagattaaggcaagttgttaggttgcattgtgacgagtatggctaaagtttttaagtaagagtctatcaccttgcaacctagaattagctacctggacatagagcttacccgttttatatgcatgctttggtttttgaatccccaccttcaaacctctccttcaacttaagattttttgtttgcttgagggcaagcaagatataagtttgggagagttgttaacactgtattttactcattttaggtgtatgtttatcatcatttaactgtgcatttgctcattgtatcatatcattttgcatcattttagcttattatgcatacttaggcatctaggatcatctcgcatacgcattgcatgttttggtgtgttttcaggtgcagaaggggctaaaaaggactctactcgatccattcactcgatccaggcagctagagaagaggcatcagtttactcgacctctctactcgatcgaggcagctaaagaggaggatgcagtttacttgaccctcttactcgatcaaggcagccttagatgaagcagcagattgatatactcgcccctcctactcgatcctctactcgacccgtttactcgaccaagggtgaccaaactacaagacttgttgagctatcaaagcgtcttcggatcctcctcattccccactaaactagacatttgagcatacaaataggagaggaagaagcatctactcgaccaattgatcactcggagcatagacacaaaggcgcagactttgcagcaccctctttactcgatccccaagatcgagtattcgcccaaaccgcctcaagtctcttgcctactagtgaatctagggtttcaacattttactataaatagatcactttggggtttgtccaaaggatctagcttttatctttaggttttctttgtgttcttgaatcttcaaaacttaattactcttaatctatttcgtttttgcatttagttgtttaagtaaagttgtttagcttgtttagatctacattttggtatgatttcagtaatttctgggtttgtgttcttgagaatgttgcttgagtagtgattaggattcttgaggatggattagattagggtaatctctaggttagttaggtggttaagattagtttagaacccttgtggatttgcttcgcccctatgcagttttcgctggctgatgtggagattcgatcatagacgtccagcgtccaaaagacgttcaaatggatgtctgatcatcaaattccagagatttgtagactcgaccaagagattggcttgtctgcttattggctttggtagattgtttcttaaacccttctctactatgtttcatcaacgacagttaagattaggaagtggtagagttatggggatctctgtcccaagtgtggattgacccggtttttgaatctatcgtcaagggtatctacctttcacctattagccatctgatgaaccctagagttgcccttatcaatgaacccatccttagaacttttattagatttatttgtatcccctgttgattgcacttttatttacctgttatttgtatcccctgttgattgcattttagttctgcctattggttatactcgacccaatgatcgagtagggctcttaagttctcatttttacttgttcgaatcctaacctaagattgttactagaaatccaccatcattataatctggcttgacttagttgtttctgtacacatcttgattgctagcaataacagtggactggattgacaccccctatagctgcatcgacatgtttgtgttttaggggaattgaactgaaccacgcattcagcatataagtaggcataaaaaacctgcttatcacttttctagtattttcaggtctttacaagtttgagattcatttggagataatagagcattctggaggaaaacaaagggtttatgctgctgaatcgcgtaggtgtctagcgacaccattacctgacgacaactcgaagacgcaacttattgaagttttgaaaatttctaaattcggctcataactttcccttatttctaaagaaggcctatcacgtttttaagtcatatgtaaagtttttaggtcattgtttagatctaagttggagaggctattctccttatctctttggtcttgggagcaaaaccctgtggagacttcctttagataagatctttcttactctttctcttgatatattgactatttatttccaattcagactatgatttgtgtttctttgatcatgtatgagcaatccacttgttaggtttagggtttctcattagggattcatatggtttagtagatcgcccccctgctaggttatctgtagaattcttcatatttaattgttcttaatgctagttctagagtaataaactagaacttgaatccaaacaatagatataaccgccataggtatttatagttggatctattatttgatgagcctggtttatagctgtgtaataagaatcagcctatctactaaggtgaacaattaaactcgtttagaatgcatgtctaggtataagatctctcggcttctcgagttactctttttgttttttgaaataaagttaaattagtttcaaaaaagaaaagtatatgtgtttacaacttgtgcaacgtttttgaagaacataaaaaccaagaagaagcaactttttaccccaactctcttgtttgaaaccaaaaatggagagctcgatcatatcttttgtctccactaatattaatagctgatatatgattccgaatgtgcttatcaatccacttaactagtcgggctacaggatttgggagactgccgtgtttacgctcatttcgttcccgccatatggtgtgtaccgttgcctgcaaaacacaacgagctaagaatccttcgacacgattctcgaccaatagttagcgatgttgtgtataatctcctgccaatccgtggaatttctctatacttgagaattgttttccacatccatgaaccaaggcaagtgatatctattactgcccaaagagacccttgtttgaggagggaagttctgacccatttcacccacagcgaatccttgtgggataagataagccaaatcaatttcaagaaatagacatcattcgcttctttaagagaccgaaacccaagtcccccctcttgtttcggtttacacacagcttcccatgcgatctttgcttttgttgtttgtaaatcaccaccggaccacaagtacgcttaacacaactgatctatttctcttatgcatgctcgaggaagacgaaatgctcccaaccagaagttacatatgctccaaagacaaatatcgtgccgaccaagaacgaatcttcttctttatttgttccatgagagggcgataatctgtagaagagagaccttttatgaccaaaggaagtcccaaatatctcaccgggagtgtaccaactgcaaaaggaaatcgatctgctatatcttgttgagaaatgtctgtcactcctacaagataaactgttgatttttccatacttatttcttagtcccaaacttttagcaaaagcatcaaacacttccacaatgccttctatagatcgcattttaatatgggcttatatcgagtccgttaaaaaaaatataagccctaaccctgataaaattaaataaaagattttgggctaagatagggctatactcaaattgttatgggctaaaatagggttggccctattacactcttttattattccctgtcctttttttcttcttctctttctcccaattcccaaacgcgtcttcttcgactcttcttcttcaatctcttcttctttgatttcttcttctttgatttcttctctgaaaccataagagtgaaagatttcatctgaatatatagagaaacagaagcttggtgaagtagcaacaaccctaattgcagatacttaggtttataacaaagtggatcccgtcacggccgacggaaaggttgatattgtgaggaataatttgatctcgctttatgaagaataccagactaaatctgcaagttcttcgaactcttcaaccacacttactccacacgagcttctcaatgaattgccacttgaagcagatgtgaatgatgtaagtataataatatatttgaatatctttcactagttctggtttttgtttaactaattgtgtgtctatttgtgtatttacaatatctttttgagcttgaaagtagtctcatatctgcttcaaaaagtaccaagtcaactttggaaatctatttggatgatgaaccaagattagagatgaagactttctctgacatggaaattttaagcttttggaaagagaatcaacatagatatactgatttagcttcaatggcatctgatttgtttagtatcccaatcacaacagtagcatcagagtctgctttcagcgttggaggacgggtgttaaatccttttaggaatcgtcttcttccccaaaatgtgcaagcattaatttgcacccgcaattggcttcgtggatatgcagatcttgaaggtaaaattgtaatttgaagttataaaacttacataaatcattgtcttattttaacttgtatcattaaaatgcaggagaaatcgaagaactttttgctgaagaagataatgatgctacaaagatgacaagtagttcaggagttggagattctaacatatgatgagaagttttttttgctcagtttttttttggacaaatatcggtaacaatgttttacatttcagcaaaatgacaagaaacaatgttttatatgttgtggtgttatagtgtttccatttgataataaacaatagtattattatcttataattgtttttgtttgaaaaacccttctctttaaataaaaaaaaaaaacttaagggctacaaaaggccaaaaaggtgctcaaccctgttttaaatttttttagggattaaaaagggttagggctcacttagggctgggcttaaaataaatagggctgggttgggctggaaaaccctttttaacatccctacattttaccatccgaaagaaccttaagattatctgcaaaactaaggtgagttaaaccaatgttcttacatcttggatggtaaccaaacttcctcaaacctactgccttatccaatagtttggagagaacatccatactaacgacaaacagatacagagatagagatagagaacatctctgtctcaaaccccgcacactgttgaaatatcccaccagttccccattgacttgaaccgaaaaagaggttgtggtgacacaaagcataatccaatgaataaaaaacaatggaaatttcatggcttcgagtaccttacggagaacagaccattgaaccgagtcgaaagctttagagatatctattttaattgcgcagccagtcgataccgattctttgtgataatcttttactaactccgtcgcgagcagcacattctctatgagcagcctatcttgaacaaaagccgattggtttcctacaacaaaatttggtagcactcgcttcaggggattagctattatttttaatatgactttaaatatgacattgcaacacgatattggcctataatctttcatctcattagtcgttgccttctttggtatgagagcaagaatggtggaattaattgcctttggtaagaatcctttcacaaagaaggatttaatcgcaagaataaactccttcccaatgatatcccaagtcgatttataaaactccattgtataactatctggtcctagcgacttatcttttggcattgcaaagagtactcgtttaatctcctcctctgttactgacctagtcatctctgttttctcctcctctgagcatcgataaggcagcaagtcttgaagttcactaatggatatttcctcatagtcatgtgaaatcagctgaagaaattctctaaaaaagtgttctgcttcctcttttatttctactactttttttgtaactgagccatctggtctttgtatttccctaatcgagttgtgcgctttccttaaagtgaccgctctatgaaatgtcttgtttttttgtcacccacatcaagtcaatgcaacttagatttctgttttagaaacttctgttcaagacaagtcaccctttcccacctatcataagcctttgtttcctcctccattgccctaactgaaggattttgtagattcagttgctgctttatgcaaagatcctcatgtgcttcctttgccttcttgaccaaattttccaaactatctttggtcaagtttctaatcaccggttttagtgcctttagttttctaataaacgtcgatgtggacatatgaattggttccgcgtccccccccccccagtaattcgccactaaaggtctaaattcctccatcattgtaatagctgataataggtttttatggtcaattaatcctaaaataccaatcatgtcgttgtagtattttaggtgtcaatccaaatgagtgtgatgcaaacagatgaaatgtgatcagaagtcactaagtcaagccaagcaataacagttttggggtttctaacagtcctaagcgaacatgcagaaaacagaagtaataacagaattactaaaatcactcgaccacaacaggctgatgccagaagtaggatgtggtcgagtaacaggtcgagtaacagacaggaaacaagacaatcttactcgactgcacagtctgttgccagacactgggtgtggtcgagtaagttggtcgagtcattgtaaaaactaagaaacaggcaatgagaacgatcaagcgataacgataaaacagagaaataagatagacgagaaattcctaaggatggggtaatcgagtagagtggtatcctagcctattcgaatggttaacaagcgcaatcaagttatccctagacaacaggttcaacaacagatcaattcactcccgtgacagaaatcctcaagcaaagctagcccagacaaattcgcattaacggaatctaactatgcaagcaataaaaacagactgataaagtcaataaatgctctaaacggccaatcccttgggatagagacgcatatctcaggaactagtggatcaagcattccatcgaacaccttctgggtgcgcgaatgcttgagatcgaattccagttgatcagaaagaaacaagcagtaaacgcaactagtcctaaagggatttaatcaattctaaaacttaaccattctacagactacggattccacaactactctatcccatccctaagaattcaaagtcactactcagacaacatgctcaaagacataaacgcagataaacgataatattgcataagtaaagagataaagagtagagaaacaagatgacagatgaaatcaaatgcggaatctgaataacttggaaaaatctcgaattacaggttgcagaagcaaaaccggcgcagtagagtaaaacagaaaataaaactgaagcaaaaaaactcaatgtcgaccggatatctgaggacagaaccctaagacatctatttatacaaaacgaaataaaatgatagtagacgggccaataacctaatcgctcggcccatagagagataatgggccgagatgggcttcgtgatccgatggaggtccaggccgcttccaaacactttgtcttctcctcttctcttccttgtgctcagcttgtctggttgagtgcgaatttgagtagactgtgaagacgtgatcgagtgtccggtcgagtgatgcttatggtggtgagtgttgatactcgaccagggggtcgagtaacttggtagagcgaatggtcgagtgatggtgatggtgtggcgaagtgatactcgaccagggggtcgagtattgtcatcgagtggcctgagctgaggttactcgacctggtggtcgagtggatgggaagaatggctccaaagtcactcgacctgggggtcgagtatgtgggaagaatggctccaaagtcactcgacctgggggtcgagtatgtcttctggttctggctcgtttcttccaatttgcttgcaaacagctccaaatcacctgaaaacaactcagaaatgtaatatgtatgcaaaactatcctaatcatgcaaagtatgcaagaatgatgagaaatgatataaaacagtgatgaatgatacgaaactggactcaaaaccatgatgaatggacactgaaaacatgcaaattatagacatatcaactcccccaaacttagtctttgcttggcctcaagcaaataagaagacatagttgaaggagaggagtgaaggcggggactcagaaccaaagcatatgatagagcaaataaaatcattgtccaagttggtagttctaagatgcgatatgattgaattctactcaaaaacgttaaccatgccttgttatcaatcaatccgtctcttatactcgacctacacatgctttcaaatctaccaatccctttaacattcattagttctggaacgtgaatcaagcagtgcatcatcaatgaactcatttggctaaggtgaaggtcaagagacaaagatggtcccttacagaataggcttaagtaacaggggatccctcaagaatgattgagctttagtagaatactaaaggtaagtcccaagttatgcatacagagataagatcccatctacccagagtataacaatgaagttctaatggtgatcccaactcctgtcccaacttaactctgccctttgcactcatgaatctttcaaactctttttcatatcattcttttcttttctcttaactctaggagaagctttctcaacgctctgatacatctagcgggtttggatttctttaacaactaaggttcctgtttttttttttttttcctttaaaaccaaaggcttttaacccttcttctttagctaacaagaacctcattcttttctttaacattctcaaaacctttactagattttttttctaacttctttagcttacttcccctagaattctttccctttcctcatcaacaatgaattccctcttttcttttaaacacatcccaacccatgatataagcgcccacctagtcctatccagtccgaagaacgcgaactagaactacatgagacactatctctgtcgttacgtattaacactttctaccaagctcaatcgaaataagacctcacaaacactcacaagtgatatagggcttgaaagaaagttcaggtttgggtatgggttaactgctctaataaagagtggttaaaatgagtaagaaaatccaagtattttagggtatccatgagttcaaattcgatgccaagacatgataattctaaatcagattcaagttcaaattgatagggaatgatatcagtttgaacttgaatctaggcatggtgcagtttttacttcaatttcaatgacaacgcatcaaacaactaacaacgagggcactgagctttatctggtgaaccaaaatgcttacaaggctatctcatcattatcccctatgcatatgcaacaatcctaaacgaaacactctagactcgatcctaaatgaaatgcaactacatgaacactctatttttgtgaaatcattttctgaaatttttcaattttttttttttttggtttttctatgccttagatgaatgcacactcaagattatatacaatgcaacacacacttcctgagccctcccccaaacttaaatcacacagtccactgtgtgaccaaatttggaagagagtactcaggacaaaacacatctcaaagacaaaataaaaacaagagatggtatattacaatggtggagtgaggtgcatacctcagtggaagaaggagcggagttggtcgtcaatagctgcctgtgattgctctcaggccatcgaagaatctccctgttgtgtctcagcttccccctgggggtactcgacctctgctccttcgtcgcagccagcaccgctctgatgatactcgacctctcttcttctgctgcggccagcaccgcggtcgcgtaagctacgggactggagaagtcgtgactgcatcattcgctatactcgaccacatcgtcattcgatctctatagggtgtggtcgagtgatttcctggtgtgaagaagccagaacaatgtcgagtttgattgctctgtggtcgagtgtattgctgttccttcaaagccagaatctatttccatcaactcttcatacttatctcctgaaaacactaacaagatgcatcaaaaacaaccaggaaaatgaaagatatgtacaaaggaaggcttgggacttcctcccaagtgagcttgttttaggtctctagcttgactcctcatactcattaggcgtttaaaggctcctccaaaggaacagaggttccttctggaataaactgatctatcatgtatttcttgagccgctggccattgactgtgaagtctccattctttccagctagcgtgatagcaccataaggtcggactgcagtaacagagaaaggaccagaccatctagacttgagcttgcctggaaaaagcctcaggcgagagttgaacagcaacacttgatcaccaaccttaaaatctcttgagactatcttcttatcatggaaagacttggttcgctccttgtagattttggaactctcataggcttctaagcgaatcttgttgagatcgttcagttggattaaccgcttctcctcggcggttttaatgtcgaagttcaggagcttaactgcccacatggctttatactcgagttcaacaggcaaatgacaggattttccatagaggaggttgaaaggagtcgtgccaataggggtcttgaaggctgttctgtaagcccatagtgtgtcattgagcttagcagaccaatctttccttgtacttcccacagttttctctaaaattgcttttatctccctattggagatttccacctgcccgctcgtctattgatgataaggagtggctaccttgtgctttactccatgcttcttcaaaaggttctcaaaacccttgttgataaaatgtttccctccgtcactaatcacaattctcgggactccaaatctagggaagataattgtcttgaacagctttagcacaactctagcatcattggtgtggctggctatggcttccacccattttgatacatagtctattgcgaccagtatgtacttgtttccgtaagaggaaggaaacggacccataaaatcaattccccaaacgtcaaagttttcaacttctaagatcggattctaaggcatctcattccttctgctgatgttccctcttctctgacatgaatcacatttcgagataaattcctgagcatccttaaacattgatggccaccaaaaaccagcttgcaggattttcgacattgtcttgaacgttgcgaagtggccaccataggcaaacccatggcaatgcaataggatgccttcaatttcgtcttctgagacgcatgtcctgtagatcttatctttgcagagtgtgtagagataaggttcgtcccagtagaaatggttaatgtccttgaagaacttcttcttctcatagctcgacagattcggaggctcttcaccactaaccaagtagttgacgtgatcagcataccacggaagcttttcttcaattgcacatacttgatcgagtgatttctaaatttgagcactctcgttaagttgctgaattgccattagctgttcttctggcatggagtcgtcaataaggacctcgtcttcaatcctcatcctagacagatgatcagctacaccgttttcgattcccttcttatcaactatctccatatcaaactcttggagcaataagatccatctcaacagcctaggtttggtatccttcttcgcgtatatatgcctcagagcagcatgatcagtgtagattgtcactttagaacccactaggtagcttctaaatttttcaaatgcaaataccacagctagcaattccttctctgtagtggcataccttacttgtgcatcatccatcgttctgctcgcgtagtagatcacatgcagctttttatcaatccgctggcccaagactgctcctactgcgtactgaagcatcgcacatgatctcgaatgggaagtcccagtttggagcttggactattggtgcagtgatcaaagcttccttgattaacttaaaggctgtcaaacattcgtcatcaaatgcaaactcggtttccttgcacagcagtctggtgagcggtcttgccaacttggagaaatccttgatgaatattctgtaaaatcctgcatgtccaagaaaactcctgatgtctttgacagtttttggtggctgtaactgcatcatcacgtcaatcttagccttatcaacctctattccctcctcagaaattttgcggcccaaaacgatgccttctctaaccatgaaatggcatttctcccagttcagcaccaggtttgtctcttcacatcttttaagtaccctgcacaggttcaacaaacacgaggagaaggaagagccatacacagaaaaatcatccatgaatacctctaccatctcctctatcaaatccgagaaaatagaagtcatacaccgctgaaaagtagctggtgcattacagagaccgaaaggcatacgcttgtaagcaaaggtcccataaggacaagtgaaagtggtttttccttggtcatttgggtgaatagggatttgaaaaaatccgctataactatccaaaaagcaatagtaaggatggtttgctaatctttctagcatatgatcaatgaagggcaatgggaaatgttcttttctagaggcaacatttaacttcctatactcaatacacatcctatgtccagttatagtcctagtgggtatcagttcatctttagaatttttaacaactgtcatacctccttttttaggaacgcagtgaactggagatacccaagtgctatcagagatagggtagataaccccagcatctaatagtttaagtatctcctttttcacaacctctttcaagttagggtttaatctcctttgaggttcaatgctagagtaggattcattttcaagatggattctatgggtgcataaggtgggtgaaatccccttaatatcatctaacgaatatcctatagctttcctatacttcatgagctcagttatcagcaggtttacttgatcagcagttagctcatcattcactatgacaggataagtagagtttagtccaagaaaaacgtaccttagcccttttggtagcggtttcaaatctaccttgggtgccttgatttcagaccagtcatcggatactaagttggcttcagatgaggagttgtgatcgagtgacgtggtcgagtagactgaatgggctgttggtcgagtgatgtggtcgagtatatattccccccttgctctttcacccaaatcttcatattctcctggattctcaactgctttgttcatctaacagcttctggtaccccaaagtctccaaatgtaaatctccttctttgctatcctttgttagagcactctgtagatgatctgtttctcccagctcttctagcattttgtcagctaacatatccatctcttcaatccagaaaatatttccttctatcgtaggcttcttcatggtgttggtgatatcgaaggtcatcttgagatctcttccgaggttaagatcaatttttcccttcttaacatcaatgatagctctagctctagctaaaaatggtcttcccagtatcaaagggtctttgggttcttcatccatttctaaaaccacaaagtctgtaggtacctcgaccacgcctatcatgactggtaagtcttccagcagaccatgggagattctaacagatctgtcagctaggatcaaggatatattgcagggcttgtacttgttgaagcccagtttcttagccacagggagaggcatgagactcacagatgcacctagatcacagaggcacttgctgaaggctaaagggccaagagcgcaaggtaaggtgaaggaaccaggatctcctagcttttttggaatgatcttctgctgaatgatcgcactgcattcgtgacttagcaccaccattccttggacttctttgatcctctctgtaatcatgtctttcacatatttgttagagtctggtataagtgcaagacagtcgacaagaggcatcgtgacttcaagatttttcaattgtttctccaggagagctttgtacttctgtatcatgaccttcttgaatcgaccaggaaatgggagtgggggcttgtaaggtgggggaatgaagacgttttctttggttttggcggcagctggtttttcaacaagaggagatgctgcaggagctagtggtcgagtaggttggtggagtataggctcttctattgctttttcagcggaatttccattttgacagaaatcctccccatcttgatccagactgtcctcagtgttctggttcggactctcttttgtgggtaattctttaccgcttctaagtgtgatagcatgagcgtactcctttgaatttgacattgattttccggaaggtcctgtaaatttgggtgctgcggtcgacccagtttggccttctatgtatctgatcttagatgttagtgcttcaaccttgatattgatatcattgtaactgcagtcaaccttgttgtgaatttctgccatccttttggacaaatccattgctcctgttgcttgcccttggagaatctgttgtaacatgttcttcaagtccgaatctggagttgttaaagctggttgttgttgctgctgtgtgaacccaggtggtggaagttgctgctgatagttgccctgatactgctgcttaggaacatacccttgaccttggttgtatggaacaaagggcttgggttgattctgctgctgtgaagggtaaacttggtcctgccggtttgcaacgtttgtacttctgtaagacagattgggatggttctgcttgaagttgttgaaacctttgttgtaacctccttggttctgcacatagctgacctcttctaactgcagagtctccccatcctgaacttgtaacgtctcatcatcacccagaaaatgaatgtgcttctgttgcataaggagtagcttgtccagtttgtcattcatggctttcatttccctacggtgcttctcatcagaatcagagcttgtgcggatgcttctgtcataatcttcattatagttgccatccgactgagccaagttctctaccacctcccatccgtcttcaacatctttgttgaggaagttcccgttagaagcggtatctagaagcatctctgtagagagtgctaagaagcgaagctttggagaaaccatgatgaggacattgcgtctgataacccttgaagcgctcccatgcttcatagaaagtctcattattcgtctgagtgaaaccagatatgtcattccgtagtctcgcagtcctggagtttgagaaaaacttagccaagaaggctttcttgcagtcattccaggaggtgatagagccttgaggaagtgacttttcccactgatgtgctttgtctccaagagagaatggaaacaatctgagcttgaagccatcctcactgactctattgatctttgttaggctgcagagcctatcaaactcgtctaggtgatcgagtggatcctccatagggaggccgtggaacttgttgctctgaaccatggcaatgagaccgctcttgatctcaaagttgttgttctgcacaggtggaggcacgatgccattacgctgattgtggttgcgtggtgcatcgcctgcacctatgttgtttggttgcacctgctcatcaacaactgcagccattgtgtctgtttctgtctgtgttctgagttggcgtgcaatacggtcgatgttatcgttgaacaggagattctgatttcctcgtgatcgtgtttgcatacaacgagtaccaactggtgaagctggtgattcgtagtacctgaatcaaaacagacaaacaaaaaaaacacaaagtgagtaactttcagaaaaaatgaaaaagaacttgatcttaaatattctgaaatctcaaatatagcaaacaaacacccaattggcaacggcgctaaattgataataggtttttatggtcaattaatcctaaaacactaatcatgtcgttgtagtattttaggtgtcaatccaaatgagtgtgatgcaaacaaatgaaatgtgatcagaagtcactaagtcaagccaaacaataacagttttggggtttctaacagtcctaagcgaacatgcagaaaacagaagtaataacagaattactaaaatcactcgaccacaacaggctgatgccagaagtaggatgtggtcgagtaacaggtcgagtaacagacaggaaacaagacaatcttactcgactgcacagtctgttgccagacactgggtgtggtcgagtaagttggtcgagtgattgtaaaaactaagaaacaggcaatgagaacgatcaagcgataacgataaaacagagaaataagatagacgagaaatttctaaggatggggtaatcgagtagagtggtatcctagcctattcgaatggttaacaagcgcaatcaagctatccctagacaacaggttcaacaacagatcaattcactcctgacagaaatcctcaagcaaagctagcccagacaaattcgcattaacggaatctaactatgcaggcaataagaacagactgataaagtcaataaacgctctaaacggccaatcccttgggatagagacgcatatctcaggaactagtggatcaagcattccatcgaacaccttctgggtgcgggaatgcttgagatcgaattccagttgatcagaaagaaataagcagtaaacgcaactagtcctaaagggatttaatcaattctaaaacttaaccattctacagactacggattccacaactactctatcccatccctaagaattctaagtcactactcagacaacatgctcaaagacataaacgcagataaacgataatattgcataagtaaagagataaagagtagagaaacaagatgacagatgaaatcaaatgcggaatctgaataacttggaaaaatctcgaattacaggttgcagaagcaaaagcggcgcagcagagtaaaacataaaataaaactgaagcaaaaaaactcaatgtcgaccggatgtctcaggacagaaccctaagacatctatttatacaaaacgaaataaaattatagtagacgggccaataacctaactgctcggcccatagagagataatgggccgaaatgggcttcgtgatccgatggaggtccaggccgcttccaaacactttgtcttctcctcttctcttccttgtgctcagcttgtctagttgagtgcggatttcagtagactgtgaagacgtgatcgagtgtccggtcgagtgatgcttatggtggtgagtgatgatactcgaccagggggtcgagtaacttggtagagcgaatggtcgagtgatggtgatggtgtggcgaagtgatactcgaccagggggtcgagtagtgtcatcgagtggcctgagctgaggttactcgacctggtggtcgagtggatgggaagaatggctccaaagtcactcgacctgggggtcgagtatgtcttctggttctggctcgtttcttccaatttgcttgcaaacagctccaaataacctgaaaacaactcagaaatgaaatatgtatgcaaaactatcctaatcatgcaaagtatgcaagaatgatgagaaatgatataaaacagtgatgaatgatacgaaactggactcaaaacgatgatgaatggacactgaaaacatgcaaattatagacatatcaatagcgttgacaaaattaaaaggtcgccgctcacgacccctttcttcattcactgtagtcagatttatcttacatcttaagtggttgaaaaatcctcctgcttcaaaaacactatatgacataggataattctgcagccatacgtcattcatcaaaacacgatcaagtttcttcataatcaacccatgatccctcttattactccaagtaaatagcggaccgtgagaatccatgtccgaaagagtgcagtattgaattacgtcttggaaatccctcattctagaagttacaacaggctgattctccaattgtgaatgcttgtccatatttaggatttcattaaaatctccaaatataatccacgctttattactaataattggagagtcgatgtgatctcgcaactcactccataaattctttctctcttctgcaaaatttgaggcatacacaaaagaacaaaaaaactcattctcttgatcctctagttttactgaacacgtaattacttggccgcttttcaaaacggagttaatctgacatcgtttctccatagaacccaaatacgccctcttcggttggattcataatttgtaacaatagccctgtctttaaataacttacttcctaacctttcagctttactctccttcactcttgtctctattagacacccaaacttctgctccttaacccacttcttaataacggaatgcttatttgatttgtttaaaccgcggacattccagaagcacgacattatcaatttttttggtggcgcttcttactctgagggcgacctcttatttgagtataagcaacggaaactgtcttatgtgctgtttttgatcctctaggtagattctatctaggctcaacctgtgatttagagtgcatcgacttagataaaagaggtatctcatttgttatcgctgtatcagatgactcctcttctattgtttcaggcgtggcaatcagttcatcttccttatcaacgtgattttccccctctttcatagatatgtctgcatcttcttccctcttctccttaacctcttcaactaaaccgccaagagcagagtaggaattataaaggatggagacttctccaaactttggtatatctattgttttcccgggggtacgagtagactttgatggtgtggaccactcttcttctgttgcattatcttgattgtttcccccgataggtaaatttatccttgcttggacctcttccaaaattttttccaccataactttctcaatagcctgtttgctcttgatactcttctgttatttgttcgctatccacctcattcatatcggaaactttactgtgagacaagttcgagtccagtgctaagcacgtgttttgaaagtgtccccatttcttgcaacaattacatcttggtggcagccaaggatataaatacttgatcaccacatctaactctccttcttcctcaccactaaaagagtattcagtcagtaagtcttttgtaagatttgcctccactaaaatttgtgcttcatcgaaactcgaacatgtttctgtttttggatgaagtttgacaggtttgccaacgaaattctaaccctttatccgtaaacatagaaggctggacatccttcagtgttacccataagttgattgatttcattttaggttgcacttcttcctcataaggagaccatttcgaaaccacctttggaagagccataatattccacattcccctattcagaatccttcttctcattacttcatttctaactcacaattgaatcgttgttgcatttacttcataaacatcgatcattgttgatttatctcccaatctccaaattttattcataatcatgtgaattttcccaacatgaggagctttattgttgagaaatttccccaccacaaaatcttcccagagaggtttagctacaacaaaaacctctcttggaacaaccattctgccttggccatcaactacatccactacgaattattgttttgtaaatccatgcttatgagcaacacttgcgtaggatttcctaggcaatgaagcttggtccgatgctgaagaaacctcagggtttgagtcacccatcggctctgtttcctgctcaaaatcatcttctttctgtctaccatcaacctccatcttgctattaaaatagtcttccaactctttacctctcaactccgcatcatctttgcatcctccttgtaccagaacatcatcggcagggactggaggtgctgccggcggcaacagacgtgctcgagaatccaaaaaccctaaaatcgccgtttctgtcgccctagccacgtcagctttttactttttgaaaattctccagttactcttcgctataggtataggaagtttcgtgaaacaccactggttgttacaaaattagagttttagtttaagaatggttcgataacaacctagctattattaaatctactaaccaatagtaacctgagaataccttaagcctgacgtttttactttcttgtcttacaacctcacaatctgttattgctttcttctattcttttaattttcattactattttacttagcttaattcaataccttggtctattgtgtgatccgagagctttgtggaatttgacccttaagtgctataatcgatctcttatttgagagagtaggtttaaggcaatttgaaccttatcaaatttggcgctgttgtcgaagttctctacgattcaccattagattaggattagaattttgtctaagcttttatttttctttttttttattttatttacttagtctttctcctttatttttttctgtgtttcaggtatttgtctaatcacagaaccaggaacaagcgagaaacatgaacaagagtaagattgctgggatcatggctaagcttaacgcggtcgacaatcaacttgtggaggatgtcgcttatgttcgtagcagagattttccaaatcagagatttgatcaccaacaaggctacaaaggttcctatgggaatggtcaaactagctactctcagaattctcagttccagcaaccgcttcagaataacaatagttttagcttcacaaggaactttgatcttgcttcttaccaagtaccccctccacctgcacctagacgcatgatagaatcaatgcttgaatagattctggaaggtaactagaggatcttacagcacctatccctagatggaatgagagcagcctcactacttcttggcatgctgcttcgatggaaagtggatatgagttcatgaaggatgatgagagtgacgaatttgacgttgcaaaggtagtatcgaccgacacatcccttggtgtcgatcgacaccagtgcatatatatgagccattaggctgtgacgaagcaaaatcgagcaggctcgacactgatctctagagtcgctcgacacacattgatagtgttgaccgacaccacctgggtgtcgatccacaacaataccaacctgaggaagtgtcgacgtttgacggagcagaatcgaccgagattgacagagcaggattgataccagactcccgatttgaatgccactaaggacagtgacgtttaagtctgggagaggcagttactaactacgtttttctttttgagtcttattcttactcttatttttcttattttttagtcgttttattgagtcaacattttgttaggaattatgatctcttttctttagattattgccgggttgattaatgctgcaggttcgacacaatctgactattggaaaatctagatggcaaaccaagagacttgaggatatcctggtttccaacacaatcctttaaggttagagctaatcttactgctcttccttttacctcatcaaaacagttagtgttcatagaacttggcttcttgttcatacctgatattgagaccaatgtgaaaaagaaaagtattcctctccccttataataaaaaaaaacgaagtaagagagtgatatgatttgaggtagtgtataggggtaggaatgtttcccatgaccccattattatacattgttaggaatgatcaattacaaaggttggaaaaatgctgagtgtgtcgatctagtatgcgagttcccctttgtttactcttcaaaaagaataagtctgggggatagaaaaagtaacaaaagaaaaagaaaaaaaaagttatatatatatatatatatatatatatatacaaaggatggtcgatttatcatggtatattacatgaataagtctagaaggttcttgaatattagcttgcttgatgagaccatgcgatgaaagcctgatggatatagttgtggaacttaggtatggaatctagaatgttgtgtaagcttgcagagaagtacatgttggttaggatttgattagacttgctaggcatatggatttagttaaaatgatcatggcaataggctagagaatgttgggagttcttatgttttcaaaccttttccatggtttcgggggagttgatatatccctatttttactgtttttatctatgattttggtagtagttttagagtctattttttatttctagagtcttttctagtcttttgaggtctttacaagtttgagattcatttggagataatggagcattctggaggaaaacaaagagtttatgctgctgaaccgtgtaggtgtctagcaacaccaatacctgacgacaaatcgaagacgcaccttattgacgttttgaagatttccaaattcggcccataactttcccttatttctaaagaaggtccatcacgtttttagatcatatgtatagtttttaggtcattgtttagacctaagcttggagaggctattctccttatctcttttgttcttgggagcaaaaccctatggagactccctttagataagatctttcttactctttctcttgatatattgactatttatttcgtattcagactatgatttgtgtttctttgatcatgtctgagtaatccacctgttaggtttagggtttctcattagggattcatatggtttagtagatcgccccgtgctaggttatctgtagaattcttcatctttaattgttcttaatgctagttctagagtaattaactagaacttgaatccaaacaatagatatacccgccatagatattatagttggatctattatttgatgagcctggtttataggtgtgtaataagaatcagcttatctactaaggtgaacaattgaagtcatttagaatgcatgtctacgtataagatctctcggcttctccagttactcttagctataggcatagggagttttgcggaacaccaccaattgttccaaaattagagttttagtttaagaatggttcgataacaacctaactattattagatctactaaccaatagtaacctaaaaataccctaagcctgacgtttttactttcttgtgttacaacctcacaatctgctattgctttcttttgtttctttttattttcattactattttacttaggttaattcaaaaccttggtctattgggtgatccgagagctttatggaattcgacccttaagtggtacaattgatctcttatttaagagaataggtttaagggaatttgaaccatatcaacaagcagaggagaaaatataaaaacgaaaaaaatcagatcgactttctctctcttcctctaccttctttcatttttttcgactttcctcctctccaaagaaaatcgatacgatttctatgtaaaaaatccaatccactggaggatccactggaagataatgaatccggctgtttttggcctatatctcctcatatcactaactctgggtgtctctggcgaggtttagtcgtcgaatcggcgttatttaaagtcggagagtagggatgtcataatgggtaacccgacccgacccgatccaaacccacatgggttcgagtgcttaatggacgggtttgacccgacccatatatttatatggattgaacttacatacccaaatccattattatagaaacccattggtttaatggattatatgggtacccatatatatgtataataaaatatataaataataaaaatccaaaaaaataacatagttttgtaagccaacaaaagtttgtaaataataaattaaaacaatctagatattaaaatagaaaagcatactaaaatcttaaaactacaaatccaaagaaccataaaactaaaaaaaaaacaaaaaatagtcttaatttaaaaagctttaaatgcatccgattcttccgcatcgaattcttcggcctcattcttcattttggcttcattgtctacaaacgagatgaaaaaaatattagaaccttggctataataataacaataacaaaatattgaatatagatggtaatatacctttttcatcatccgcataaccaaataaccaagatctagtacaaagtaaagcttgaacatgtttaggaagaagtcgactccgatacttattaagaacacgagaaccaatactgaaagatgattctgaagctacagtagttatgggaatactgagcacatcatatgccatatatgataaagcaccaaagcgatgactgttatctttccagtactgcaaaacagacatgttaggaaagttccttcatctctaattttggttcattcaagtaaatatcgaagattgacgactttccctcatccataacatcaggagcatcgtccaaatcaaacaaatcctacgttatatgaacgtcaatcaagttattattatattatatgactaactaattatttaaaatactaattaattatttaaaatttaaaagctctaaattttgaaacttacgtcatcgaatttttctctaccacgtttagtggaatgatgagaagacgaagatgtagttgaagagttcatgggcattggaaacttacacttgtactcgttaaacaacatagtcattttatccttcaaaaaatccagttttgcttgagaattacttggatcgagctcatcgtaaagacgcttcaagagcttaaacttcattctaggatcaagaacagcactcattgcaagaacaatgctatattgttcccagtacttatcgaatttaatccgcattctacaagccctgtcattgataagctacaagaaaattgccatttaccgacttcagtattactcactctttagtcgctaaacacctctttacgacaaataaacgactattaaatttagtcgctaatcgagagtcggtaaatacgatagtcgtattttagtcgccaaagagcgactaagtttaagtaatcgcttttatagtgaccttttagtcgttaaatttagcgactattagacgacaaattaacgattaacttaagggttatgtagtcgttgtaggtaattagtcgttaaaatttacgactatgttgtcactatatttaagactgagttgcgactgaaatgtcatttagtcgaaaattttagtgactaaattgttatcaaaaaccgactgcttggatacatttttgatgactaaattgcgactattgttgttattagaacacctatatgattgttctagagatggaaaccttcctgagaaaacaaaacataaattacaagaagcataaagacaatacaagaagcatgaacacaaatatattgtcatttcagaaaagtacaaaacccaaattacaaaaacatgttcgattcactacaacttagaactttgttcagcataagtacaagcaacacaagtacacatatataaaaactttgagccgtgatattgagtcttgaggaaggagttaagattcagacctatgaagcagatgaagagggagaggcagctggagagggtgagataggatctatggttgtctccttagctgaatgagattcgaggaaattgaggaaccaaggatcattttcgcgcaaaaacttatccactaaggacaagtgctcaagcttcttcttctgctcatctgcagctcgggaattctcagcttcacgcaaagaaatcttagattcacgcctatgattgtaagagacctgctcttctatcttgcgttgagcttcctgtaattgttcttgcaaagctacaaaagaagttgagtcacctgcttgcttccgcttgccattgacaagagactctttgaggcttcctactccataaggaacgcctctcgaatccctctcagtggactgcaaagtatgataaaagctgagattagagaatgaaaaagacaactcgaaaacactaaattgggaaacataaaacgttacctgaagaaatatggttgtacaatcctcagctgtgagctcccgtgcccgcgaagtgccatctgaaacagctgaagcttcagcctcgaactcagactgcctcagttgcaaattcttcttatataactccgcaatcttctccgcctttcgatcaacatacgtcccatcaggttttgtatgtgttttgatgaaaacgtcaccaatattgacagttttgcccaattgctcttcctgtaatgaaaaaaaaaacaagtcatagaaaagtagagaaacatcagattaaagttgcaaaggagtaaacagagagaagacttaccaattcgtctcggatttgatgatatgacttcgaccgtgagaagggtatgtgaggacctagaccgttacggtcagacatacgagcatttgaacagatttgacttctttcttgagcttcttcagtgtcccagtacgcagtcattgttttccatagagtttttccgatccatttaggtttattttgactagttcttgcagtgctaaccatgcctttcattcgccttaaacaaatctcattgaagtaaaactgaacagtccatgtgatcaaaggatcccaatggtgtgttttctacaaatagaaaaggtaatgtcagtaaaaaaaagaagtgttagcgtatatataagaagggctgaaagaacacttaacagcaaactcgatgaagtatttctcttgtctctcttgaggtacacatgtccagctgtagaagggaccatcaaatttgtttgtaaacactctagtgatattcctaacaagtcgtgagtttgtgtcccgagtaaacctccatacacaagaaaaacaagcagttgttatatggtagaaaatatctaaatatcagtataagctggaatttgattgactgtttaacacattgcaataaactcatttcggcttcatttgtcaatgtataagctggaaatggagcttttcccttactatcaatatgtatgtcaggccgagaacagaatcgttctatatccattcttgacattatgttgtcctttgatttatccttcacgctcataagagtattcattatgttatccaaaaaattcttctctgtatgcatcacattgatacaatgtcggagatttagatctttccaatatggaagctcccataatatgctttccttgtgccagttatgttccttcccatagcctggcatcttcttttcgtgaccgttgccaccaacatctttggttcttggtggatttacaccagacaactgctcgtaataaatttgctcaccggttaaagactcaggtggatactcggtagaagcgtcttttccttttcggaagtcgtttttgttcttccgtaatggatgaccatgagaaagaaatcttcggtgacaatcaaaccagcacgtcttccttccattaggtagataaaaaaaagttagtactttccatgcaaattggacaagacagtttaccgtgggttgtcgatcctgataacatgttgtacgccagaaagtcgcttatcgtccacagcaacactgcttttagattaaaatttcgattcaaagacacatcatatgcatcgattccagtagaccataactcttttagctcctcaataagaggttggaggaagacatcaagactacctcgcgggtgatttggcccatgattcagaattgtaagaaacaagtactctgtattcatgcacatacccggtggtaaattatatggagtcacgatcacaagccacaaaaaatgatttcgcgacatgccaaatggattgaatccatcggtacataatccgagataaacattacggggttcttcggcaaacatgggatgtagctcttggaaatatctccactccgccgcatctgaaggatgattcatttcttcttcttttgattggtgctcggcatgccaacgcattacagctgctgtcttgtggctcaaatacattctcttcaatcggtcaccaataggtagataccacatacgactatatggcactttggttcttcgacggtagtcatccataggcttccatctttgagcactacaaaaccgacatttatcttccttttcgtcttctttccagaaaagcatacaattgttaatacaaacatcgaaattgtataataaggaaggcctaaattgcgcatcaatttttctgtcatgtaatgcgaatcagtagcttggtttccttctggtaaaaaatctgtcaacatttgacataccgaatccacacatctttcactcatattatgatccgccttgttctgcatgactcgagctgctaacgataattgagactggccttcacgacaaccatcgtacaatggattttgagcaccttctaacaagtcgtagaattttttagaatggttacgtaccggttcctccacattctgattagtaccgtcttgatgatagttatcatcaaaccccacgttataacgaaatgcatcgttcaccatatccacatattgatcttctacaacattacccacatccacatatggatcttctacaacattatccacactttcataattctctcttagatacgtactattaacataattactcgttcctacattcatgttgaaatcttccccatgcttataccaaacataataatcaagcataaatccttgactaaacaaatgactactaacttttctacccgagacaatatgttttttattcttgcacacagcacaaggatagtggaatttacctcgacaactttgtactataggctggctattagcaaatgtcaagaactcctccactcctgcaacgtattctgctgtcaaattccccgtcatttcatcgaacatcttgtacacccactctcgattaaaaccaccgctattcggataattataatttcccgccattataagaccaataataaaactaaatatattttttatcgttttttttcatcaaaaacgttttttttcttaaaggtattatttgtattgtgtttgtgttgtgaatgaattttgtgtacgtgaaattttcattatataggcaattttagagtgactaaaacacgacaaaatagtgtagtcgttttaaaccggtacaacaacttacaaaacaaaatacatgtgctttttcaatcgataattacgtctattttgcgactatatttaatgacaacccgaaatagtcatgcaatagttgctgttgaacgactattacggcgggtcgtatattagtcgctaaacggcgactaatttacgactaattttggcgacaaccaaaatcggtcatataatagtcaccctttagcgactaataaggcgtctcgcctgtatagtggttatttggcgactaactaacgactatagtactgttagttgtataatagtcgtaaaattgtagccaaatagtcactaaatatagcgactatttatgtagtcgccggttgtagtgggtagttagctgttttcttgtacgctcatcaccgtttgttgcattctctttcagcagacgttcaatcttccacacatgcccaaaatatagattacatgtagagtaacttgtacctgacataagtgtggtaatcttgtagaatgacctcaaaatgtcacatatttttgttcctctctcccattcttcattcaatggacaagtcttgtagcatttatcaacaactcgtaatcggttaaaaacacgtttatagtttaaagctttctcgagcataagaaacattgaattccatctagtttgaacatccagcgacaaaactaccccctgatcaccttctacgcattgctggaatgcaagccctctcgcttttgaagctttcacgcacttgacactatctctgatcttggttaaagcaccactaataatctttagtccatcttgcacaataagatttaggatgtgtgcacaacattgaacatgaaagagttcacctccacataacaagttgtcatctaaattaagccgctcttttagtatctcttgcatggtgtcattcgctaaagcgttatctagagtaagagtaaatatattctcttcaattccccattcttttagacattcatggattttagtcgccaaagcatcactggtgtgtggaggaggtatgtcacaaaatgacaagatcttgctattcaaagtccagctttcgtcgacgtagtgggcagtcagagttatataaccttcaccagcaattgctgtccaacaatcgaaagctaagcatatcctactctgaatctttgccaaatccatcttcagcttgttcttctcgctatcccaagttttaacaacatctgttgcttctgtgtttctagtgtagtagctataatctggattcagatattgaaaaaaccttcgcagctcttcatattcaacaacagaaaaaggaagatcatgccaaattataaccctactaaacttctctcaaacaacactctaatcaatcttcattcttcctagtctttccatctccatcaattatcatatcagcgacatgcctatattttgacttcttaatgcatctttgatgatgacgcttcataggagatgttcatgtggtaggttcatacacaagtttttcaccacaatagttacatttaactcgattcttgccatcgtcaccttttccagcttgagtaaaatgtttccacatttctgaagttttcttccttcgtttacgagaattttcttgagagttaccttctggtatctctgatgattgctcatgggttgaatcaatatcatcatcgtcatccatcatcatctcttcttcagcagctatttttgactcccagtccagatcttccatattatctatccataaatttaatataaattatagtcaaaaaacaatatatgtatagatcatcgttttagttctaaaataaataaataatatcaaacaacaccaaactgtagacgatatttagtataatctcaaacataactacaagaacgaacacatgaagccaatctattttgtttttactaacataatatttacttatttagcaaaacaaatcatatgatcatcataacatgcatgggcacaaatatcaatatgactataacgtaattacatagtacatactcctagacgaagatgctgtcatgctttcgaattcgataagacacgaacggagacaaaataaaaaccaaggcgatgagacacgagaactcaagaagtaatttaagaagcaaccatagaacgatgacgtctatttataataacaatacatgaagagaaaaagaaaaccctagtcttgggtttatatattttacataattagctgcaaggaaaaataaatattatgcatatattttaccttttacttttatatttaggtaaaatataaactttaatagttattttagatatttttacatatgtagttgtaaagaaaagaaaatattttacatatgtatatataaattttacataatatattaatataaatatatataaattttacttttttgttttgattgtgaaacccatgggtaacccatgatcctaatgggttttacccattaaacccatgactctaatagggtaacccactaaaacccatttatatatatggataaaaaaaatcatacccaaacccattaaaatcatgggcgggttcggataacgtatgggtattgacccattatgacacccctatcggagagcaacgacatcagatcttcgagttgtgttcaagaaataagtttgatccttcaccaagttgctttgtgatggtaagaatctctcttactctgtattaattgatgattattgattgttttgaaattagggtttttttctttcagtaataattaggataatttgatgatggattttgattaattgtatactgtatcttaatctgataattactagagtattcgtaatggaaattattttattgtggatgattgtttgaattactactcaaatggatcttcaatatattaattagttcgattagtttttggggttaaacgcatgaatgttacctatgaaatattgtgtcttaactgtgatattgtgttgtatcttaattgttaaatattttggtttttaccgattaaatttatcaaactttttttgttttcttttgaggtatctatggaggaaacattgatttggacattgatatggactctacagctgcaacatctcagatggtgagtaaggtaatgcattacattgacattagttgacttttgtatttaaattaggtaaaacttgacttgtattgattgtagtgtgtctgttttgtgataaatgtttgtgtgtgtattcaattgatagcttattgtctatttagaggttgattataataggtaagacttgacttacattgacatcattcttaatgtcaatgagttcaatgcttatatgtttttcattaggtaaaaaaataagttttaacattgaatgcttaaacctacaactagaacttaactcaactaaccacaactacaacttaaaatagtcaaagacttaaacctaaccttctatatatcccaagtaaaatcgctgcttaagccacacctttctcctctttattttctcacatcctcctttaaaagtcattgaaactctttcatcctcctttaaaagtcattgaaactctttcatcctccttaatgaatccttatgctaacacgtccggcttcttggatctggtaacaagtcaacaagaaacctccatcaatgttgctgatacaagactttgtgaatctgacgcccctgtcttcggtacatgatgatgtgaagcagcattgcatggtgaaaccacaaacacaaatcgcacaccaagaacaaggaccaagtagtcatctaaagacgatgttctactaatctttgtgtggctaaataaaaagcaaggatgttgttattggtaatgagcaacgagcaaatgtattcaggaaacacattgcgtagtacattgcagcaagtccctttgttggtactctcaacaatagaccagcaagtcattgtaagtaaaggtggtccaagatcaacaaatttacatgttgtgggatcccatgcaggtgaaacatctcggatggcgagtggaatgaatgagaatgatttgatgaggttagctcatgaaatttacgagagtgattacaatggagcattgttggagggagttaaggcatgatcagaagtaatgcgcctctcttccaaccaaagagacattacttagcaaaagaagaaaggttaatggtgctcctcgtgtagctgttccaaggattacacatgtagttgaagcttcctaagctcgtccaccgggtgtgaaggctgctaagggtaaagacaaaggagcatggctggagtttcagcaaatgtggaagaagaaggaaagaggctagaaaggatggagagtatgtgggaaattaaagcaacaagatttagcttttaaagaaacgttgagcgacaagaaactgctagacagtttagttgcaagattctacacgcttactaaagtggaaacagaactaaagaataaactaatcaaaaacatgtattttacttgacaatcttctcaattctttgcgtttcagtctttgtctttgatgctttgtgttttatgtctttgtgtttcagttatgtctatgttgtttttattatgtctttgttacttttgtatgtctttgttgcttttgtgttttttgtaacattatagacgactttaagtccttgttcatgtatttctattttagtttaatctaagtatttgttcatggtaagtttatttcgtctttcagtcatgtttattatattcagccatgtttatttcatcaagttatttgaatgagaatgatttgagtttggcccgtgtaacatgtttatttcatcaagttgtttgaatgagaatgatttgagtttagtgcgtgttcatgtttatttgtatgctttatttcatcaagttgtttggatgagaatgatatgagacatgacaaatactctttatgctttgtttattcgtgtaggatgatagttgatcgactattgaaggatcacaagcaatcgactactaaaggatgacaagtaagaagactatttaaggatgacaagtaagaagactattgaaggatgacaagtatttgcatacacaccacacaaaaatttaaagttcacaagtggaagaacaatgacaaggaatctacatcttttatatgctttgtatacacaccacacacatatttttatgctttgtcgacacacatattttaatgcttttttttactatatattttaccatgcatgacactctttatctcattctctcttattccacatactctttatctcatatttcttcatccacaaactctttatctcatatttcttattccacaaactcaattctcgcttcttctacaaactctttctctcatatttcttattccacaaactctctctctctgaaacaaaagctgtatacttaatacaaaattccatcttttctatcttaatccaaaaatccatattttctacttaattctaaaactcatcttttatcctaaaaaaatggcatcatcctcgcgtgataatatcgacgtagcgtttgaagaagcatttgtaaatatttttgaacaagtatttgaaaataattttactcttacggggaacttcaaagagcaaccaaacctacggaaaaagagtttatattgaaagagatcgtgaacaaggacacattcagtgtgtaacgattatttcaaagaaaatccaactttccctcctaatctattctaacgtcgttgtagaataaataagtatgtgttcatgcgtattgttgatcgactctcgaatgaaatttaaatctttcaagaaagaagagatgctagcggaaggctcggtttctcttggctccaaaagtgtacagctccaattcgtatcctcgcatatagttgtttggctgatgcggttgacgaatacctccagatgggtcaaagcacttcgatgaagtgcatggaacattttggtgaagcaataatgtttttgtttgaagatgagtacctaagaaaacccagtgcacaagatcgtcatcgcctactaattcttagagagattcaaggattttccgggatgatgggaagcaccgattgtatgcattgggagtggaagaattgtcccacctcttagaaagggcaatatacacgtggctctggcaaaccaacgatcgtttaagaggttgtagcttcccaagatctttggatatgacacgctttttttttacctccaagcactttaaacaatatcaacgttcttgatcacaatccagtttttgacgatatcttacaaggatgagcttcagttatttagtcaacgagaccgagtatcatttgggttactatctcactgatggaatttatcctaaatcaactacatttatccaatctatttcacttccacaaagtctcaaggcatctttatttgcaaccaaataagaaacttaccgtaaagatgtggagcgagcttttggagttttgcaagctcgatttgcaattgtcaaaaatccagctcttatttgggataaggtaaaaatagaaaatattatgcgagcttgtataacacttcacaataggatagtagaagatgaacgagatggatatactcattttgatatatctaaatttgtataagtggaatatgctagaagttctcaagtgcatttcacctattctacatatatatcttaaaatctcgagaataagatcgccactcgaactcgaatatgtgatcaagctatgcatcaacaattgaaacatgatttggttgaacatgtatggacaaaatttggaaacaatcaatattaaaactatttaagttttatgtcatgtatttttaaattgtgtgtcatgtatgtttctaattttattatttgcaataattactatgttttcttaatttataaatgtttttgaaaataaaatcttaagaaccccaagtaagaacctaccattggacacataaaacttttacattcattacaccatctcttaagtctaactttttcagttttaatattaaatcaatgcttaagaaccaaaattaagaacctaccattggtcatgctcttaggatagtgagttggttggtttgatccgaacttaagggaagctatgtacctcctaattggtctgtgtgtcactgtgatttcgcataatgtcatgcatcagttacactttttgagaacccaaaacacttgagccaccaaataatagcctttttacctagcccataaaatgttcaatatcctctttgtaagagtacatgccactgctattgaatgttaaaatattaagttatctgattatgaaagttcttttagatctcgagacttaattttgtcgctacgcttatggcgaagtgatgcgtgttttattttgcctcatgcttttacctgaaagaccacacgactactacaagtgcacaatatttcaaagtagtaatttaggatcaaatccacaaggagagaagtagttcagagaaatcctttagaagagagtgaagttaggaccaaataaaaagagagggggttgttgtatgcattgaataagaaaaataaaagacaagtaactaaaataaactgtaagcaataagagagaagcgctaggtctttgggggtttctccggatgtcatggttcaacataaaggtatagatcccaattcaggtgataacatggttaggtttatttacttccaaattctcagacattcgaaactcattcaagacaagctatccctaacggctagtaggtgaaagccggcaattctaactatacctcgccactcagttgccctaacggctagtaggtgctaacatggtttcgagatacagatcaaagcattaagttcaagttcaattctagtccataagtccctatcactcggcgggtgagcaacagttatagttatttatttagttgagttagttcaagcaattatacaagattctaccaagtataaaatacctaagatcatgtactaggtggagttccaaacatacatgcattaagattaaactcaactagaaagaatagtgtaaacgatcaaacaaaaccatagaaaccgccaacctaaacttgatctaaagtccccatgaattcccctttgaaaccccctaaaacctaactagagatctactcgctcatggcaaaggagctaattaaaagttgggttgagtaaaccaaaacaaaaagacaaataaaacttaaaaagggtttagagattacttctttaaatgaagaacacaagaggcaaagctccaccttaaagagtcttatacaaaacaaaagagaaagagagatagatggtgatcttcgagctcaagagttgcggcggcgagtcggcagctctcggcgacggctagggtttgcttttgatgaaggcacacctagggttagggcttataacaagtatttgtacttgagggccaagaattaggtttagaggtaaaaacgtcaatccgccggataagtaagtgatagggccagtcgtgggcatcagggaaggagccaaatgacggtggcacaatgaggaattgacttgggcttgacctaatggtcggtggaaagcttctcggagctgcccgggttcaagtctccttggccggatgctttttggatttattatttccaaacgaccggttcttgacatgtcctcactctttgggtcatatcttgcaaacggcttcatggattgcttcgatttgacttcgacgttaatcttgactcttctagctttccatgcatacctacatatctcgtttccgtgatggggaagaactcggccgtatgctaaacttctgaagtactggaactgatcgctttttgatagttttaggttcaaaactcataaaaccttcttggcacctagaatacgtgtttctcctcttcttggatcaagaaaggcaccaaattctctttgaaacataacaaaacaatagctaaaacgggctaaaaagctgtgttatcacgaagtacagtctagtacggtttgatgaattttgtgatggtggtttgcaggcaattgataaaagcatgatcccaaagaaaatgtgagttcttttgttttcaaatctctcctccagatcaagatttttgttttccttaagaataatcaaagagctaagtagggaggagttgatatgttgcgtttttaatgtcttaggtctcttcgttttgagtcatttaacatgtcgtagtccgtgttttgcgtcttttgggttgtgccttctgtattttgcctgttttaggtaattgtgacgggactggatggttttgagctttttggagtagagaaagggcgagaaaatctgaagcagggagaagactgtgtagaccaatcggtccagtagagggtgatgatccattttggctttcaacagacggtcaaaaatggttgaccgatcgattaaaatctggaccgatcggtctgatttcctaacgcaggatttcggttttccttaactggatttattttcttttttctgtaattgggtattaaaactccaaacacctaattttgtttttaccgttctttttctacaactttttgagagcttttctttgtaagcaactttgggagaaggatccatcctctttgacactttggaaaagatttctaatctttttttcttttatatttcattaatctattatatcttttcaactctttgtgttgtttattttgcttagagtgagtaatcacttaattgggttttgggttctaagtaggggattcaatgaattgatcgtttgattattgtttggagttctttatctttaagttctttgattcacatgttcttaatgtttgaataggttgtatcaccctgttttagagtctaggtttttctatgcatcaaaagtgtttgatagaatgcctaaaccaatgtgaattgaacatttaatttctagccaacaaatgttgacgttagaatgcattctgaacctaatgaacctaatcctaatgtaaatttgactaggaaattacaaatgaaagtttagtagtgaagcagtccaatttagtgattaataacttgattgagaattaggctaaacttgtgttcatgttcgagaatggttctttatgttgaatttcctgtctaatatttccattaatcatggatctctgaaataccctatggccgattgctttttatcatataagtttaatcgtttattttcttgcattttaatttataactctgaatactaaacaaacaatctctttagctttagctaagaacgagtcttgaaaatccttagagtatcttttgtccttgtggatcgacctcgaatatactatctaggggttaagtgtattcagtaattactcaagcaatcagttttaaagatggtcactctcgtttatcagttccaaagcattcttgttcatggacctgaatatcttaggcgatcacttgatgtattcttacaatcattgattcatgagttacaaacattgtggtccgagggagtagttgcatatgatgttcctctaaggaacatttttgtgatgcctgctgttctgatgtagacgattaataattttccagcatatggaatgttatatgggtggacaacgcatggaagactatcatgtccctactatcaggatactattaatgcatttcagcttaagcatggaaaaaagtcttgttggtttgattgtcatcgacggtttgataataggtttttaagatcaattaaacctaaagcactatcatgtcgttgtagtactgaaggttgtcaatccaaatgggtgtgatgctaacaatcaagatgtgatcagaagtcactaagtcaagccaagcaataacaggttttggtgtgttctagcagttctaagtgaacatgcagaaaacaaaaattcaagtagaaacaataaaacactcgaccaacacagctctttgcagagcactggatgaggtcgagtgacaggtcgagtaacagacagaaagtgaaacagggatactcgactgcacagtctgttgccagacaactgggtggtcgagtatcaggtcgagtaacagtaaagaattgcagaaactaagcaacaaatgacaagatgcagtagagtaaacaataaaatcaatcagataaagaattcccgaggatagggtaatcgagtagtttcgttttctcagtttactggtgattgacatgctcaataaataaaccctaaacaacaagttcattaaccaaatctaagtgccaccgcaacagagactctcaagttaacctagtcccagactcaatcaccattgacgagagctaacctaacaggcattacgaatcaacaagttaaagccaaaacgctccctgcaaccaataccttggtacagggtcacgaatctctggaattagtggttcagacatttcatcgaacaccttttgggtgcggaaatgtctgggctcaaatttcagttgatcagaaagcaataggcattaagaacaactaatccagaagggatctatcaatcaatactcaatcacctagcatactgagaattctacactactctaacccatcctcagaaacctattcactactcagacatcataacagaaagcataaacgttgaacaagttgaaaacataataacaacagtgtaacagcaggatgataacagaataaacaacagtaaacgaaatctagaacaaaagttgaatactgaatagataaagagaaatccggattacaaaaggtctagaacacaaggtctgcggaaaaactagataaaaacttttttttttaaacttgttctcgaaaatgtaaagtacatgctacttatagcaaaatattccaaaaccctaatactcaaaacgacgcagtattgggacggattaagaactgtactcgagccaggtggtcgagtgagaggtcgagtgataagctggagtcttcttttcttccttgtgctcgagtgtctggttgagtgcggaatgaagaagactctgaagctggcagtcgagtatttagtcgagtgatagagatgatggtactcggctcggtggtagagtgatcgagtgaaggtgatgaatgtactcgaccgtgtggtagagtagttggtcgagtgattggtcgagtgaatgatgatggagttactcggcctgttggtagagtgattggtcgagtgaatgatgatggtgttactcggccatgttggtagagtgataggtcgagtgaaggtgatgaatgtactcggccttccttttcgggatttcttagactcgtcggtttgttctcttgatctctcatctacgcttcttcttttgtttctctatttgagtttcgactttttattcatgtttttttttattcgctttctaattcattttcttcatactaaaaataaggggttgggtatggatcagattattctcgtgtgtggcagatggatctttggaaaaaccaaatagccttttgacgttgataatattaaagattgtcgagttcttgaaggtaacagccaaaccatgatttcgttccaacgatgtatgaggattacgatttggataacaagctattcaaagtagttttgagttacaaaatctcaaaaaaaaaagaactaccagcagatacaccaccagttattattggtaataatagacaattttcagctttttttgggcatatgaagaatgaaaccactcgactttgtgctgaggtgaaggagaaatttatagttcaatccacaaaggaaggaattgatggtttcgttgagtgcagtttgacaagttctttacgaccaagtaatatattccataaggtagaatgagatatcgatttatccagtgaaaacatggaagaagctgaagttaataatatttatgtggatggtgaagatgatgaaagtagattcgattactgcgacgattctgacggaatcgatttcgaagatgagaaatttagcatgtacggaattccacctgaagaagaagaaaaacctcagttactactccaaaatttaggtatattcatcgaagaagaaaaagaagaagctacttatgctactttagatgtgtcttcattggagctggcggttggacaatgttttaaaacagaggagcacttggagaaacgtttgaagatacttaccgtattacagaaatttcattttgatgctgagaaatcgactccaataaaggatgtaagtggagggttcgagcaacactagtaggcgactctacaaagcttcatgtgagagtatttaagtcggaatttacatattctgttacaaagcgttcatcgcgtgcccgacaagcagcacataaaatacttagactgttgtacaaggattacgttggtggaattagaccaaaggttgtgccaatgcatgttgctaaagcgttgaataaactctttcaaatcaaggtatgatttactatttcttttttatttgttttctatttttaaatcgttttttatagtattgctaatactcactgtaaaataatattgtgtaaatggattattggaaggtatatcggacactaaggtatgcacgacaattggttaggggtagtctataaagtggatatgagcagcttccttgtacatgctaaggagagaaaatcttgaaattttacttgacctgaagttgatgaagaaaaacggtttaaatacttgttctagcttttggtgcaagtattttaggatttccttacatgaggaaagtggtactttttgatggtatatttttgcaaggaaaatacttatggacacttcttaacgcaacaactcaagaatgtaatttttagatataccagataacttttgccgtggtagatactgcaaatgatcaatcttggaatggttttttaaataactcagctgtgtgctactagatcatgaaagccttgccataatttctgatatgcatcaatccattggaaaagcaatcaagacggtttatcctaattctagccagggaatatgcacataccatttatacaaaaatatattagtccgttttaaaagtcgggatgcgtttgggttggtaaagaagggagcgaatgcttttagattagtcgactttgaaatcatttttgcttagatgcaagctttaaagcgtgcttacctttaaagagcggatgtacgactatggatacgtttacatttctatggggataggtacaatttgcttacaagtaaaattgttgaatcaatgaataaggtcatgttccccgctagaagttaccctattgtacaactgttagaaaaaattatgttcatgatgactagatggttttcagaccgaaggaatgatgctttgaattagtttacctctcttacacgtgaaatagagaagattttgcaggtaagaatttctaatctagtactatttgaacagcacatctatgtaaatattgttcactaataacaatcctgggaattgttttgtagagttgtgtagagtatgccaagttactaagggtgcaagatatagatgcacatcaggtacaagtgacgtttggagcatctctccattttgataatttgaaggatagaaaatgttcgtctcgtagatttgatctagaaaagataccatgtgttcacgcgattgcagcggctgaaataataaaattctctcggatatcaatgtgtcatccttactatcacaagaattatttatgctcatcatatgctaacgccatcatgcccagggattttgttataccagtcccgaacaagttgtgacaaccaaatgtttaccaccagaagctcgacaataacctggaagaccaaagtgatcaagagtcaatctgcattggagattgctatggataagaagaagccaagaaaacgacatgcttgtggaaatttgaattaagtaggccacaatcgtaagacatgcactgatcaaacttgaaagaatggttaatttgcttatgtttactactatttggtttcaatatttttttagactttttctttttactgtaaactatatttcagtcatgaataaagatcattacaaagaaggttcttaagccaaagtggctcgtttctagggtctgcttggaataccgaagtcgtataagcaggaaaaactaaatggtgagctatactattacaaagacgttttgtgaacgtaaatacaatagatgaaaatcttgaagacccatattctatatctagaagtaaattttcagtttcactcctatttgacctgccatttaggtgttaatgaggacatgcaatcttcttcaaagtgtattttcttgtatccatgtgtccaagcttattgcatcgctacaagtaatgctttcgtcttagcctctaggggagtgttacatgatctaatattgaagatccccaagctttttctttcccttcaggatctcgtattatccacccaccggtactttgagtagtatttttatgtaatcccgcgttgaaattgcatttgacaaaagaaactgttggtttcgtccatgaagctttttgtgataatggaggtcttgttgtagcagtatttcctcgcctctcacacatgtttatgatccattcattaacatccacttctgattgtgaaacgaccttcgaagaacattttctgaatttattgaacacataattatttcttgctttccagattcggaagataagccaaaatgggagtaatttttgttgttctgttagattattgttagaaatagaatcaataagaacagagatgttctcttcaacatcgtttgagaaagtatgtcctgataaatatgaaagttttgctagtttccatgttgtagttgcatatggataattaaatagaacatgacatattgattcctcttcaagtgaacaacgagaacagattggatctatattcattccttttttgactaatctggcacatgtgggtaaagcttctggtatagttctccaaagcatgtatttatttttggaatgataggaagtttccacatcttgtttttcaactctacctatccggaaggtgctgatggcttgatttgaaaatcagttggatcatgagtgagtaaccaataccttaaattaaccgtataatcccctcatgttgtataatttcacgatagtctatcatggattttcttgtgtgagagatgaatactctttatatgaatgtgatcatcatgatttattaaacgggatattagggtttcattccaaaagcggtatattccgttaatagaaatgaacttctctactttgttgttttgtgcaggggtaaggagactgatcggtctaggtggatgggttgctataacattattatgtatctgcttccttttttttatcacattcaaacccgcgagtagtaaagaccaaccataagattgtctctttcgagctttggcatataagatagtttcctcactaaagtatctcgccttcataacccgagcaaataatgaatttcgatgttggatgattttccatacctgtttcgcaagcagcgcatcataaaactttcctagatcccttaaacctagcccaccttctttttttgaatattgtagtcttttccaagcaatccatgggatacctcggtgttttgcattcttctcccactagaagttcatgagtagtgattcaatttctgaaatgattcccattggtaatttgaagcatgacatggcgtacaccggcattgccattgccactgatttcaacatgattctttttcagccggttataggtgttttacactccaacttgatgttcttttcttaactctttcaataatgtaattaaacatttctgttttctttggaccaaattgctctggtaatccaaggtactttccaccaccgccttgactttgaatccctaacaacctcttaagacgattttgaatgattccattaactttcgagccaaaagtaatgagagattttgccatatttattttttgactagaatagtattcagaaatgtcaaaagcgactttcagggcttgacagttgcgaacgttagcttgacagaaaaatagagaatcatctgcaaactgtagatgagtaacacattggactccatttccaattcgaattcctcggatatctccttcagaaactctcatcttaacaagatagcttaaaatatcggcacattaaaagagatatgaagatagaggatctccttgtcttatttcacattgtggtttgattgtaccatgaggtatgccatttattaaaaccgggtaactaactgatctcacagtgcccattatccagtgaatccatttcttactaaagccaaatagtttcattattgtctccaaacaagttccactctactttatcgtatgccttgctcacttccgtcttcacagccatagaggattgagatacttttttcctcgacttcaaagaatgcatcatttcgtgtgcgatcatgacattatcattgaccagtcttcgtgaaatgaacgctgcttgagaatcggagactattgcatcaaggtgatttttgagtctctccaactagacattttgagattatcttttataggatgttacataaagctatgggccgataatcagatagtgttataggattattgatttttggtatcatacatatattagtgtggttcattgactgtttcatgtatgaagttctaacgtaattttttacctcctacatcacgtcttgtccaactatgtcccaacaaaatttatagaatctagtagttaacccatctggtccaggtgatttatcatctccaatttggtttattgcctcaaagatttcgttgtcgctgaattcctttgtgaggtcatcgttcatttgtttggtgactgtagcttttaagcccgcaaagtctattgtagaaaattgtcgactattactctcataaacttttgtgaagaagctttgggaatgttttcctattactttatctcctctataactcaaaccggtatcatcttttattgagattatgcgattcaccaaaaatcttgtttcagtgcaaggatggaagtatcatgtattttggtccccttctttcatccaattgcttcggcttttttgttgccaatatatctcttcatcattgtatgcccttgttgactttgtttggatttttggaatgagtcctcttactgatcagttcatgcttgacatagcattgttcagttgagctcgtagatgatcgattcgcattcgtgagttcatgttaaacttatgttttagagttcccattgcttgtctacaagtcctcacttgatatattatttgtgttttctgtctggtgctctgttttgtccatccaacttggacgtgttgtttgaagtgaggcacatcaactaatctcttatcaaaacgaaatggtctctgcttcgaagtttcagttttttctagagttaacaaaagtggtttgtgatctaaactagtaaggtcaaggaattccaattctgcaaaatggaaggaggctgctccttcagaattaataagggctcggtctaaacagcattttactttgtgtttatgccgttttccaaccgaagaaaacctaagccttttgatcagacgtccagaaggtcacaagtagccatcatgtttcgaaaactcttgaaagtgcattcttctcttcgtggtcatcctatttttttcagaatttgacaatatcttattgaagtccccaatcaatatccaagagtcattgcgtgtaagtgacaagttttcaaagtgtttccaaagatgatggccctaaatgttttgtagcttttaattgatttttagattttggtttttggtttttcatttttgtagtttgtgatttttgttgtagattttaatatttgcaaaatcttgaatggaaatttgtttagtttttagtttttctacataatatttatttttcaacgtttttaagttctctattttaatatttagttttctattttctatttaaaaattactaaaacaatgataataaatattttcttaataataaaaattaaaaagatgcagaaaaatattaaacataggtatattgcatataaacatagattttataaattaaaccaatttttacatagaaataaaattaaatttttaaattaataccaaaacaatgatgtagaaaagaaaacacaaagcataattaaaataataaaaaaaaattaagaaatatatcacgtaatacttctaaaaaactcacaaaacttggtttttggattgtatgaagaaataggtaaaatctcctaaaatctagttttcctatcttttaggaaatctacttttttcttaatcatgaatgggtaattattagttattgcaaaattaaaatccaaaaacttttctaaaaactgcagtcattcaaggtcgatgtctttcacgttgataaggatgaccatacacacaagacaaatagaaattgatattattgatagagatatgtacattgatatggcgttcatcttggtagactttagataaatgcacattatccttccacaacaaggctaagccaccactatgaccttgtaggggttgagttattacattgggaaatcctaatacatatttacataatcacacttatttagagtttcaataagaaaaacaacattaaacttaagtaatgtacatagtttactaagtcgagattgagtcagtggcgcaccatggccttgatagttccaggagccaatcctcatgggggatgtgggggtaccgggccccctgcacctccgatcaatgtcattggggatgaaccagatgtagcaaacccaagcttcttgtctttcttgcgtatgtgtcttagtactgctgattcttctgttgcttccgcttgattgtaaagcctttcaaagctgagtctctttctcttaacaaatgcatactcgttcattacattgtctgaaaactcctctagcagccctgcttctctttgatccatcagagattcacatacatatttggcatgcaggtaccttagtctatgagtagttaaatctgtatcttcaaaagtacttgccatttcagatggaacaaagtctgagtcttattcctgtcttggtcctgtagtcgaatggttctgaagacctggtatcaatgtagccggatcaatgcttggtagcgagccatcaccagtcatatcttgttctccatgttcatgctcctggtggttatcatcactcccttcatcatcatgtgcaggattatcctcttcaaaggtcaaggcacattcatttgcatcgtgcttaagggaaccacacttggtacagaagtttctcaatctctcaaatctgaatttgatgatagtattctcattcgcctgaaattgaatgtttctttggaaccggagtggatcatctaaatttcaagccaacttaaccctaatgaatcctagttgatttgtgttctcatcaaaatcaacatctacaacatatcctagtctgtttccaactgccctagccattgcattggttaagaaaagaagagggataccttggatttaaacccagaaaagaattatcttcatctcattctctgtgatattcaggtaccatcgattgattgacaacatccagtcattgaatgaccacgtcgcaggaccaagttcattgattcatctgtttggaacttgaattgcacctttccattgccaacgattcgcccaacgcaagaatccgccagtccctaaactctaggcatttgactgattaacgctcgtaggttttttttcggggattcactggtgtgacgattagtgagaagcggttaacagcgaacgcctgtgagacgaattcctgtgacaggaaatttggagcatcgtcgattcccaaattcagatcttggacaaactttcttagaaaatcactcataattgattgttggtttttgtcgagttggtaaaacagtggtgagagaaaaaggaatagatgattgaaagggttaaatagaatgatccatgacggttttggttgacgattacctcccgtaaagaggggagaagaataactaccattgtcatttggcagacaaaaaccggcgttgaagactctagaaggaattctgcgaacatctcaggtcggaaaaaaatctccagtggagaacaagcaaatggcgtcgatcgcccaaaaaattgcctttcgagagagacgacatcatcaatttttagacttaaacctcttctattgtcttgttttgcatgtttaagctattagacttgatatcttttgtgtcttgcaacgtttttttgattcagtcacttatgttttctactattttgtttcaatatttttttgtcttaaacctcttttatgtcttgccacgtttttttgattcagtcacatatgatgtagaagtctgagacaaatgaaaaaataattaaggttctgcaatggtttttaagccagtcactcaatagtaagaaattcatttctacttgcctataacgtagaagtatgagagaaatgaaaagatatacgtcgaagtctgagacaaaataacatgaaattttgaaacacataccatgaatgtctgaaacaaaacccaaaacaaccacataacaaaataaaaacacaaacatagcttctacgaatcattaaggcgaggaatctcgaattctttctgacgagtctcacagttaagtgttccgacaaactctcctaattcatcaaacatctctacaccaagattgatccataaggcctgcatgtttctatcacacaatccgtcgaatgactttccaagtgccaaacattcaatgtattttatcgcatatattgcacaatcacctcgatcgtcattcactgggttcttctttgtaaccctcttcacctccaacattgcgtagctcttcttatggtccttttctagaatatattcagacaacatagttgggattatcttccttaaaaacatgcactgttgaaccatttctaattcctcaacaggtgtgggaatgctgtcgtaaacgtagatcctgtttgtcttcaagttaaaatccaaagccacccaatgattttcattgacaaagagacaaccgtaaaggtgatctacattagtgaaccacttattgtttgtcgctgcgtctgtatgacttgtaccgttgaggtgattcacataatagccggtccagttgtaggttttaaaatcagacgaatagtgtttgttgtagtcattcttcatctttcttatcaaaacttgatcaaggaaagcaatgcggtgatttggtatttataaggatcacgaatgaactttctaggaaacatagtcattgtagttcccatgtggtgcaacataatcaatacaacaattaaaaccaaattttaaaccaattccacaagctgaaaattgtaaattacaaaagggaatacttacatagtctttcacccaaccatgtgttccatctggtcttttctaggagttataatttgccaaaacaatcgaacatcaaaattatttgtttgaaatggttcttctctgggaaaaaaaatgataaaagagaaccgaaatcatggattttagaactagaaaacagaaacttactcatcaagcctagccaatccatgagactatgaagtttctcatctgaaactggttgaagatgctcgggtatggaaggggatggtgctccatccgtgataatgcgcttcactgtggatttccctacataaggaggttttatataatcggctagttgagtcactcgtctctctagtagtaccatcattcaaatttttaatttggtcttcaattgacgacaacacgatagccattgcttcactagcccgctgtacatgaggattagagaatgtatcttcaaaactgcaagccattttcaaagtatctgctacaactttttcagttacatcaccaacatagtcgtcatctctcctcattgtcttctttaaaacttttggagttgataccttcatttcctttaccttggccatcttcttcttaggtatcttagatgcttttttaggcatgattgcaactttcttcttcttaccctttgttgcatctttcttttcacaaagaacaagcagctcagatatttctcattcatgctttttcttgttcttcactaagtagataactttcttcactactctctaacaaggcaaaccatcttgagattatggcttctcctctaccatacaagacttcgataatcaataatttaatatttcatcaacatcaaaattcatgataaatatgaaaaacaatttttaattgtagttcaagttctttattgggtgtctcatcttctttatcgttgttgaatgtggcatcatctcctttgttgttggatgtgacatcattaatggatacatcagcgggatgagactctttcaaagctttcaaatcattctccacagctgcaagtctcttactaagctactcatctaaaacaatcactttctgattaacaagaggaatttactctccaaaccatcaattcttctgttcagatttttgtccatctccgtaattgtccttgtcattttttccagcatcttccaaatatccaacaagcttgtcttctcctatttatcaacctataattagtgaaataattgtgtaactaaattattgtcaaaatgtagacaattataaaagctaattttgtaaaatgggaagaaaaaaaaacaggacctccatatgtgctttttctgttagctgtttttttgttagaaacctctgctctttcatcatcaataggcgttgactcattaccattcttttcctttgaaatgacactactcgaacatcctcatttttttattttttcgtttcctcttaagcactgatttcacatgtttccacgcattgtttcttaaacggttgtgtatgatatctctaatcaagttgtcaagcgtcatatcttgattctcaggcaagtcactccatttagggtacatgttttccaaagaatcaggaagcatatgcctgacctgcacctactaacaacacaaaattaaaagattatgttagttacatgtctcagaatttattaaatatatgaaagaacctaactaaagaactagagaagatcacacaaacctcttcatgggcaaccttctcagtttcaatgaatttcttaaatttgatacgtgcgcgacttgatctccaatcaagtagtgcaacaccattagttgttgctcttctaaatccataaatttctctcaatccaggcatactctcgtaaatccaaatccacaaggcatagacacatccatgaatcccatatgagttttttttgtagtcaataatcttcacggaactaactagagactcaattgcaaatcgaccccaaggatatttctcaaaagactctggatcaagaactaattagcgcttggcaaagggattctagaaccgtgaagaatctcatgaactccaacagataacaagcataacctaccaaccatcaacctcttctcataactccattccttgctaatatccattacgcactccaacttagtaaacaagggaccctcggacgttccaacatccatttcattccaaaactcatggtgtccagcttcacaagtggctgacttgtcaataagatcacagttgaaacccattatatccgcaaatttagtaagagaaaatctgattggccttccatcaatcacagatcaaagctcctgaaagttgttgacactcagctggtttgtaaagaagtagtgaacagttttgccagcccatatatattccgcatgagcaaactttataaagacaccaagtgatgatttcaacaaacctttccacacatcactacctaatcttgatctaatcttaaagatatttgaaacaaagcagcaatggtttatgctcctgttttgtagtggtgatttaccttctagataaagacgaggccggtaactatataaggttttgactagacgacacaataccttatcatagagaaaaacaatgttcaaagagattgtcataaagatttttgaacaaatctgtcactaaagacacatgataaattgagtaaatttgtcacaacatgaccctaattcaactacaaactatttccaaaggcgggaatatatttctaattttttttccagcgaatttggcataagttagctaccaaaacaatagattactaagaattaaaatctgaaaaggaatccaaacaatacactcggatatcaattgattactaaaaattgaaatccaaataataaacaatacactcgataggaataatgattcaccaataaagagtttttaggttttcttaaaaatttacctctaagtatgccgactagtttcgagagcagcgatgatgaaacaagaacacggtgaaggaatagttatgaaacaaaaaggggaaaattaatattgaaatcataatcaacaatacacgattgatagtaggatttttgtcaattaatcctaaaacactatcttgtcgttgtagtattttaggatgtcaatccaatccggtgtgatgcaaacagatgagatatgatcagaaagctctaagtcaagccaagcagaaagttggttggtcctaacagtcctagtatgcaataacagaaatgaaatgaaactaaaagcaggaatggcaatagcaggcaagtgaatgacaaagcagaaatgataacaggcaatcaaatggataaacgattcctaaggatggggtaatcgaatagtgtggtctacttaatctattcaggcggttgacaaaacttcacagaagctatccctagacaacaagttcaacaacagattaattcactcccgtgatagaaatcctcaagcaaagctagacactgacctaaatccctttagtgatctctaactaagcaggcattatggaatcaacatgttaaagtcaataccctctctacagccaatcccttggggtagagtcaggtatctctggaattaataggatccaacgcccattaaacgccttctgaacgctggacgtctggactcatactccacattagccagtgaaataagcaataagcgcaactaatctagaagggattctagaattctaaactcaaccacctaaaacgaccaagtaaaccacaactattctatcccatcctcagaaatacagttcactactcagacataatcaaagacaataacaaagcaacaattgaaaacatgataacagaattgacgaaagacttaaacgaaaactgaatatcaaatacttgaaagcgaaactacaaagtcgcaggagaaacactgcggctatcaaagttgcgaaaatgtaaaagcgagataaaaacggataatagcggatgccttagggaaaaccctaagaggtagtttatataagccaaaaaatgaaacaaataaggaaactaaatatatagcgaatcttcacgtcatgatcctgcgaccgaatgtgtcattggcatcagacgggctgaaatgagcttcccagtgatcgagtatgtcattgatcaaactgggcttcaggggctccgtcttgcgatcgagtgaaatgcagtgaaatcgagattgaatggtccagcgaccttgtgatcgagtgcgatcgagtggatgtcatgagggtgtgatcgagtggttctgatggggtgattcctccggcttcgcgattgagtgaaattgagctgtttgcttctccggggttgcgatagagtgatttgccctggcagagctccgaggctgcgatagagtacttttgctgaaggcgtcattgggcattttgacttcatgttctgtttttcctctgtttgaactccaaaagcatccaaagtacctgaaaacaaccaaatatgccatgcacatgcaatcctaatgcaaaatcgtcctaagtatgtaaaacacactaaaacgactcctaatgagatgaaatgtggatgaaagaatgacaaagtggtgaagaatgaatgcctaaatcatgcaaattatagacatatcaacgattaactcaaaagggatgggaaacacacctaaggatgataattttgctaatggatgaagaaatcaaattccaatgaaagggcaaagcaatgacaccgaagaagaagagcagtcaccaccggagaactgaaatctacaaagctgaaccgccaaatttagaaatcgacaaatccaaatgatatctccgccgttgttctaaccggagaaactgtattcaagaacaaccgatttttgattgaaaatagaagaagaagaagagacatgcaaagagggaaataagagaagaaataaattactcaccaacggcaaagagaaatcgccaaatcctgatgatattgacgccgttgttgttgtcggagaagatgatttccatatcggggttttgggttttggttttgcataatatcgatgaagaagaagaaagggaaaaaaatggaagatgacggcaaaaaaaagacctagtttatttagtttctttgtaacttcttcatttatcatttttatttttacttaattcattattcttatttttttaaagggaattatgggtttaactttgattatggttaattagtctttttacttaagattagagtcattctagttatttttgttaaaagtagagtcaatatgagcaaatttcagtatatatattatgaaagcatatttacatgtttactaataaatatatataattaatacagagataaatacttttttcatagacctttgctcaagatccttcgcagccaatgatataactcttcaggataagaacattcctttgatcttatgcaatttagaaaaaatattttcaccattttttttttgatgttatggaacatcttccgattcatcttcctcgagaagtagtgttaggtggacatgttcagtataggtggatgtatccatttgaaaggttaatgtttcatctaaaacagaaagtgaaaaatctgaggaaggtcgagggttctatcgtggcgcaaaatataaatgaagagactacatatttttcttcgtactacttcgcacctaatgtttaaacaaaaggtagaaaaccatgtcgctatgacgattgcgggaagaaaccttcttaccactctgatatcccaaaaatatttgcagaatttgggcggctcagatagaccatcaaccatggagttgttgtgcgtacgatggatgcaaaaaattacggtgtgattaaagactttttagaggtttagtatcatggactcataaaatgtgtgtttttcaagtgtcagtggtacaatcctactagggaacgtggtgtttgacttacaaaatttggcgttacggagattaattcggctaaaaagctaaataagtatgatccatttgttcttgcatcccaagtcaatcaagtgtgctacattccatatcctagagttaaacgcatctatgatccgaggatcacagctacacaaattaatccaagaggaatagtagatggagtgaaggaacacaatccgatgcaacaaagctatgtagactttattagtgtggttgaacattctcttgaaaacactatattggtggatgttgaaaatcaccaactaaatgatgtaagtgtaggtgtcattcaattcggtcaagggactcatcagattttgatgatcatgagtaaaaatattgttttttatttacttcagttatttttttgtgatggtgttatgtttggcttagctctctatttttgtatagagatgcttacaattgtactctttatttctgaactatatttttaactttatcattgtgagttgtttcaaagacaagcttggattttaagcgttgtgagaccatcattattgatagtttcttaggttagttcttagataaagtaagtcttaaatttaatgttataagtcaattaattgttaagaatggctcttatataagagccaaatctaatgtttcttaggttaattcttagataaattaggtattaaatataatgttttaattcaattaatcttaattcttagataaattaggtattaaatctaatgttttaattcaattaatcttaattcttagataaatttgagttgtaataattattaagttttttaaaattataatgtttctaattttttttcaaattttgttttttaaaaactccaagttaagagtccaccattacatattgccaaaatttcaatctctaaactaaattcttaacttcaaaattttcaaaatcaattataaaaatattcataagaactatgtgaagattatgctaagaaactaccattaatgatgctctgagatctttgttccttctacgatttgcatttttttgttgggttttaatgttttttttgtgggatccgggaaataagaaagtgagagagatggtgaagaaagctgagacggtgttacatgaactatcatagttgagactaaaattatgcccacaaattttaaaggaacatcagttttggagcatatatttctagcttgtgagggagcttgtgagggagcttgcagcaaagtaagtactttttatgccaaaattttgtttgagtatttggtatttggaaagtattttggcagatatgaggtgctagcaatccaacaggctaaaatcaggagcgtgtatatgaagttgaaatgtcataaacaaagcaaaggttgagtacatgatctgcaactccatgaagcttgtgtggcgatgaattgataaattctgtaatattagaaacaactttttttacttaatacaactattatcaatgatgatgatagcactctaaacaccccaatgatttgtttttgcagctttgttcacaaactaaccaaaccaaaacgcagaaacaacggagtttaagcaggacttgattagtgatcattgtcaagtgtttaaaaggtggcaaaaccaagaaagttttgattcttcagatgtgtaaatgatcatgtgaatctagtacgtatatcagacatgaatacaatggtcttaaatgctttgtagacatgaatagtgcatacaaagcataatcctcgtagctcgaggtaccgtaatagactcctgccccacataaccgtcgatttcattgttaaatttgacatatttgccatcaattctttggctagcatacaaaacatccctcactagaacctcctttgtcacttcattctctcacttaaccaaaatcgcatactgtctaaacgcaatatccctcaaattctcaggatctttactaaccaacaaaactccattactccaatccttcttcttaactattccacggcttaaaagcccattaccattatcacttatccccaaatgagtggaagttgattcgtctttacccatatgatctcttccactcgtttgtatcccaaagctccaaactttacaaaaaaaaaaactgcatcagagtggaaactcacatgatatccaaaatttgttgagatatttccaagtaccattcacagcctagctccattgcatgaccaatgatccagaggaaaatcaaaccgtcagtctgtacttgagccttagcttttaaatgaaaacacaacccatcttctccccacttaacccaatttcattcataaacgaaagactaaccacgagattgaaccaatcctcaacatgacaattttctgtgagttagggtccgatctaatcttcttcccatttcccaaattctggaatttgattcgatactctatttttaatatttgtaggccgtatcttctctaataatatttgtttgcaatttcttaagaagcttcgttttttttcctttcatattttcgtaaatctcagaagtaaggaaaaattaaattcgtttcttacactcttcgatgttaccaaagctagttctgcttcgttgtggatagggcacaacaataattgcctaaaatttcttcacgagtgactagggttcttggagtcaacgaaaaatgtattttcctttgaaatgtcttgttctctaaattgccacgtattattttatataaatatataaattactaatttttaaaaagaatttggaccggttgtccactgtattccattaatttaggttggttttaccacaactattaataccgagaacctcttatgttaaccctaatcttcatttagcaatatccacaagtttgttttaccgactcttcacgtctcaccaccgtaactcttcttttctataggtaattctattatttttatatcataaaactggctttgtggatgaaatggtttgttaatttcgtactttgcaacttagtttcgttatttatttcatgaactcatgtagatatgggggacttgggatgactatttggcttatagacgaatgatagacaaaaacatcttgtgatcgagttctcaacagatgagtgactccgatccatatgctagagaaccgtctgaagtaccagagatgcctacaaatggacaaggcttaacagatccagcagatttaatgactcttgaccaattgcttcgatcagcaagccatgcaagcctaaagaaacttatccgagaagaatgaatggtgatggatggtaaattccacttaaaattctctacctttattctttgagttttttttctcttaatatgagactgtacgtaataagattctagagatgataaggtccgtgaatgacttgtattcatggtcgattactttatacgtactagctagctaatatattacctatcagttactttagaaatatgctctaatgtattctaataactactcgtatatttactaacatacaaggtttgaatacacaaaggaaactactaaggcggtgaaaaaaaattgtggagaacaatttcaaagaagtggatcctaattggtcaacactctcaagcgacacccagttacgttggttcatagcttttgcggtatgttttttctatttgttttgtcaaagtttttatgattagtgttacttgatacacattattatttatttgattttcattccttttatttgatcttgtagcaaaagtataattagcgttacgagataacaacactcgttcgccatgagtttgagactttgtgtgcatctcgtttaatgggatatgtccatgaatggaaaaaggcatggaagcaatacaaggagaagcctcaatggatgctaaactctatttgaaaatgagaaaacatcaagagaagcaaaaccaactccaaaaataagaagaccgatcgtggtggcttaagatagctaagcacacatgtgggtcagtaccatatgtccggagaagaaaatagatggaaattttattatttgcatacgatcaattcagtttctttcaaattcaatcaaagttttctataatgacttgtttgtatttcaaaattgtttagcatgataaggtgacaagagagctcccaaatatggttacttttatgaaagcaactcataagagaaagtctaatggtgtatttgtgtgcaaaaaagctgagttgatcgcaaaaaaatgtcggaacatggagcaccaaattctcagtcaaagagataatgacgatgatgacactttggagactaaccatcttacacaaaaagaatttgatgccatttaccaaggggtaaaatgctgaaactttgttttaattatactttatatgattttttgtagaccatactgtatatgtgtttaatactttatattttatgtgaagtaacatgcaattttgaaattctaagaaattcaatggaagaaagccaagaaatttggttatggtccaattctggtagttgatcctactgttgatacatctccaaattatgaagaaatgtatcttgagactcaagaaaagctccagaaatcggaccaagtgattaagggaatgctgctgaagtttaaagatgttgatttttggaaactatgatgtagaacaagtttccaaacgaagttccaccttccattagagcaacatgaacaacaatgaaggtctttagattcaattattaattttgtttcatgaagattttaagcattttggattgtttatcaatattaagtttggatgtttaaatgtttttgagattttaaaatatttaattattatgatttttaatttaattatttatttataatttataatttatttttatttataatttataatttatttttatttataatttgttggtaatttttaaattataaaacattttgttggaaatttagtagaatatatcaacatatattcaactggtaatctatgattgggaaacattctaacataaataaccctataaagggtaaagatttacatggaatgctattaggattttttcaaactaagacttaatggagaatttcataaaaaggtattttggacaattggctgcaaactgggacgcggatcctggatcttttagtcggatctgtatccacccactgatgatatcacgcggatcctgttcaaattaaatttcgaattagtagtaaccaattagacttattgggcccacaaaatagaaagaccaatcctcttaaaggatcttaaagtcttcagcaacatttaacatattaaagaaatctgcagtaaactaaataaatgcaaatcttaccataacaaccaaagttttgaataataagcaaatctttgaatatctatgcggttacattaactaatttcagtaaatgtattaccataacaagcaaagttttaaattgaaatttgtcactacaaaaatcactgaagtcacgcaaatcacgaaaattaccttaccaaactaagcccaaatattctaaggattatgcaaaacttatcataatagtcccacgggacgggttgttacaagtatttaaggaagtttttcagaacctataagactaagcgttgcaatagacattttttctcagaggtaaaaaccattaacaaattttagtgatctttctctgtgtttagtataattaatctcttcttttttaaatcttataataggtataagctggtttgaaaacgggtaatcgaaaagtgattgaataattggaatcagtttaccagagaagaagtgaagtgttagattttcaattttcgtttttaaatcgacattcaattattctcatttactttttcaaaggatctcaaacaaaaaaataataacacatttactttgttttcccaaaagtaatttatgtttgctattttagatttagcaaacttacgtttatatgttttcattttcttaattagtaaccaagtttttttttgtgtgcaaaatacttgtattcaatcaatcaagaaagaaccaaatacaaagaaaactgagatcaaaagattcagagtttagaacataaacaagaaggacattccccaatgccacaaacagataaatagtagaaatcgacaaaggttccatgagagctttgagacaaatgcttgaaggtgatttgacacatgtgaggtcacggtttgacgaaggatcttccatgaacgaatcaatggatgacaagatagtcacagtcataagactatgtaacgttgataagtgaaccatggctagacttctcgtcttgagaaggactacacgaagtagtacagcagcgcgggttcgggcagctatggatttgtagcttgaaggagtttgctttacgacataaagcaggggtttgggatcacttctatgaagatagtaaatgtcttgagagcacatgatccggttcttggagatgatgatacttgggcaagagttgaagacattcaataatattgtcgtagcgtagagatttaaacaagggccttcatggccacacacaaatctccagcaaaaacggttcaaatgcaaggacctataagtcttcaaaattttggaaacaatattcaaagccataggtgcaactaaaatcagggttctcagaagattggagtaaacccgtagcaatgaaagtgatctacgtttcaaatggtgtccattgccattgagaacatatacttgatctaagcattgaccacagggagacaaaggcagtgtcgaaacagaactgaagttaattctttgaagaaattggcttgggccacaacaacgttaatgggccgactaaaaaattcaggcctgcccacagaaaacctaattttgttttcgttggtctaagcgtgtaggtcatgcggcggctcaccagagaagactgagatggttgttgtgaagatcgtgtctccgatggcagcaaaagcggcgaagccctgaagagaacattgtccaaagtggagaagggaggccagaagaagctcttaagagtttccgagagaaaaaccattgcccaaagaagaaaaatgtcgtgcgccgtcgacgtctccatcggccatgacgcaactgacggaccaagagggagacctcttgccatcaacgaaaaccagagagagaactctttagcgtgcaaatggaatttaggtcgagaacaaagttgaatgatgcttttagatctgttctaaattttgaaggtttctggaaaatcagacctgtaaatggatctgcgaccaaaagagcggcgagggagaaaaccgagcaccacatctgtcctttgttatgaaaatttgataagcctgtgagggtaggtgtgttcgagaaggttcgagaattttgaaaagttaagaaaaaattagggaaaactttcaacgagagataaaaaaagagacgagagcagaagcggaaagattttgagacgtttagatcccgacgccggcgagcatttgcattgccgacgtcagacagtttgtttggaagaggcttttcgattatcatgccagagagagttcacgacctcgtaatatgtacgattctcctaatagtaaccaagttcaagtataatcaaacaacaacagaagtgaaatgacaattgcaaaaacgtatcatagtaagttatataaacagacaattgcaaaaacgtatcatagtttatatcatcaactattctaactgacaataatgttttcaaaaagattttaacactaacctttaatatagtttggtccttctacatcgtgtctgcttcaatagaaaacattatctcatttattggaacaacataagaatctggaggaggttgtctcttccaattgaagattcgcctaaaaacaattaattttgttaatactcattcttcgaaagatttcgtaatagctattgttttctaataatcatatcagtttctatcctttgtttatcctccacatatttgaaaatatgaacaaaaaattgtaaatagaagtgaatggaatataaattagctttgttaaaactggtaaataaaatttggaacaatgtacttgatctaacaagttaagattacacccaatcaattttgtattcgttgataaattagtgaaaatcaaacgatgaatatgaaattgacaacaccagatgcttcttggtcaagaacacaattccagtttttatgatctgggatttcaatccacatataaaaattgtttaaaagtataaatctgagtcaataataagcttacctctttaaagatcaaaaatctcaaaacacagattataaacgcagacgacgaagcaactgtctaagatttcgcaatttagacttcgatcaaaggatttgcacccaaaaaaaaaacattagatcaaaggattttattagttttgtttggtaggtgttttttttttagtaagatacatccacaacttatgttctaaaatgaaacaactgtccaaaccaaaaaaaatatactaatgggacagattataacattttaataaaaaagaaatattaatggtgtaaggagaaagttgtcttgggttattactacaatctttatcggcccacaacaaattaactcgacaacactaatggcctatatatactaacttttttttgttttgtaaaatcaggttttaaattaccaaatattaaattataaaaaaatttaagttactaaattttataatctctgaatttttaacattttaattataacttttacacacatgaaatatcctacaattcacattattgccaaactatacattgtattaaacacattaaattgtttattcttatgctaaattaatagaaacaaaacaatttatggtttaaattgttatcaatttatagtaatttatagtttaaattgttatcaatttaatataatttgaagtaagaaaataataatacaattataactattacacaccaatattatgcattaaaaagctcattcactaaaatcaccctacttatttatatacaacattaaatatctcacacttatctttctattgatactttataattactcaaaaaaaaaatatcagtataccacaacttatcaaattcacaaaatgtagttaagattctaattttttaaatattatgattatctatactattctctaattcactacaaatacagaaaccaatttggtagatactattactaataacatttgaggaagtatacaacagttcttttaaaataagaaaccctgcacgtatgtgcgggtcaagatctagtttatgataaaattctaacaattaaatcattagtaatttttcacaaatttacaaggaaaagtatcaataaattatcaacaattaaattatcattaaatttctatgaagtttcaacaaagaaagcgttggaaatgtctcacacaatttcaagaaaacatttcaacaaagtttcaacaaatatgttatcagtagtctcccataataaactttgagatttgttgaatatccgttgcaaattatcaatgacattccaaaaaattacatgttggaacaattcgttaaacacttcactgtaaattccaacaaatgtccaacaaataacttatcaaaaatatccaacgaattggccagattaattactcgatgaaaacgtttccaataaattcacgacaaatacaaacttctaacaatcatattctaacaaatatatattctattgaaaatttattggaaacatataattcctacaaattaccaactaatatggcggttggaattaacctttttcttatagtgaattattcaaaagaatgcctcatggtggtagaattgtagcggtaaaaaaatctaagcctatgtatcaaaattacaaaataagatcgaagagttcataaatgaagttttcatactctcgctgatcaaccaccgcaacatcatgaatatattaggatgttgtcttgaaatagaggtacctctacttgtttatgaattcatcccaaacgacaatctttctcaactttttcatgaagaggttgatcacacattgattacatgggagttacgtctacatattgtcatatatacagctggagctttgtcatacctccattttgttgcagcatctccgatttatcatagagatgtccaatcatcaaacatcttgtttgatgagtattaccgagctaatgttttggatttcggaacctcatggtcgatacacgttgatcaaactcacatgacaactgcggttataggtactgtaagatatgttgatctgactactttcaatcaaacatgtttacaaaaaagagtgacatgtagagcttcagagttgtgcttgttgagataatgaattgagaaatacctttttctttccaatggttgggaaaaaatagaacattggtcacttactttaatcttgccctaaaagagaatagacttttctacattttatttttaaataagaaatgactataacctaggacaagttatatagttataacaaatatttcaaacaggtatctctccagacatggagatttacaaaaactaaattgaagtacttagcactgatgatgatgattgatgactagtcactttccattgtaataatttgggtgaaacaaattgtcatagtttctactacacatactttgcttatattgttgttcaatgattatgatgaatattcttaattattgtttgagacttcattaatacataattttttttatcattttcagatttaggaaattgagatagcaaattcgaagagggttgttgctaaaatacgctggccttcaaatgacctgacctaaaagtttattttgttcctatagacgctaatggagttcgcgtctgagtagatatagtaaaggtaaatgatgcagcagtttggaggcattcttctaagtttaagtgtatggaagatgcgttcagtttcactatagcatggctaaaggccaaagtagtgctcgtctaagctgatgtaagatgcattttgtactttcttttgtgttgcatggttcaaacttttgttgagacttgatacttgaacgaatgaatcaatggttgttttaaaatacttattgtaatagtcagatgatatgtactgtattttatgtagatgtttctattaaattctttttatatattgaaatttttgcaaaagcatatctacgatcaatagaaacaaaaatcataaatatatagcataaaaataaattttacatagaacatggccaaatatcatagctacataatacaaaaattataatagaaatattgttatactggtagtatattattaatttattatcaattttttcatgagttttagattttttttaactagtccatttggattagatgaaagatgtaaaagaagtaatgtattaatatatatatatatatatatatatatatatatatgtttagctattgcagtttaaaataaatatcttattttaactctatcagactatgtctgatttcagaactcatacatcgactagcgaccagcgacatcatacattgttcgtttgtctgtcgctgtattcagcgacctattacagcgacaatcgctaaaaactgtcgatgtgttgttcgtttgactgtcgctataaatagtcgctatatttttaaaatatttaattatttttcgtgctaatgtatattttaaaatcaaaatgtaaattatatatatcatacaccatgcgaaaaaataaattaatatatttatttattttagtattatcaaatttaatttacgttatttgaatttatttttttttttaataagaattattttaacttaattagaactcaaaccccacgtgatatcgcaaagaaatatattataaatttgtttatataataatttctttacaacaaatctaactcaaaatgatgcatattataaatttttgtagttatttaagagtatatatataactaaccggaaaaaaataaccgtaaatattttgacagaaaattacaatataggaaagttgcaataaatgacacaagcgagaaaaacaaccgtcaatatttttttacggaaaattgcgattaaaagacacaacctttcaaagtacaaaaggcatttatttaagtttaatttaatttaattctgtttaatttaattatttttaatttatattttttgatcgataagttgttcgtttgcatgtcgctggattcagcgaccaaaagcagcgactaatcgctaaaaattttaacgacaaaaaattacggtcgctggtccctggcgactgtcgctacttttgatcgctgaaccagcgacaagcaaacgaacaacttttgatcgctgtcgctggtttcagtcgccagcgacaggcaaaagaacaggaccttaaacatcagtgaccttctttaagtatacggaaggtataaaatttaagtataaaattcgttacttacattaaaatggttcgttacttacattaaaatggtcaaaactcatcctctttacaatgtaagaactaacacatcgaatgaacaaacaataccgaaaaaagtttatgggcccatctaggatcattagttgggcctatattgtacctaaactttaactattcaaattagattaaacaaatcaaaaacaaattcagaaattaaataaaaattttgattattgttctaaggagaggaaaaaaaggctcattgtttcttcatacgtttcgttcccaaaaaattgacacagaagagagaaaaccaaattaacaaaaaacaatttctcgcctctactcgcaaaaaccctaatttcatcatcttcctatctgattccaattatttcttctacaagtttccttcttcttataatccatcgtttcttccttctatcgcgtttcacaaagcttgtcgtttttctctccttgtgggttggttaggccaatttgtttcgattgagcgattgaatctacgagacgcaacaatctctttctgggttagggtttcttcacataaccttttgtggtttcttgttttgggcggagtttggtggtttctggaaccctagatagagaggagccttagggtggttaatattggcactggtgatttagatatagagaaagagatttgagagatatatgtgtaggtgttagggttttcattacttgtgaattgtggctgtggcattgaatagaggtgtttggggttttgtccctttggtaaaggatgagtgttctctagtgtgaagctaaattggtcttctaagccatctgtgtgagggatggaagtgtagaaggtgctgaaacaactcatttggattagggattggaattggattcgtcttgtggcctttaccgtggtagggatttagatggtagagaaagctagggtagattaaattttttgtaagaggagctttctctgttgttgttggtggggggtgaagaaggttagagagagtgtgtgttctttcttgtatctgatgaggtacagctttcctaatggacaaaggtgaacactctttagctccggaatggttgagaagttcagggcatgcttctggtggtgggagttcaaaccacctccttgtatcatcctcttctcattcaggtatgttcgagtcatcatggatcatttcattgatctgatctttgcctctttagtcagaatagcgtgattttaactgtttgctatcttgttttttttttttttgttttgtatagattctgcatctttacaatataatagcaggaataggaactctaggagcaaaagtgacgttgattcaattcattctccttttctggatcgatcttcttctactaattcaaggaggggctctagtaatggttctgcaaaacatgcatatagtagtttcaactttaataggagtcaaagggataaggaccgcagcagagacaaggatagggtaagctatgtggatccatgggaccttgacacttctatccctcttagaactatcttgactggtagggatccggatccattgagacgatcacattcaatggttacaaggaaacagggagaacacctgtctcgaggattaacagtgggcttgaataatggtggcagtagtaatagttacaacggaaatggactactttctggacctagcattgggaatagctttcagagaactgggtttgataaggattttccttctcttggagctgaagagaagcaaaatgggcaagatgttgtacgagtctcatctcctggtataagttcagttgttcagaacttgccagttggtaactcagctttgattggtggggaaggttggacgtctgctctggcagaggttcccaatgtcatcgagaaggcttgtactgggtcattaacgtctccaaaagctaatgctgttagcgcgggaactttaactggcccaagtggtcttaacatggctgaagcattggtgcaggctccagcaagaactcacacccctccccaagtatgattcgcatcatcttggtgtaactttgttgtacatttacctctctgctcgtctaagattatgaccatttttttttagggatctgtgaagacacaacggctcgaggatttggcaatcaagcagtcaaggcaattgataccggttgtgccttcagcaccaaagggcttggtaagtatttaccttggtcaatgttattattcctcattcatttgtgctacaatcaatatctgttctatttcatttgtcagagtctgaattcttctgataaatccaagacaaagcaagtggttcgaactggtgaaacttgccttgctccctcaagaaatgccctacaacagcccgctgtcctacttgggagtttccagtctaatcctagtggtcaaatcaaacctgagaagaagctgttggttctcaaaccggctagggaaaatggtgtcagtgctgttaaagaatctggaagcccaagtgctaatacaaacactcgagctgcctctagccagctgatgtccaatactcaatcaacccaatctgctcctgtgagaagtacaaacagcccaaaggagctcaagggagccagtgccttctccatgatatctggccaaacaatcgaaaagaaaccttccgctgctcaagctcagagcaggagtgcattttacagtgctctgaagcagaaacaaactgcatcaacaagcatcaccaccgatcctgttagctcttcaaccagtgcctcttcttctgttgaggtaaaactcaacagctcaaaggatcttatagctagtgacccttcaagttcacaggcaacaagtggcgtcgaagtgactgacagtgtccaggtagcttctcatactagtggctttgaagcaactgacactccagatgaggaagaggcacagttccttagatcactcggctgggttgaaaacaatggtgaagaatatctcacagaggaggagatagattcctttttggaacaggtaaatagacataacagccccagtctctctctctctctctctcatattataactcagaaatattaataatggttatgttctttgttttgtttgatcagtacaaggagctgaggccgttatttccggagagactatccatgatacatgaagcaagagaggatgtagcttaagactcctgaacccaactttacaaaactgaagaaagtactggtttttggaaagatagtttctaatttcttttttaatatatttttcttcttttggtctttttgttcctgagaaaagcttagctactactttggcaatgggagaggagaaaggcagggaggggtttttgtttgtttgttttgatgatttgcaaatagtgcaaataaagctgatgaggctttgagttgccatatgagtgtcctgccctcttcagactttgtagatctttctttggtctgaaaaaaaaatggctcagctctcacacacgtgttcctctttttgtctttttctcttgtctctaatgtttgatgagcaagagttcgctcttaggagaatatataattgcgaaagagtttcttcatcaacacaaaacattggataaacccaatagaggtgccaaacaggccaatccgcaataggcatttatatttgtaagactgcgacaggctggtctgctaagactgccggcagaaataatgtgtccaagtctacccactaagcccaacgtgttagcatgccggcctgcgaacttatctcattgagcatgtacctcgtcttgctgatcacatgattttgagttttcttttctaggtaatttaaaaggtttgcctatttgcgttctctttggacaactgattgatttggagtattttcaataacattcacacaaagttttaacagaaacacacactgatgcaacagaggaatctcgcacacaatgccaaggtgacaagacaagacacaggaatttacatagtagagaaacgagaggaacttgtaagttgtcacagtatgaatctgagtcggagatgaagtatgtgcctgtgcgctactctgagtgcgatgtccaatacattagcccactgtcaaaaaaattgtggtcagtgaccagacaccagagatatatacaaatagattagtataagatgatatgcagtatacgaaaacaaaaaggttaggatgcttcactgattgcaattcaaatcacatttgctaggtttggaagttactgttaccagtacaaaatctattgtgattatgaaagatgattctaacgaaaagttttagtccagatgcgaaaagaagacagccacattagttaagaatggaagtgttagaatccaaaggactatgactaaaattgtaagaatcactaaatctatttgtacaagtttgggtaattttgtaggagtatttgtgttcaatttcccaatctaaaaagcagtgtttagtgtttcaagaaatgcacaaccagaagagtgcatagaatagctttaccttatcaatacaaatacacattgaaagacaccagccacaccagtccaagttgaaggcccagtcttcacaaccgaatcttgaatcagcaagccaacagaagcagctaaggaaacaaatgctacgacatacgctatgaaaagccacagcttcaatctgtagccaagaatccaaatacataaaaacacaaatcagaaacagttgaaactaaccgcaaatgtcagcgaaaacttgatttcagataatgagggttataaacacacaagatttctcaagtatcttctagtttacacagaaatacagattagaaacacttagtaaccaagctcttaaatcttatccttgattaaataactgtatcagcaagccaacataaacagctagggaaacaaacgctacgacatacgctatgaaaaagccatagcttcaatctgtagccaagaatccaaatacataaatacacaaatcagaaacagtttaaactaaccgcaaatctcagcgaaaacttgatttcacataaatgaaacacacaagatctctcaagtatcttctagtttacacaaaaaatacagattagaaacacgaagtaaccaagctcttaactcttatcttgatcaaaaacagaatcagaagcagagcgaatgaaacaaattcaacgacatacgctataaataagcttcaatccaaatccataaaacacaaatcatgaatacttcaacacttatagaagcaatgatcactcaaatacttcaaactaaatggatcagtcacaaaaatcagctaaaatttgtacacttatctcaactaccttctactttccacagaattacagatttaaacaagaagtaaccaagctcttatgttgactcagatcaatttgaaaaactaacctccactcgccttcgtcgtaaggagagtaatcaatgtcttcttttctgacgcaattgaacatcaaagctccgagagaagcgaatatgcctgcgaaatccccaaatccaacggaccaaaatcgctcaaaattcggaaaccctaattgataaattatcgagagttagatatatttaccgggaaggtaatggacgaagggaacttggatggaactgcaaacgacggcgtcgacccaaaaccaccacccggttccgaaaacggcgccggagaatccgggtccgaaaatcgcccacagttctgccaaatccatcgctcgatatgattcgtctccaattggatagatagataaataaaaactttattgttgatattgttaaattattatagtttttataccgaaaaaatgtcattaaaattattatgccaaaagtgtcgaaacaaagcatcaactttacctgtaatgataaaatcatcaaagtaaattattaatttttttcgattttgccaaataaaagatattagataatcaactaacagatcaatttaacgtataaagtcaacaataacattttctgtcaaatagtaaaacaacatcgtttttgtattaaaataaataatacaaaaaacatatagctaccagaatcggaccctgcatctgtggctatgtaactttatttgcgtgatttgaaaaaacactttgcaaacgatgttgttttactatttgttctggtagctaatctcagaatcgattcaccagaacacatagctaatctatcatattctccatatcacgcaaataaagatatataatattttataataatattaaaaggagaaaaaattgatgaaaattaatctagaaattgcaggtcttctgataacaagaaaactgtaaaacttattatctgaaagagtcaatacaatttgttcgatacagagagctctaaaacacaaatctagatcattactctcacaaacccagacacatacgtcacaggcagttacaaacaaaatgcataaatcttctaaagaaagctaagtctcaatatatacacttcacacgtgtgacttcttcttcagcgcacgtgctcctcagcaccatcttcattcgcacgtgcttcacgcctcttcctccttgtatacactattaagggcttatcaataccccctcccccccccccccttcaacatgcagcttgtcctgaagcgctaaacctggaaactgtttcttcaagtccttggctatctcccatgtatcctcatgaaccggaagaccttgccaatgtaccaacgcttctaagagtccatcctcattgtaacgagtctccagcacagcttcaggcacaaccacaaactcattatctgcagtcaacacttccggtaatggaatgacttgatggtggtcacccaaaacctgtttcaactgagacacatgaaaaacaaggtgtattttagaaccctctggaagtttcagcctataagcaactttcccaatgcgttccatgatctcaaacggaccaaaatacttcgctgccaacttctgacacactctctttgtcacagaattttgacgatatggtcttagcttcaagaacaccctattccgtgtatcaaactcaacttctcttctatgtttatcatcgttatttttcattaactgctgtgcattcaccaaatgctctttaatatcggccaacatcaaatccctctgcttgagtaacccttctaactcacaattcttagtagaattagcttcaaaacgcataattggtggaggatctctgccatacaagaccttaaaaggtgttgttttgatagttgtatgaaaagaagagttataccacaattcagccctaggtaagtattggaaccaagtcttaggatgagctgaagcaaagcatcgcaaataagtctccaatgtgcgattcaacacctctgtctggccatctgtttgcggatggaaagcagtgctgtatttcaacttagtgcctgatagtttgaagcagtctttccaaaaggaactcaaaaacgtgttatccctatcagaaactatcgatgcagggaacccgtgcagcttcactacctcgtgaataaaaattctagccacatcaactgcattgaaaggatgtttgagaccaatgaaatgaccatatttgcttaatctgtctaccaccaccaaaatgacatttttttccgtgagaaccaggcagcccttcaacaaagtccaaggaaatgtcttcccaaacctgcgttggaattggtaaaggttgtaacaacccagccggagataaggtggagtatttctgtcgttgacacatttcacacttagcaacaaatttctgaatatccttcatcataccttcccaatgaaatgattgttgaatacgtttcattgtcttcaacacacccgaatgaccacccaacaggccactatgatattcagcaagtatgagtggtaagaactttgagtctttaggaatgatcaatctctgtttcttccataatctgccttctttcacagtataggcactagtcccttgtttagctgatagacattctttaaccaagtgttgcagatgagcattagaatctatttcttcatagagatcatgcaactggagaactgtgggcactgtaaacgccattaacaacattgacgagaatgacccagttggttgtaccattctagataacccatcagccgccttgttatcaaccccaagtttgtatagaatgtcaaattcatagtgcaaaagcttagtgagccatttctgataatccattgacacctctctttgttcctgcaaaaactttaaactcttctgatccgtgtgtaacacaaatcggcgacccatcagatagtgtttccacttttgaattgataacacaatcgccattaactccctctcataaactggtttaagctgctctttagatgtgagaccatggctaaaacaagcaattggtctattgtcttgcattaaaactgcccccagaccattcctgatgcatcagcctctacaacgaacactttaccaaagtcgggtagtgctaaaactggtgcagtagacatagctctcttcaatgcatcaaaagcttcttgggctgactcactccacacaaagctgtctttctttaacaactcagttaaaggtctggctagagttccatacccttttaaaaaccttctgtaatagcctgttaatcccaaaaatcctcgtagttctttcacagactgaggcgtcacccacttagtcatagctactgtcttagtaggatctgttgaaacgccttgtgtgatatgatatggcctaaataatcgatcttggcttgaccaaatgaacacttctttctgttagcatagaactggtgctcctccaaaaccttcaacaccattgccaaatgttcctcatgttcttgctcattgcgactatagatgagtatatcatcaaaaaacaccaacacgaattttcggagaaatggtcgcaacatgtcattcattgatgactgaaatgtggcaggagcatttgacaatccaaatggcattactaaaaattcgaagtgtccatcatgtgtcctaaaagtcgtcttttcaatgtcttcaactttcattcgaatctgatggtagcctgctcttaaatccaatttagagaaaatgatggctccatgcaattcatccaaaagctgatctatcatgggaattggaaacttatttggtattgtggctctgtttaaagccctgtaatccacacaaaacctccaactctgatctttcttcttaaccaataacacgggactagaaaaaggacttttgcttgctcggataataccgttatcaagcatttctgaaactaaaccttccatagcttctttatgagcgtgtggatatctgtaaggcctcacacttatagctcgagtcccaggtaaaagggaaatagcatgctcattacctttgataggtggtaatccttttaggttctgagaacacattctcaaactgttgcaggattttttcagttccacttgtgaacattgaaggattttgtggtaacacctgatggctgttcaagctgacttccagctctttgttctgcagcctgaattttgtagagaaagacttaagagacattttaaaggtatccaactccggatcacctcttaaagtcactgtcctcccatgatacaaaaaggacaactcatgcctctcccaattgaccttacaatctcctaaggttctcagccatgcaattcccaatatcacatcaactggaccaagatccaaggtgataaaatgtgttgtcaactccaattcctgcccacaaccaactggtagagtcatcgtcactttatcacacaagcctaaaccttgaacagtgattcctgtacccaatcttatatgaaagttagggaaataaaattgtgtgtggcaccactgtccaacatgacaacaacctctcctttacaaatagatcctttcatcttaattgttgtataagatggcaaacccatgtatgatgaaaacgataattctgcaaattgagcaactgaatcatggaattcttcttccacgctattactctctaaaacttccatttcaaatccattaatcactgttagtacccgcagctccttattgggacacttgtgttctttggaccaaggtccatcacatctaaaacaaatccctttccttctcttctcatccaattctgcactggatgccgtctagtctctgatcatttcttccaattggtttgtcactaccatgatttgactcagtcattacagacttcatcttccagttgtttgtagctggtgtataagaactcttgtactcagaccaatgtggatctttattctctttacttaccaactgcaattccttttgcaccactcttctcatcacactcgtctccatagaacgtgccacagccaccatttcaggcagattctgtggtttatgcatgtgtaccagttcctgcatttcacctgtcaggccattcaagaatataccttccaatttctgatcatctaagcctccaacctgtgatgacagatcctcaaacctctgcacatattcagccactgaaccagtctgtttgatgcaaaacaaactctgactaggccctctcagcttcaaattcccgaaccttaacatcaatcctgatttcaacttcaaccaactcacaaaatccccacgactgatagcccaattgtaccaactcaaagcctcgccactgacgctaactgataccaaggctaattgttcagcctcattgtaacctcctgaacgaaaaaacctctcgactctcgcaatccacccatatatcccagatccatcaaacattggcatttctacattcttaagtagattctcgcgaattctaggtctaatcacaccacgacaaggttccagttgagaaacacgtacctggttcctatgatcttgcgatcttggaggaagagtttgacttgtaccacccacttcttgcaccgttgcaatacctggcatcgaattgagtaagagctccaacttcctctcaatcgctccgaattttagatcttgcgaacccattttgtcatccaacgacccaatcttggaatctagggttgataatcttgcatcagaacttctgattttacctcccaaatccccaatctgatcgtacacatccgccaacgaagccgcgtgctcctccgcctgagaaatttcacaaaccggagataaacttgattccatcaccattgcaactactatcgtcttcttcgatcgaacaaaaattcccaaacttcagcgttagattcaatccgagatcacgaacgcaccatttgataacaagaaaactgtaaatcttattatctgaaagagtcaatacaatttgtttgatacaaagagctctagaacacaaatctagatcattactctcacaaacccagacacatacgtcacaggcagttacaaacaaaatgcataaatcttctaaagaaagctaagtctcgatatatacacttcacacgtgtgacgtcttcttcagcgcacgtgctcctcagcaccatcttcattcgcacgtgcttcacgcctcttcctccttgtatacactattaagggcttgtcatcttctttgtcatcatatataaccttcgattagtgacgaagaagacctgcaatttctggcttaattctttcatcatttttttctggttttgatattagtagaaacgcttatatatttttgtttgcgtgatatggacagtaacatactttagttcggttggtttagagtttttagctctttcccacaggtgcatggttcgaatccgatagtaggatgatttttgtatttttgtttttaatacgaaaacgatgtcgtttactgtttgacggaagatgttgatgttgactttgtaccgttaaattgatctgttaattgactatacaatatattttatttggtaaagtcaacaaaaattagtgatttaattgaaaagtcaactaaaattgatgattttattcaccataagtaaagttgatgatttgtttcaccacttttggcgaaataatgattttaatgacgtttttcctgtttttatttatacaaaatacgaacgttattaatattaggaaatattaggcaagaaaacactttttaaaaacttaatttggtaatagagcattttaggaggagtatgtattttttaaagttttttttatcataaattcctcaaaagttagttaatcatagttagtttcatatggtttgggaataaaatattattttttgcagttttcctaaagtaaaacgacacgaccaattattcgtcactttgacctaaaagtgaaattatcctggcgactgtgttgaaataaacctccgtatccgttctcaatccgtaattcttctcccgtaaatcatattcgtcttcctagttatccaaaaagtgcccatctaaattccgatcatttccctccgtgaacttataacaaacgggcgacattaaaatccctcatttttacttttcccaccggtcagtaatcaatgacaggtaatcgttttctgttttttttgttctattaccaaaaacagttatcttcttgttttatccatttttgttctaaaatttccttacctattaagtaataatctcttcacaaattgtccctttgattgcaggcgcggtcgaagatgatataattgacaacgatactcgtctccctccaaggcttttcgcaacagaccgttaccctgatgctcgtctcaatatctactcgagacccgacattcttactgtaatatgtgacgttttgaaaggtaccaaggaagtggaaactatcttagactcttgttttggttctctgtttagtttaagggttagcgaatgttcaatctcttgcaaactagttcatgcgttgttatgtagacaattggttacaaaacagaaatacgaactgaagatgatttttggtggacagccattgagattctctttagttgagtttggttatctaactggtttgccgtgtggtgaatttccaaaggagtatgatccagacttcttccctaaacgtgtcattgggatgaaggattactaggatgcgttgatagggaaagataagaatgcaacattagcgtaagtttgaattgagagacaagacggttctttatttgattgaacagattagtaaatgtcataatttcaccaaaaaggagtatgatcttgacttcttccctaaacgtgtcaatgggatgaaggattactaggatgtgttgatagggaaagataagaatgcaacattaacttcttccctcaactaaagtgagtacttccacgcgaggcaggaagggtaagtttgaattgtttgatgatgatgaagcagaagataatgatgatgaagcagaagatataaaattgtgggtgaattcgctgttgtcttctgtaaaacatgaatttgcggagagtgttaagaagttaagatctcagaatctaaatcttctgaaaaagatcaaggccttgaaatctgtcaaattgcccaaatttcgttaccacaagatctccaggtccagacagtcaactagtcctccatttaagaaagtacgcctagcacttaaccaccacacatcgtctgaatctcctgtcaaccctgttgtatattctccaaacatcacaactcccccttcagaaccattaacttcattgcacgagggagacaatgttttatctgattcagtgcatgatggagactttgcagtttcaggagattctgataagattgttgatgatctgtcatggcgtgagttaaaaacacataaggtctgccgcacttgatctatgttaattttatagattggtagatattagtcaataatttattttaacttctctataccacacatgatgagatatccagggagaccaacaaggattcagttgattccccacaaaactatctggtaattgttaattaagttctttcacatattgtttccaaaacattgattatatattctcatattttacttttttcagaatgaaactccatcaatgtttatacccaagtttatatctgctaatagcacagaggtccctacctctcatcaacccatctatgacactgagtcgaaaactagagacgaggtagattttttgaatatctgttactagccaaaaatatttaactattatatacctaactacattttcaaattactatagcatatgccttctcctcaacctcctgctgtttacgataccgcaacaaaaccatcttctattgatgtatccgaggtttttctccctaaaggattttactattactttaagtttcttataatggatgttactcatacgctaatgttatacctcttctatcttaacaaggagattaagattcaagacttgtccttagcagaaaatgttgacacattggttcattcagtgtgcaagaatataagtgcttcaattgctgctctgagtgaagtaggaaaagagagtcttgctatgatagaatgagttccacccattgtcgcacaagtaaccttcaccataatccacgtggactagtttatattatatggattcccaattatggatatacttaacttcgtagatacttaactttatgcccacttttttttatgcgactactttttccttccacatgtaagatgatcaaaaaaaggatgataaaaaaaagaatgatcaaatgtcccaccatgcgagaagcccttaatattattgatgttcgctacgatcgtaattttttattttttttccaaagtatttagtatatattacaacccaactgcaacatccaaaacttggagaaaccaaggtggaaaggcaagagtaagttacagattacagcaatatgtacaacctaacaacaaagagtaaagaaacaacacttttcaatactaagatgaaacacgaaaatggtaactttgtaaaagcaaaagcataataaaactcaataagattagatattgaagcttcaagcttgcaattgatcatatcgcatccaacatttgcatgtattatgattgcatcttattcaccatcttttagtcgtcttagaagtaaaagtatccaaaacattcagtgagcataagcaaacagtgaagctctaccactgagttttaacgctctaatgctaaacttcattgtggcaccaaaaagaattccactcagccacaaagaagatctctaaaaggagcagttattcctaataaactaaaagcgttacttaccccaaaaagaaactatctcaagagcctaaggtaaattaaactttgagttcttgtttaaactgagagagatctatgggggttggcctaacaccggataaaacctaatcccctgatccttgcgatatggcctaatgtagcgctatgtaccagaatcaacttgcttatcctttttacgttttgagcattcaccaatcttaatttttgctttttctttgcccttaaagtcagaataagagctagaaaagtgatgctgagatatagctcttggattaacaagtctggaagcctgaattcccgcatcaaagtaagagtcatgagaaggtaaagatgccggaagaggaggctgtgatattggtgatgccggggatatgtctgaactgtttgagctagtcatatgagtttgatcagtgatagtattagaagcagcagcttcctcctaaacaggtacatcaagtacctctgcctcatcatcatgaatcacaggtgcatttaaaaaggacagttgttgacttgatgagtgataagacaacacttagtacatatccttcaaagcttctcatattcaaactcaatcttagaaccttctctagattcaaaacgaactctccgaaaaaaccgaagacggtctatgaatacaagtctgatcttaacacggataaaggcaacataagttgaagtatcttgattaaattccatctcaagaataggccccaacgttccagctatgaagctcacagttaattcagaaagataaggtagaggtatacctcggacttggacgcatagatcaataaaagtgagaaaatccggtcccaaaaaatctccacctttgtaaggcaacaaacgagtcattaaacatccatagagttctccttaaagcagttgccaagtcaatatatggatatataaattactactccctccgtttcaatatgggatgttttgaggcttagcacagtaattaacaaaactattatttaataaaaacaatcaagtaaagtaattaaagcaattaaaacaattaaagagtaataattaaactctcaaacaacccaaattacttgaaaaaatggagcaactttttacataattaaatttttttttgtgtgcaaccataacagaagtaattttaaacaaacaatttcaaaatttttacatcggagccaaactaaaactttcttgaatcatacatgtttatgtgagtttttaaaaaaaatgatttctaattttcttcacaattccaaattcttatttgagtatgtcacttctaagtgaagagaatgaattttttttgatttaaatgaaattccagaagaaactgtttatagtgatgatggagatgaatttttgtttgatttaaataaaatcccaccaagagaagaaactgttaacaggagcgatggagattttgcaggtatctatatatacatttttgaagccattttaacaaataaatcctggatttggacttatttacaactcaatgtcattagcattaaatctttctccaaaataattaattttactttaaattgttaaccacattatcaatcaaatttaatccaaacaaacttcaaatcaatcccttaaaattagcataaacatatttgtcaacaatattttaaaacaaaattttttgttaaaacaaatattattcttactaaacgttttttgtttaaataaataaatcatgtatttgaacttatttacaatgtcatgacactgacattaattatttaggaatgaaaatattaaatcttctaaatccttgcttttagaattattatgtcattacttaaaaggctcaaaatataaaaaaataaatattattatttatatatctagactttataaaacattattaatatttaaacttataaaaagtttaatatatcataattttttaacattattatataatatataaagtttaaaaaaatcttaattctttccgtcatattttgtgactcgaaattttaaaaataaacatatattaaccaattggcaaaaaatgtgtgagttatacgtcccacatgaactaaaatatttagacaatgattcataaacatattataaataagattcacattaataaaataatggtttatttacaggacgagtttggcgggacgggtttagcaggacgttacttaataacaaatataaagtataaaataaaaatattttatagatagatacaatttgcaaaattttatatatactaactttaaaatctagtctacatatacatttttgcagtcattttataaaataaatcccggagttgagacttatttacaatggctgccactggcttttaattcttgtttttttttggcaataaaattattaacaaacgaaaaacattccaaatatatttcaatctcatacgtcacgcagatttctccaaaatttgaactagatttcggcaactatttaaaacaaaatatatttgacaaacgaaaatacaattgcaattccttaaaataagcaaaacgcacctaaatacattctttatctatccaataaaacttatttctccaaaatttgaactagatttctgtaactatttaaaacaaatatttgtttgacaaaccaaaatacaattgcaatcccgtaaaatatttattttaattatatatttaaattagcgtgtgtaccgcgggtttttttaagggacgggtttggcgggacgggtttggcaggacgttatttaataataattgtaaactataaaataaaaatattttatagatagatataatttgcaaacttttatatatactaatttaatatataaattgtcttcgcggtgtaccgcgggttaaaatctagtctacatatacatttttgtagccgttttagcaaataattcctcaagttaaaacttatttacaagaaatgccattagcattaattattatcaattaattaatattcctaattattagtatttccttatctaatatatctcaatcaattctaattacttttaaaaaggagaaatcttaggactttattaatattatactttattaaagataaatattatagttatttaaaatttataaaatgtttagaatatttaacgaaaaaagtttagaatatatatgatatatgaaatctataaaattaaataaccatttcaaaagaaaaattttaaattgatttgaattagaaatcttttaataaaaatattattagaacaaaaaaaaagtttaattttaccgaactggattagatggtgggatagatttagaatattataatgtatggattttataataattaaataaccatttgaaagaaaaaatttaaattaatttgaactatacgtatatcttttcaattaaaatattattaaaacaaaaataacaaaaacaaaatgtttaatttcactgaacagggttagatggtatgacgggtgtgggtcgacagtaatacaagacgatataccacaagtgaaatccattagatatgcttagtttcaatgaacgggattagattgtaggacgggtttgggtcgataataatatgatggatcgacagttatacgagacggtataccacgggtgaaatctgttagatatgtttagtttcactgaacgggattagatggtaggacggatttgggtcgatagtaatacgagacggtataccaccggtgaaatcctaaatataacaatcaaaatacaattatattatcttaattaataaaataaatataatttaaatttaaattatttagttataatttagatattaacttaaaaaactgtacgttattgctcctatattttaaatagtaaaaatcaaacatagtaattgtatattaaataatatacaaatataaactttgtatattcagaaaatataaaacattaaatcatatgtatattttaattgattaaacaaattatttttttattcttaaaagaacaaattagtctcgcatgtatcgcgggttaaaatctagtttttttgtattaagctatgccttttctaggaaaataaatcatggacactttaaattttctttttgcataattaaaatgaagtttgttagtgattaatttttagttcctattttttctcaattagctcccaatcattaactagttcacgttcgtattcctttttggaagttgtaactacatctcgaaaaaaaaggaacattgatttaattattaaatgatatgcttttcgaaaactaacccctatacatttatcttttatttgacatgcatgtcaattgtaataattactttccatttaatattttcgatatgtcaatcaaagaagtcaaatcgatggttttaccgtgtttcttagcgcgaaaaccgatgtaatcaagccacaaaacgaaaaatggctccggaggtgaccaaaggtgcgatatagggtttcgtttgctagcttttgttccgttttttccgaatagattagggtttcatatcgatttagttttcgttttctaataagggtttattcgaatcgaatagggtttttgtatatttctgggtttgacttggtttatgcttgtttgattctgagtttctaaaggttggatatcgatataagggaacaagatttcactggcttgttcacttcttcttcgttgattcttaaactacctaatttcttagcttcttattttgtcaagcacatagaaaaagtaatctccttttcattctatccgtgagaaatcttgtttttatttccggaaaaattcgattttttctttgcttatttctggatttgaattgggtttatgcttgtttgatcttaagtttttgtatgtttggtatcgatatagggtttgaggatggatactgatccctaccaggaattgaggatggatactgatccctaccaggaattgaggatggatattgatccctaccaggaattgaggatggatactgatcatatgacatacgaggtatgtttgtcaatatcgcaagagaagacaaaaccttataagtttatcttatcatcttcattgagtgtgtttttttggctctgcacagcaacttctacagctgtgtaacagtatgggctatgagaactctagtgtaaaagcaagcaacatagaccgttgttttcgaaacaccaaaccctccgaatttcaatctcttgccgataaaatatgctgcatctgtcaggtaaaagtccagattgagtctttaagaaagattattacagaaatgagatgcgttcatatcctcagtgtcaattgattacaggataggtttcagaggagagctggggttggaaaattgaattgtgggcacaacttccatatcaacagcgtgaaaccatggatattgacgaagaaacagtgtccggtgtgtcagaaaacagcacacgatgatgaacatcaaactcaatcatatcaagtagagacaattgtactaagcgatgatgatgaagaggacatgaacagtcgcgatcaccaacagtatgatccagagcaactgttgttgttctatgaaatccctacaggaagaacacacagaccattctctctcacgagtatgaggaagtggtgggatcaggggtactttgatggctttccaaatttgaaatttctaccctctttaaatttttaataaccattttacccctatttggaaattgttttaacttaacaaaatgaaatattaatattttttgcctaaaatatttcaaaacaatttataatgatttttaaaagcatttttttggctgagaaaaaatttgttactaaaaaaacttttggcgggaaaaaagtttggcggaaattttttttggcgggaaattttcaatttccaattacatgtttctattagatgacggtaatttggtcattttgttcaagggaagatgtatttttaaaaatggacaacataaaagggtattgttgcaaaaaggtagtgaaaaagggtagttttgcaaatccatcccgccatataaatccgtcccgtgataactaaaaatcaaattattcttattctttttctttttaataatgtttttatttaagatacttcaagtcaatttacaatttcaatctaataagaaaattgtatactatttttatctattttttatatcgaattctttgaacaaaaaataacaaatttcttgttaaatattttgtatcttttaaattaataaatttcctatttgtatttattatcttcaatatatttgattttgatatattatatatatatatatatatatacacttattgtttatatttgttgttgagatctttttagtgtctatttttgtttaaagatatatatatatatatatatatatatttaatttttttttattttgttcagaaaaagagcaaatatgtatttcaaaaatgttaactagataaaataaaactgttaagtagataaataaattaaaattatttttgtaacatggtattataattttctcaattaaaatttttgcaagtattattagattgacaaatagtgtaaataagtgtaatgtatgtatgtgacacttagggttctaatgaggattaaaatattgcatgaccatcagggcgtagtaactataaatcttttatcctaaattaatttgtaagtgcactagcaatcatagtagtatttagggatataatttacaaggataaagaagatacacaaaagacttccgaaaaacaaaaataagttaggataaaaaggaattacatgaactcaaggaggttttgcaggaagaaaataaaaataatattctcttcttaaggtgtgttttggtccatttcatcaccgaacgagcctctaaataaatattctcaccgaacgggtctctaaataaatattttcttcttaagctgtattttggtccatttcatccttatattgctcactttagtctcatgggtccaaaatcctaaaaagtcgtatttatagtaagaatgatttgttcttgaataaaagattcaataaaacaaataaaatattcaggaactttatgaccacatcggtcaagaaggtcgtgtctaggctgcctgctacagtcacttagcctctcacccttgtaaacagtcataaatcttgccacaatactgaacttaattaaagagaattgacacttttacccttaaacctagttggagcctataaatagtgaaacataagatgaaaatcctatgatcttttagagcttgttttcattaccttcttcacacaacctccaaggttgaagttgttgtcccttgaagatctactcttgatcgtcattgttttctcttctctattcttcaaatatttcataaactacctttcgagagacgagttatcttctgtgacaaaccttgatccaaggggttcagaactctacccggaacaacctaatttttgacataatgttaccaatccttggtgttgatccctgtgatagttgagtaacatgacttagagcacttagcgaatctgatcctaaagtgtcgaactatgtgttgttgcctacgaaaggtgagtagtagagtatagggagattttctggtttgacctatacctaggctaatcgtttatttgccttttgtagttgtaaactagaacgaaacacatagaaaattaatagataataaccctactttgtcgagaaccatgataccctgaaaaactttcctttatttgctttcttatttcattgcattagtcattgggaaacacaaaatcaaaactcctaagattagttttgtcttatccatatcttcttctatgaattcaatatctctagctatcactctctgtcggatcaatctttaaatattactactaattcatgtgcatttccagttaacgtgtggtctctaaagtaaaaccttgagacaaaattaatcgcatatcagataacacacccatgtaagtagaagacgttttgttctcgtcaacaattaattaagcaaattgaagtgtccataacatagtgaatagcgaggagtttccagtcatatgatgggaagccctatataagttataacatctccatatatcttaccaaaaaccttcttttgattactacctccacatatcttttcagcaaccatcatgtgaatcaccttttattgcttaggtgagaactcgagaaatagaggcattagaagattttgtgtgtgctacgtaagcctaagctaatccaagacctatggtagatggacctcggtctccatgcaagctttgaaaccatattcgaacagaccgatcattctatttagtccaccattcaggatagccatgtaaatgcgagcaatacacattcttgtgaccaaatttgccacattgagaacagagaatctgatctctgttttacttgttccttgttaaaacatatattttggtcggataacaaaaccagtggaatcaccactcaaatcacgatgtgttgacattagatcaataacaagtaacaaaataaactaagtcttcatgctacgtactcgcatgactttgcatagaggattctttgttctttatgtttcaccttcgaatgggcttgtgcaaggtgtaatagaagttcccaactaaccaacaaccaatttactgaaatccatgattctatattagagctattaactaccagtttggacaaagtaccatcaactaaatccatcttcttattggctcgaagggtattaagcatcgtgtatgcctattcgttgtaattttctccattgagaagcattgatataattatcaaaccaagattttttagaaagaataaaaaaagaaaggcgtcgtggaatcaccactagctacaaccgctaatttacaagcatggagatttggagatttgtatgtgtaacattccggttttaggaatataataatgcatgtagatagatttgaaagaattgatttggccacctatatcatataagttcacttatcttttcgatcaaacatcctgagaaaactctacagttaactgtttcagagcaatattaatggggtcaattgataaactctttgaggaaatctgcttaaggttagcttcaaccctggggagctatctaccaaaagcaatatttcgatagaagaggggatcgaaatccttgaggaggaatgtaacgaggacaagactcctatcttggggactatgggaaggaacccttagcctcaaccaaaacggtggaaatgagtgaatttttctcttatctgctgctatctgaatcgactaagtgtccaggagaagaggaaattatttccaccatctcaactgaagcaaagaaatggactgaacgagcaagactgaccacggaaggaacgacgaccgaacaagggctagaacatggtggagcagcagaggaacttagacggacaaggaggaagagcaaaggaaaggagctttttcttcttcttagccattgtggctttttcgtttgtcattgtgaggccagccgacggcgacaaattagggtttggtgacttaatgccgaaaaagtcgcctttttattgtcgaaaagataaatatacccatttttagttactatcctagctggataaattgctggataacatttaaaaccgtaatagtccgttttgacatactcatgcacttataccacagctgttcacgtttagttcagccaaaccataggtagctacagtaaatgtgattttctttaattggatttagaatgtcttactaaaaattttataaaaaaatgcatgtgtcgggtcggtttaggttgagctgtgcaataatgcagaattctgaacattacgaagtaattcttgattgcttttattaactacggattacaaagtgtgatataatcaattcagactgtctcaaatccattttttattttttttcattcttcattttcctttgacacaaatatgatgattaaatctacctttaacaaaaaacaaacatcaaatttggtgaaaatcatgcaataacgtcttgaacaaatcatatatgaaaaaggacgataaaatatagggcttattgtcaaaacaggtcattttttattaaaatctttgattttgagatcttttgggttgggctttgaaaaagagtactttaggctagcgagaaagactattttacccctatcaactgtatcttcttctttgttctctttttccgaccaccaccacgtttcctccgccaaatttttcagatttgtttctgttatattcgccaccggattcttttgtttcgactacgttcacaaaaactaaaccctaaaggatagtgcacatagggaacccaaggagaaaatcaaacgaattgagagtattcatcttcttcctctctttttttctgtcaaattgtgaagtagataaaccaaacttgtctatctaatcgaaaaaatgatataatatatgctaatttacacaaacccaaacccaaaacaaatgcttgaaatccttttcgctaactttctaatggcttatcagtttccaattgagaagcttaaaatctcttcttctttttttctgcaattttgaaagttggtgtattaaccatgaattgagtttgaagagaggaaggagaaactgaatctgacgacagggaggtgccaacaataacagagcaaacatgaaatttgtattgaccatatgataagatgtttcaatgtcgaatgaatgagttgatgaagcaagggtacaagcgtcatttcatataagaaaaagtacctgaatttgtaagtcatcatgaaagtacctaatcttgtaagtttttaagttttttaggcattctagataaatatctctaaaatatatgattggtaatattgaaagacaaccaaaaattatgatttaacgaagaagaagagagaagaagaagagagaagagcataaagtatgaattttctatttgtacaaactatattaataactaaatttataacaacaaataagaagcctttttttgctaattaaagctttttttgctttgattgatccaaactcaaacagttgtaactttcagctgatgaactccattggtttgaatctgcaaactccgtagttgacaaccaccagatctcctcttccaaagattctccgccgctttatctccggcgccaccgtcgtgtgtctttttaaccaccggcaaaggtgggtccaattcagcaacgtcgataacatcaatctttttgttaccaaactcctcctttcttattcttccacgactagtcctggtagtggtggtagtgggagcggagaaagagagattcttgccggagaaaagacgtttaagcttgaagtaacggtgctgagcgacgggggtgatggaggtggaggtggtggtggtggtggggaagccggtgatcttgttgctacgtttgacttgaccaatgcagctgattttgggagataaaggatcggcttgttggtatgagtcatcttgatgtgatttagccgggagggtcacgttcttgatggaaggtcttgaacataacattggtaagaaagttggtctttggaactgaacactgttttgtctcgtctccatcatcttgatcttcttcttgattactcttaagacacaagagagatgaaacttcttgatttcacaaaaggacttagtttcttatttgtgtgagggagagaaagagaaataggagagtttgggtttgtggtagttggagagttagaaaactttgatggttacttaaaataaggagatatagagaggctttggtcaaagtggctttatcattagagcagacatgtcattatttttgggtttcacactcacaatcactttcagatttctttccagaatattggcttcttcccaatctggtaaattatatggcttctctatttttttttatataaaatattatctcttcaggaatatctgcttttttaataattgagatttcctattggcttgtaggtaggaaatgaaataattgagaatattgccatttttgaaagttataagaaaatattcacgtcaaacacatattcttactcaaatatcattctactcaaagttgcattaacaaatttcttatatgctgtgttaaaaggtttagtatattataaccgatctatttcatttagatattatagttgattaaaaagaatagtaattatattagttttgtatttattattataacatataagtacgcagtgtacaatttaccatgtaaccattgctgacaaaagtgtaccaccaaatgtaagcatcagcttcaaactttgcacgaggaaatgggacaatgcttaaatggaccgctaatttaacattacatcagccagttcacattgacactgttattaatcacaccaatacacttctacagtttttttcattataaaagattttaaattataaatctgaccaacgaagttattaaaatttggtgttagcatgtggacatagatatatattaagacatactattattattttcatacagttagatccgaaaaacacaacaaaaatcagtatcgtagaaaaaatctacgagccaactagtcctaagatcaaaataataaattctaattttgaaaattcaacaaataaaaacattttttgtggttttttatccataaaatatattatgccgatttgaaatcggattttgaagtatgcagtcaataataacagtaatttagaggaatacactactagtaagttttatttttactatggttttaaatggtaacttcaccgctatgcggtgacggatttacgttggaagaaagtatggcatgtgccccatacacatcctataatttttactttatcatctagttgtttaaaatatctattagctaatttggtggagttgcccatataatgtgaaggaagttgggttcgatccccaactgcggatcaaatatggtgcaaatacggtgcggttccaataataacaaaatattatatatatatatatatattttttttttttctgttactattagaaccgcaccgtacttgatacgaagttgatccgcacgtctctatttaaagcatatatttaactagacgacatgaatttttttcttaaacaaccttatgtaacatgagatgaccaaaaaaaaagaccacgctacatgtaagatttttttttcttataatgagaccagtcattactaaaaaggagcatgagcatgaagtacgaatgttcaaaaaaataaataatgaaggctagttgtgccctagttgtaattggttcttttgagtctcacttaaccactcgcgtgaatagaaacccatcatttattcattttgatgcctacatttattgagcctgcaaaaaacatattaaatggttatagtatcattaagatttagttaattttaattgtagaaagaaggcctaaccataatggctccaagacatgtagttctattctatcttttcccaagaaaggtacaaatttgatggtaaaaagttaatgaattatgtactaatgtctactgtctttgtccccttcttcctatacacttcagtctactttttcattttataatcactgttgcattattcggatctctccaaaataattatttctcatagccacttagtgacattttataataataaatatcatgtttaatggtgatctataaattattttctatataacaaatgacatattttgaaatttactataaaaaattacaactgagatggtagctttatctttagttcaatttagtgtttctcaagcttataaattcaacgcttattaaaagtcataaaactaacaatttcatggtttgttggatttatcatttcgtgaagagtaccttaacaacgaacatcactgttgagtgtggatagatttgtactttacaatttacagattttcatatgtaattgcgtaattttctcaaacttttacgtttttttttttcttccaaaatctaagattcagagttgtcagacctcatgtatacagatagtctcagccattttctagaaaagattttgactgaccataacaggaaaaacgacttagttaaatacaagctt

SEQ ID NO: 194 - DNA, 92584 bp, Arabidopsis thaliana
ctggcgaaagggggatgtgctgcaaggcgattaagttgggtaacgccagggttttcccagtcacgacgttgtaaaacgacggccagtgaattgtaatacgactcactatagggcgaattcgagctcggtacccggggatcctctagagtcgacctgcaggcatgcaagctttctcaacattttgatacttctagaagatttgggtatccatgagttcaaatttgatgcaaacatgataattaaagatcaaattcaggttcaaattgataggaaatggtatcagatcatgacaatgtggtcgagtagagcaatctaggcatggttccgttttactttaatttcattgactacgcaacagacaactagcaacgagggcactgcgtttatctagtaaaccaaaatgcttacaaggctatctcatcattatcccatatgcatatgcaacaatcctaaatgaaacactctagactggatcctaaatgtaatgcaactacatgaatactctgtttttgtgaaatcattttctgaaatttttcacatttttgttttttttgtttttctatgccttagatgaatgctgactcaagagtataaacaatgcaacacacacttcctgagccttcccccaaacttaaatcacatagtccactgtgtgactaaacttggaagagagtatacaagacaaatccaatcacataaacaaaataaagaacaaatcacaagagatgatatagtacaatagtgaagtgaggtgcttacctctgtcgaagaatgaacggagttggtcgtcaatggctgcctatgattgctcccaggccatagacgagccgccctgttctgtgtcagctccaccatgtgggtactcaacctcatcagctctgtggcggccagcaccgctttgaagatactcgacctctcttcttctactacaaccagcatcgcggtcacgtaaactacgagactgcaaaagtcgtctgctcctgctgctagatcgagtgagtgtggttctcctctttctcccagattcacgagactcaaatgatgaatgcctcgctaggacatgcggaatctctcgcagggataaactccctttaagactatgtatcttctgttggtcgagtaaaatgatgatttaaatttttttgggttttaaacatcactcatactcgaccgatatactcgagtgcaaggtctccaggtgcaacagaaagttttaaaattttttcactcctctgtactttgtactcgatctctatgccatctgtagagaaaaagttttaaattttcactctaccttcacgttattcctttattcgtgagaaccacaaacacaactaaaacaaatcaaaaataacaagaaaagaaaaacctattcacatagatagtcatgggacttcctcccaagtgagcttgtttaaagtctctagcttgactcctcacacttatcaagaagaaaatgaatgatagagagggtctgcatagttctctctaatatcattctcatactcagtgtcctccctggagaggtctacttcagaatactcaattcccctctcttcaaaataggcttctttctcttctggagggtaatctatctcttcaaaacatcttgaagtgaacttctttcttgagatagtgtcaatcccgcctttagattgagcttccttctgcatctgattcagcttactcctatgttcctcaacagtgtgggctagcctttctatagtttcttcttgtttatcagacctctttttaagctcttttacattttcagtctcatatccttctcctgggatcactctatcgtctccagagggtttttcatcttttgttgactcttgtggagttttgttgatgtcaaactgcaacttgatgtgctttccaaggttgagactttttttccctttcctgacatctatcactgctcccactgaggctaagaaaggtcttcccatgattaggggatccttatgctcttcttccatatccagcaccacgaagtctgtaggcacttccactccattaatcatgactggtagatctttcaccatgccaaagggttttcttgaagacctatccgcaaggatcagagttaggtcacaaggcgtatactgaacaaattccaaccttcttgccacagagagtggcattaagctgacagaggctctgagatcgcacaagcaatcgctgaaagctaattccccaatggaacatggtagagtaaaagatcctgaatctcctaacttttcttgaagaatcctcttatcagcagctcgagatggagtaacatcacattcatcatctgaatcgtgatacatcttgatcctttccagtatcagattttgttacatctttgtgaggatgaggaatcaagttgagaacttccatcaatggcatcactgcttcaatctcgtctgactgtttctctgcaactgacttgtatctctccatctaggctttcctgaatttccatggaagagcacgtgatggtaatggagtaagtttgaaacgttttaccatcctctcaattatggctgctttctctttttaggtggattaaatgagatgtggagaaccagaagaatggttgaattcaacaacagagacctcaatctgagtagaaggctccacttcttgaactgtccaagtgattaagtcaggaataggtcgagttggcagctctcgatcatggcagatagtgatgacgtgagcagttgtatactcctatggattatgtattgacttcccaggaagtcctgtaactttaggtgcagaggtagatgctaattctccttccaagtatctgactttggtattcaatgcctccactttgacattcaggtcattgtagctgaagtccagcttatggtgcaattcagataacttcttagcaatttccaaggagctagatgcttgtccctgtagcaggtgttgtaccatctgtttcatttcagcatcaagagcagcaggaccttggttttgctgaactgcaaacccaggtggtggttggggctggtagtttccctgaaattgctgcttgggaacaaaaccttggttgtagggaacaaaaggtttgttctgaccttgttgttggctgtggaggatacacttggtcttattagcaacgttggtgctgcggtaggagaggttagggttgttggtcttgaagttgttataccctttgtagtcaccctgattgttgttgatgtagctaacttcttctaactggttaccctctccatcttggacttgatactgctcgtcctcaacaagaaagtgcatatgcttctgctggctaagtagaattctgtctagcttgtcattcagcgctttgatctccttcctgtgtttgtcctcagagtcacctgtgcctggtcctgtcgcagtcctcgttgtaattaccatctgattgagctaggttctcaaccaattcccagccttcttcaacatctttgttctggaaattcccattgatggcggtttccagaagcattctgatgtgtgttaaaactcctcggtaaagagtgctgagcagagaggctttcttgaagccatgatgagggcattggttggtgtaacccttgaacgctcccatgcttcacatgagctttcaccaatttttggtgaaaaaccagaaatctcatttctgagtcttgcagttttggcattggagaagaactttgctagaaaggccttcttgcaatcatcccaagtggtgattgagtcatggggcagactcttctcccaattgtgtgctttgtcgcccaaggagaatggaaacaaccggagcttgaattcgtcttcactgacaccgttgattttgggtaggttgtagagcctatcaaattcatcaaggtggtcgagtggatcttccattggcagaccatggaatttgttccccagaatcatcgagatgagaccactcttaatctcgaagtttttgttctggatagcaggaggtgcaattcctttcctttgacgatggtcccgtggtgcatctccaacaccaatgttggcagggccattatgttgattttgttcgtcagccatttcgagtgggtgctggggtaagcaccaatgttggccggcccattctgtctgttggtagggccattctgtctgttgattttgttcatcagccatttcgagttgatctaagcaagtttgaaatatcaaatgtaacaaacaaacacccaattggcaacagcgccaaattgataataggtttttaagatcaattaatcctaaagcactatcatgtcgttgtagtactgaaggttgtcaatcccaatgagtgtgatgctaacaatcaagatgcaatcagagttcacagagtcaagccaaacaataacaggtttttgtgtgttctaacagtcctaagtgaacatgcataaaacagaaaataagacagaaacaataaaacactcgaccaacacagctcgttgtagagcactgggtgtggtcgagtgactggtcgagtaacaggcagtaaatgaaacaaagatactcgactgtacagtctgttgccagacaactgggtggtcgagtatcacgtcgaataacaggaaagaattgcaaaaactaagcaacatgtgacaatatgcagtaaacaacagcagagtaaacaaaaaaatcaattagataaagaaattcccaaggatggggtaattgagtagttttgtttcctcagtttacaggtgatcgacatgctcaataaattatccctagacaacaagttcattaaccaaatctaagtgccaccgcaatagagaccctcaagttaaactagtctcaaactcaatcaccattgacgagagctaacctaacaggcattacgaatcaacaagttaaagccaaaacgctccttgcaaccaataccttggtatagagccacgaatttctggaattagtggttcagacatttcatcgaaaacgtgttgggcgcagaaatgtctgggctcatattccaattgatcagaaggcaatgggcattaacaacaactattccagaagggatctataaatcaaacccaaccacctagcatactgagaattctaaactactctaagccatcctcagaaacctagtcactactcatacatcattgtagaaagcataaacgatgataagaatgaaaacatgatatcaacagagtaataacaagatgataataggatgaacaatagtaaacaaaatcaaaagcaaatactgaatagattaagaaaaatccggattacaaaaacgtcaagaacacagtgtctacagaataaaacttcgattatcaaaaatgtaaagtacatgctacttatagtgaaatattctgaaaccctaatactcagaacgacacagtattgggacggattaataactgtactcttcttttcttccttttcttccttgcgctcaagtgtctggttgaatgtggaatggggaagactatgaagctggcagtcgagtatgtagtcgagtgatagagatggtggtactcggcttggtggtagagtgatcgagtgaaggtgatgaaggtactcgaccatgtggtcgagtagggtgatcgagtgaaggtgatgtggtggacgtgatgatactcgaccagggggtcgagtgatgtgatcgagtggttgtcttggtggtactcgaccaggggtcgagtggtgacgtgaagtgatgaagtcttctactcgaccaggggtcgagtgatctgttgaggttgtgaagcatctactcgaccaggcggtcgagtggtttcacatgatcaagtccgcttcttctagttagctcgtcaacagctcgaaatcacctgaaattaacacaaatatgcaacatgcatgcaaaactatcctaaacatgcaaagtgatgacaaatgatgagaaatggtatgaaacagtggtgatatgatgcaatagtgataacaaatggatgctcaaaacatgtaaaatgcacatttatcaactaacaataacattggttgcttagaagaataagcactcttaacctcaccacattttgcaaaaaagttgggctgcttgacgactttttctttcttttgtttcagatgtattttatcttgataaacctcatgtagagtcatagggaccagaatagtcttccctcctttaaactcaaatgaatgacgattagtgaaaccatcatgtattaccttcctatcagattaccacggccttccaagaagaataagtccaacttccattggtaaaacatcacataagatctcatcttcatacttcccgataacaatgggcacaaccacttgatttttaaccctcatttcgccacaatcattaagccactaaagaacgtatggtttcacatgtttttgcactttcaatccaagcttcttaaccatagtttcacttgccacattcgttacaactccctccatcaatgatgaggctgcaaactttcccgtgcacatgacaacccgtgtgaaacaagttttctctctgttctttatcatcggtcttggtttggatgctcaaagttctcctagataccaacaactcacccttagccggcagctcctcattctctttcaatgaagaaggtgatctggaatctcctcctcggactctatatctccattatccatgtgattcgtgacatttgtatgatgtcctttccctttcccttgacatttgtaacacctaacatcacgaactctagatgtagaaatttcagcctttcctttgtaatcttgaactgcagcatatggttaatttcagcccttgaactgacaatcggcttatagctgctggttctctcctctctttggtaagtaggcttaacaacggttcctgaaccataactagatcatgaagaactcttcgtcttaacttgctgctcaaacaaaatcgccttgtgcaacatctcttctatttcaacatagtattgagtctccaatctgttttgaatatctctgttcaaacctccaagaaaccttgacatagttgcttctctatcctcggaaatatcagcccgcaacatcaaagtttccatttctttgtagtactcttcgacataacggttcccttgtgtaagattcctcaacttgagatgcagctcacggtggtagtgactagggacgaacctcttcctcataatagctttcatttcggaccaagattccaatggaagttcttgcttacacctccgtgaagtaactagttgatcccaccaactcaaagcatagtcataaaattcggtagcaacaactcttaccctattgatctcggtgtagtgttgaaaattgaaaaccaattcaatcttcttttcccattccaaataagcatctggatcattttttccatggaatggtggaattttaagcttaagacctccaagattgtcttgcaaaagatctctaccttcattagcacgtctatggtgtctcctatgactattgcgagataaagagctcctatgcccatagtactgatctgtagcttcatctctttgctcaagctgctcatcaactcttctttgtactcgaggacgagtctgccctaattctagtttctcatgaaacacttggcgaaaagcattcagtttggtgtccatcattttctcaaaggcttccaccaaaagtttgttgttgcgattgtggttagtctcttcctcttcagtttcagccattctttctgcaatagagacaacaaaacaacaccagtaactagttcttttgaaacaaacacgaacagacccttcagataccctagaatcctaattacgatagtttcacttgttgggatgctaaaaactaccaaatcgtttccaaatatttcagaaattttttcaaaaatagtagactcttttccaaacctgtgacagttgatttcgcaattttaacacacgccaattaattataaaaattaaatgaaggtgacagacggaaacagatttgaagatgaaaagacacaaaatggtgagattgaagactcaactttcagagtgtgctttgataccacatgatgagatcctcccaaggactcgacattcttaagttgagcaaaggatagaggtggctgtgaagccgtgataatggatcgatttgaatgaatcgatggatatcacagaagcttgcagaaaggcttcaaaataccaaaagagactaagggttttgctggatatacacaccagcaagatgatcttcttagaaaaggtttttgattaaaagaaagataagttctcaaaagagaatacaagagtatataaagagaaaaagaagagaagatgacgagacaagtcttggaacaagctccaaggctgcctagaacacaacagaaattaaaaacaaagtttaaaattcaaaagtaacccttcaacgtcaaaggccacgaaattgtctctttattttagtgggcttgggccttgaatcatcaaaatggattatatgaagcgaatacataagcctcattaaaaaccttcctttggaaaatccattgggacaaaaccaaaggcagggaaaaagagcactcatgaatcacttatccatcttgatgaggtccttgagcttgaatcaaaaccaaagaggtagtgacttggctcaagtcatttggtcggtcccaaatgtggttaagcatccatccaatggcttggttgaatagcttaactctagaacgagtcattggaacgtccggtgcgacaagaacatcctctgcctcaagcttctcccccgctacaagctcatccttggctacaagcttagctccttcctcggctacaagctcacgttcaagctccggttcatgctccatatccttaatgttttccatgatcatatcacgtcgccacctgtcgccacgccatcgtctgagacacacctgtcgcatgtgggcacgacagctgtccggacatgtggcagggggcgatgctgcatggccgaccttgggcggactataaatgatgctcatctctgcccgttttcatttttgaaggcgagagagagactgtaaggctgcccgacagataactcgtctgcaaccgagaaaacttgcccaaattcagtaaatcttgcacgtggtcgaggaaactctgtccgtgcctggagaatcgacgcctgtggtcgagagaacttgaccgtgagtaagggatcgtcgaccgttatcgaggaattttgcccgagacccagaaaccttccaaattaccgaatatgtgagttgtggtcgaattgtgtgtttgtttgcatgttttctagagctagtctttagatcatatgcatgcatagtcacttagacttaactaatcggaattcggtttaagttagaacttgaatcttaaaatgatggttacttgatgaacttgatagttaatatcattaaggaatggaatggactggtgcatgactaggctaagtgaatatggacttaactaagtttacttgatgaatcgagatttgattcgagggattacttgcctggttagattgttatacttatatgagatatgctatgaggctgtgaataagtccttgctatatcatgtatatatatatatatatatatatatatataaatacgtgatttagtacttgattttgttatacttgtttggggtgtggtaaactacttatatttagtactacatgaggttattgtgtctaagtggtattcagggtttacccgataccatcatgctttaagtaagctgttaccttcctttttgtgttgtgattgtgtcagtaagtcttgatcctgagtggtcacttacatgatggcacaagtctcgtagcgtatgtcgggtaatgcatgacgatgcactaaagtgatgttccgattataagctcgggtgttcatagttgtgtacgtacgtgtggtgtgggtgtggacgtacgtgtgtgtgatagcatacatgtggagaaaatgtatacacgtatgcgggagtttgtgctgatgttgtggtgcacctttttggtaaggtttacagtattttgggcccaaggttcattcatgtgtctagttcggctgcatattctggtattattataaatatataataatacgtttgctgcgtgttttgtgatatatgatggctaagtttacttattaagttgattaaaccctagagatttaattctgcatagaccgagctcactgagtaatgctagattactcatgattctacttgtcttacaggtaaccatagtgggatgaccatagcgggaagacaaacactaggaattgccggaaatagaatgtttgcgttgcttctgcaaaattacttgttattatgtatttttaacaaggatccgacataaagatatatttttgggtaactctttgcaaagtataagctatatactacatataaagtgttttcttaaaagcagccgagtgtttaatgatataagacctagtccgggtcgctcaacactagaatatcatgagggttggcaagcctaagtggtgttcctagtgggaagatggtcgattataatctggttaaggatccggattcatctggaacctctactgagttatggtcgatcatcttcactgtagtgtaactaggtcgcccgtggcttgtccgccaatagggcgattcaggggcgttacattatcctaatctaatccatcctcaagaaccctaataactactcaaacaacaaaatcaagaacataaacccaaaaattactctaaacatatcaaaatgtagatctaaacaatataaacaactttactcaaagaactaaatgcaaaaacaaaatagattaagagtaattaaggtttcaagattcttaaacacaaagaaaatctacagaataaaagcttcgtcttttggacaaaccccaaaagacatatttatagtaaaattccgaaaaccctagattcactagaagacaagagacttgaggcggtttagaggaatgctcgatcttggggatcgagtaaaaagggtgctacaaagtctgctttgaatgatcaattggtcgagtagttacttcttcctctcctcttcttatgctctgctgtctggttgagtgtggaatgaaaagaatctgaaggcgctttgaatgatcaacaagtcttgtggaatgggttgcttttggtcgagtacttgggcgagtagaggattgagtagggggtcgagtggtgtctactgcttcctatgtagctgcctggatcgagtgaatggtcgagtgaattgccctgctgcttccctcctggtttgatagagtatagggtcgagtgatttccatgtatcctccttctacacctaaaaacatacaaaaacatgcaatatgtatgcaatatgatcctaaatgcctaagtgtgcaaaataagctaaatgtggtgcaaaatgatatgaagcaatgagtgaacactaagctaaatgatgataaacatatgagtaacatgagtaaatacagtgttatctgttcctaaaagataatagtgttccatgctacaacatacaaacccaaagactcatacggacttcggctacaccattatagctttgagaagcaataaaaagcttggttagtgtttccgagtcaaatatgaatagatttcatgtgtatgattgagtataagaactagaaccgcaaccggttccgaaaagctaaagtagtgttttcctgttagaagatacaaagccaaagactcatgctgactttggctacaccatcaaagctttgagagggaataaaaagcttggttagtgttttggagtcaaatatgactagatgtcatgtgtatgattgagtataagaactagaatctcaaccggttctcaaaagctaaaggagtgtttctttgatagaagatataaagccaaagactcatatggatttcagcacaccatcagagctttgagaagcaataagaagattggttagtgttgtggagtcaaatatgacaagatgtcatgtgtatgatgcactacaacaaatatccacattgatagcagacgaggataacacattttccgtcactgctatgaaagattaatttttttttgggttcttttttaatagtttattaaaaacgctatgataggaaatacatgagtgggagtctaaaatcactcaacccgccaacactttacctaaattattcacttaagcgcgtctagaactattcatgtctcttccctcttctctcggcaaagacctaaggtttcagaaaaaaacaccaaattctctgatccacgattgctgtcaaattctacagtctcaaacacaaaatttcattatccccgaaactataatcttctctctcgccggtctgcttctatttcgagctccattgaagtcacattcaagctccatcgaagtcacattcctctttaatcgccagcgtcagcgagctcaaatcaaaggcatgtgtttcttcctttcactaattcctctttactcccaaatatattgtcaaacgattttgagatggttttattgaatttagggtttatgtgcatcgatttggtttatgtgaaattagggttcttgggtaatgtgattcgattacaagtttcagagttataattcttgtagatattatataacaatcgattacataagttgtctagcttcattgtcaaatgattatgctattttttttgcaagtgttggtgattgaaacgcttggaaactgaagcttgttgttcttgtaatcacacgacaggttagtctcttcagttgctttggttgtctttgtgattgtgattccatttgtctgtgaatttgcttcattttccgcgactgttttggttctgtgcattgctttggttgtctttagaattgtgattgtgattcatccgttatttgcattgctttggttgtctttagaattgtgtttatattagaaatgtctccacataagatgtcgctgtgagtgaatgtgctttctttctttttaatgttggttatggcttgaattggtgttaaaaaggtttaggcttatataatgttggacaagacatgggtgcagctatgcaggtaaggaattatcttatataggttaggtttacaaatgggttttggatactttaagaggcttctatttggctttctttattcattgaagagctgatcccaattacgagagaggtgctcggagttttgtacgtgatgtggttgcggctctaggagatatcgatatgattatatgtccctgtaaagagtgtcgtaacgtataccagcagtcaagcagtgatgtggttgtccatctggtaaccaaagggatggatgaggcatacaagttgcaaagtgaatggtatcatcatggagactctgtggcttcagctgaaggcgtaagtaccacaaatcagaggaatgatgaaattcttgagctatacaaggctgctgaatattttgatgaagagctggctagcaagcgggacttagtagagactccattgggtgacttagctgagatagcagaagacgaggacaggagagaagatgaattcctagccaaactagcagatgctgaaccccctttatacccgagttgtttaaaccacatcaagctctcggcgattgtgtctctctttaggattaaaacacgtaatggatggtctgacaagagcttcaatgagctgcttgagacattgccaaatatgttgcctaaagataatgtgctgcacacatcattgtatgatgtcaagaaatttttgaagagcttcgacatgggatatgaaaagatccatgcttgtgtgaatgactgctgcctattcagaaagaagtacaagaagctggacaattgtcccaaatgcaaagcttctcggtggaagattaatactcacagtggtgtagtaaagaaaggtgtcccacagaaggttctgcggtactttccgattatcctgcgacttaagagaatgttcaggacagctgaaatggccaaggacttaaggtggcatttcactaacaagagtagtgatggaaaactccgtcatcctgtggattctgtgacttgggataagatgaatgtgagtatccaacatttgcagctgaagcaaggaacatgcgacttggactgtctacagatggctttaatccgttcaatatgaagaatatacagtacagttgttggccggttcttttagttaactataacttgcctcctgacctatgtatgaagaaggagaacataatgtttacactgctcattcctggtccacaacagcctggtaatagcatcgatgtgtacttagaacctcttattgaagatttgaatcatttgtggaagaagggagaggtcacttatgacgcttaaagtaaaagcacattcacgctaaaggcaatgcttctttggactataagtgaccttccggcttatggaaacttagttggttacaaggtaaagggtaaaatgggatgtcctatttgtggtaaaaacacaagatagtatgtggttgaagtttagcaggaagcatgtgtatatgagtcatagaaaaggattggggccaactcatagttatagggataagaaggcttggtttgatggaaaatcagaacatgggagaaagggcagaattttgactggtcatgaagtttctcaaaacctgagaaactttaaaaacgattttggaaatgtgaaaggatctgggaggaagagaaaaaggactgttctattatctgatagtgattattcatcaagtgaatccgaagaagaagaagaagtagaagttgacgaggatgagttatcaagatggaagaaacgatctatcttattcaagctgccttattgggaggtatgtatagcttaatataattttagaattgataaacggatatttgtttaatgtgaaaccttataattgtatttgtattctctatatgatctcacggtaagacataacttggatgtaatgcatgtagagaaaaatgtggcttcaagcattgtctctacattgttacattgtggaaaatcaaaagacggtcttaatgcccgtaaagacctccaaaatcttgggataaggaaggatttgcatcctacaacacaaggaaagagaacttaccttcccgcaacaccttggtctttgtcaaagaaggagaagaaaacattttgcaagcgcctacatgactttaaaggtccagacggttattgttctaatatagcaagaggcgtttccttagacgactgcaagataacaggactcaaatcacatgattatcatgtgttgatgcaacagcttcttccggttgcacttctaggtttgttaccaaaagggccaaggacagcaatcttaagattatgtgcattctttaaccatttgagccagagagttattgacagagaggttatttcagtgatggaaactaaaatagtggaaactctttgtatgtttgaaagatttttccctcctagcttctttgatatcatgatacacttgactgtacatctaggaagggaagctagacttggaggaccagttcatttcagatggatgtacccatttgagatatttctttgcaccttactttaaacacttagtataagtcactgaaatccattgtaatatagatgcttcctttgtattgtaggtacatgaaatttttaaaagactttgtaagaaatcctgcaaggccagagggctgtattgcggagtcataccttgaagaagagtgtgttcagttctgtggtgatttcttgaagaatacaaccaatgtagaagaaaaagtagataggaatacagagtatgagaacagctctattttagaagggcgtccgatatcagcagggacttcaataactctaagtgaaatggacaagaatatagctcatcttgctgttattcaaaacatggctgcacttgaccaatatgtagagtaagttctctttctttcttaaaacatggctgcacttgatcaatatgattatatatgtaactgaaattcttaaatttctcttttgtaagcatgcatctacaacatctacaagactcaaatccaaggtgtaggcgtgatgcatcacacttatggagtatgcatgccaaaaattatgcttcttggttaaaagaacaggtaaatcatctcttttcttggttaagagaatagattgaaatctcgtgatggtgattctggttaactctaactgatagtctctttaaccgcttgctagatacctcttggttcgactgaacatgaagatataattaagtggatagcatatggtccacgatgtagtgctaggtcctttactgggtatatagtgaacgggcatcgtttccacacaagctcacttcaaaggcaaagtcagaatagtgggatttattatgagtcaactgctatgtgtagatctagtgctaaagataactcacaagtggtggatttggtatcctactatggtagagtcatagatatcattttgctggattataatgtgttttatgtgcctatattccggtgtcaatgggcagttagaggaaacagagttaaggtagaagatgggttcacgcttgttaacttgaatcacagtcaagttagcttcttgaaagatccgtttatactagcctctcaggcaaagcaagtcttttattctagagaagatgatgcatcaagctggtatgtagttatgcgaagttcttcgagaagaaactgtaaagaacaaaaccccacaatagcacagttcactatgaaggtcagacataccacaatcttgatacgcttatggtctctgcctcctaccacgagcaccacgcatctagacccaacatttcaagatattatgagacatatggttactcaaactcatagaattatcaatatccttactcaacacaacctcccaactataagccttaagcataagaatctaaaagatctcatatgcggctcattaccaccattcacactattaactaatactcatatgattcacgaaataaatcaatgaatgcaagagcatatgatcatgcaactaaaaaatcaatcaatcacccaaataaacacccaaacttagtcctcttaggaaccttcgtaccatcatagcttcatcatccctttcgttgtacaaatatctccaaagtcttgtaaaaatttgctcctacgcaaaggcaatcttttgcccttgttccaaactcataaactgcaactccagacgatcacatgcctctggtagaaaatacttagactcaaactccttcttaaacatttcccatgtgataggctggtcgcggtatcgtgaaacaacactatcccaccaagctcgaccatcctcatcttaaaagtataccgctatgtggcccttaaagtcttccgggcaccttgacttttcaaaattcatttccaggttcctcaaccacttatccgctaaaacagtattctgctctcctttaaacttcgaacacctaaatccttcattatccataaccagctttaagaactttgccgaaggagattcggcacgctggcttttctgcatctgttgttagtgtagctattgttgaatcatatgagtcaacaaggtctgaatcatccccaacatcgattgagtctccaacacactttgaacattacgaccttccccatttccttcatcaacttatcttggcagcgacggatttttgtgtgcagtgggttgattcacaggaacatgtgatcttgtctctgactgtgaccctttggatgtgctacagtgcataaaccttggtaaggagtattctggtatggttgcgggaacatcccaatcaggcgttccatacatattgggataatagtatccctcatccccttctcctccaacatacggtacccagtcttccggcccgaagtgctgactccagttttcataaacaggtgagaaattcatcgactcgttcctctccgttctttgacaagaaatctgcattcaatcaaccaaggtaaacttaacccatctacctaacaatggtgaaaagacaggattactcgataaaacattttgaaaaacacgagtcttgctagcatcattaaccatgctctgataccacaaattgtaacgcccccgagacgctctatgaccagacaagtcatgggcgccccgaaaacgccacattgagattgatcatcaacatccaaccgaggtttgggaacccatcctaacccttggccgacgtattgacgaccactctcccacttaaaacattgtttaggcttgccaacccttacgatatttaagtgttgtgccgattcagactaagtcattatcattcattactcgcaaatttgtacaagaaacctgatttatttcataagtatagatattttacaatatgttaccaaacatttataagttttatggccaaggcctagtgccaaaagcacggtacataatagaaacatacttgttttacaaaaggcacaaaactactccaagtttcctattgtccaccacgcgctctaatcctcactatgggttttctgcaaaataagtagaatcatgagtaatctaagattactcagtgaactcgggattccctgcaacagacattagtttaccccaacccaaatacccaacatggaacacacaacaaagcatggcaacgtaaggtagcttgccgaagcaaactacaaaaatatgcaaatgcattaagactccagttttagtaagttttaaagggcccgatatgctttcttcaaacccaacaccaaacacacacactcccgtgatctcccgcgttacaaccacaaaggtatgcaaccggagcatcactaccaaacgttacaccgtcgtgtatacactcggccagggtagctttccccgtctcttcgagttctttgcacttcatggtgataaagtaacatcgttacaagaccccacgatagcatggttcactacgaaggtcagacaaatcacgatcttggcacgcttatggtctttgcctcctaccacaaacacatcgtaccaagaccctaaagtttaagatattatgaaaaatatggctaaatcaaataatagaatcatcaatatcccaacacaacctcccaaccataaacaatagcataagaatctaaagatcacatatgcaatccaatataaccattcacacaattcatataactcacgaaatcaatcaagaatgcataagaatatgattttgaaacttaaacaattttctagaactcactcagtaaccaacaggatgcgtgcaatgattcggaaagaaattttggctacaggaccttaacttgaatcggacgaacggtctttaactcggcagcctctcactttcgttcactttctcttcacaaatcatttcgggtcgagttgggcttgaataggcaaagcaagggcgtgtcagcatgtacacatgtcaaacgcttgggcgagtcagcaatccacgtgtcatccgcccatgatgacacgctcaccgctttagaagatgagtgacatgtggccatccaaacttcggctccacgcaactttcttgggccccaagttagctgagccacgtgtccatggtgcggttaaatgccccaagtatttgatcatggaactaaacaatcaatcaatcacccaaataaacacccaaacctatcatgtgccatatcacacgcttcaagactcacatagattcggttgaaggtttaaggttagcttcaacaattctcggacattccatggcttcccaatcttgatcccatctcaatttaactctcctcatcttgatctaacacctcttgatagaagcagccttgattcatgaagctttagtccgaataaacatttatgggacgggttcctcggtaggttctcgatcagacaggataactgaatagatttctcgctcatgggcaggaattctcgatcactgacaggaattcttcactcacggtcaagaatatcgacggtaaggccttcttcacgttttctcggtcttacgggcagttaataactcaacagcattttggttctctctctctttttccctctgaaaattcttaaggccgaatggagcttatttaggggcggcaggggtgagtcagccagtacacatgtcgtccgcatgtgatgtcactcacgtggcaacgctaggacgatgacacgtggacatcaagactttggctccaagggacttaacttcggctccaagggacttaacttcagctccaatcctttaaaattcagctccaagcaactttgcttaagctccaagtaagccagcccacgtgtccatggcgcggtcaacgcccggtggggcaaacttcgcctacgccacgcctatgttggccaatcttgcccattcttgcccatctttgctcattcttgcccaaatagttatttctttttccctttgatggtttatcaccttttgggcacatatggtcaatgatcatgtattcatggcaactttctccagttttggcttcgcccggattaccccatttcaaactagaattggccagtttcatttttaccttgcccatatctttggctttcgtccttttactattcttttctcttttagttcttccttggacgttcctagatgtttgcccgcttggtcgcataccccttagcgagggtcactacacaaccccctctcttttatttttgtcctagtttcactctcttcttaaggatttctctaaactacttctctccttgtggatttgatcctaaaatactactccgatataatgtgctcttgcagtagtggtgttgtctattaggtaaaagcctgaggcgaaataaacatacatcaccactcgaccccatactcgatcctttacttgaccaatcactcgatcacagccaacggattccatctaacctaaagatcgatcaaagggccttccgatcctcctcatttccccactcaaccagacaactgagcataagaaaaggagaggaagaagaaactactcgacccagcgatcattcaaagcataaaggcaaaggcgcaatctttgtagcatcctgtcactcgatccccaaaggtcgagtatccactaaaccgtctcaagtcttttgtcttcttgtgtcctaaggtttttgggattttactataaataggtcactttggggtttgtccaaaggaccaagcttttatcttttagtttatttttgtgttttagaatctttgaaccttaattactcttaatcaatttcatttttgcatttagttctttgagtaaagttgtttatctagcttagatctacattttgatatgtttagagtaatttatgggtttgtgttcttgattatgttgctagagtagtgattagggttcttgaggatggattagattagggtaatttcagggtttttcaggtggttaagattaggttagatcccttttggattagttgggcttaatgtttatttctttctgatcaattggaattcgcctaaggcattcttcatccaaaagatgttcacatggaatgcctgatctactaattccagagattggttcctctatcccagagatggctctttggagggctttttggctttgatttgttggtgcttagtgcctgctgagttagattcctttgacaagaccaagtctggacctaactctgtttgaggtcattgatgcgagactgctttgatctgtattaaaacattttgtctagggtatttgcctttcacttgttaaccacctgatagaccctagatttgcttttatcaatgaatccatctttagggcttctattcttcttagatttatttgcttatttacattcacctattattgcatttctttcacctattatttgccttcaccctgtttagttacctattattgcatttttgtccttgaatctgtcgtttgcttggttttactcgaacttgtgatcgagtagggcacttagttctcatttttattgtttgaaacttgatttaggattgttactagaaacccaccatctttatacatctggcttgacttagttgcttttgtacacattttgactgcttagcaaacccagtgaaatggattgacaccccatgttgctgcatcaacatgttagtgtttaaggagaaattgaatacaacctagttaggcgttaaaacctaactatcaagagtaaagctaggaccaataaacaaaagagggttttgttgcaagtaaataagtaagtcaaggaagaaagtaaatcaagcaaatgaaaggaataagagaaccattgggtattcaagagatcacaatggattcaatgattaagtcaaaggataacacagttaggtttgtttatttccaaattctctcacatacaaaactcattcatttttgactaaccctatggtgtataggcttagagtcggctaatctccccacattctgttacccaactatcgaaggcaacgttacatagatcaaagcattaagttcaagttcgattctagcccataaggccctataaatcaactaccacaggttgtagcacaatattcattcgtgagttagattaaagagtattacacaagattctgccaagcataaaactcctaagatcatgttctaggtgggtgtaccgagcataaattcattaaggacaaactcaactagaaaaaagacagtataaacaataaaaaaaaaacatagttaacgccacttcaacattagatcatcaacccccctttgactagccctttaaacgcaactagagatctactcttgcatggtaaagggactcatcaaagggttttttgataaggctgataataagtttttagtcaattaatcctaaagcactatcatgtcgttgtagtattttaggttgtcaatccaaatgggtgtgatgctaataattaagatgtgatcagaagtcactaagtaaagccaagcaataacaggttttggtgtgttctagcagtcctaagtgaacatgcagaaaacagaaaatcaagcagaaacaataaaacactcgaccaacacagctctgtgcagagcactgggtgaggtcgagtagcagacagaaaacgaaacacagggatactcgactgcacagtctgttgccagacaactgggtgatcgagtataaggtcgagtaacaaaaaaaagaattgtagaaactaagcagcagatgacaagatgtagtaaacaacagtagagtaaacaaagaattcaatcagataaagaattcccgaggatggggtaattgagtagtttcgtttcctcagtttacaggtgattgacatgctcgataaattaaccctagacaacaagttcattaacaaaatctaagtgccacctagtcccagactcaatcaccattgacgagagctaacctaacaggcattacgaatcaacaagttaaagccaaaacactctctacaaccaataccttggtacagggcctctggaattagtggttcagacatttcatcgaacaccttttgggcgcgcaaaatgtctgggttcaaattccagttgatcagaaagcaataggcattaagaataactaatccagaagggatctatcaatcaatactcaaccacctagcatactgagaattctacactactctaacccatcctcagaaacctattcactactcagacatcattgtagagaacataaacgttgaacaggatgaaaacatgataacaacagtttaatagcaaaacgataacaggatgaacaacagtaaacgaaatcaagaacaaatactgaatgctgaatagataaagagaaatccggattacaaaggtctagaacacagtgtctgcggaataaaactagaaaaaaaacttgtttgcaaaaatgtgaagtacatgttacttatagccaaatattccgaaaccctaatacttaaaatgacgcagtattgggacggactaagaactgtactcgacccaggtggtcgagtgggaggtcgagtgaatagctggagtcttcttttcttccttgtgcttgagtgcggaatgaagaagactctgaagctcgcaatcgagtatgtagtcaagtggtggtgatggtgatactcgacttcaaggtagagtggtgagatcgactagtggtctagtaatggaggtgaagacactcgacctcggggtcgagtgatgtgattgagtgatggtcaggtgatggagatgaagacactcgacctcggggaggtcgagtggtgaggtgaagtggtgatgtccactactcaatcagggggtcgagtggtctgctgaggttgtgaagcgtctactcgacctgggggtcgagtggttttgtatgatcaagtccgcttcttccaattagctcgtcaacagctccaaatcacctgaaatcaacacaaatatgcaacatgcatgcaaacctatcctaaacatgtaaagtgatgacaaatgatgagaaatggtataaaacagtgatgatatggtgctaaagtgatgaaaaatggatgctcaaaacatgcaaaatacacacttatcaactccccttaacttagtctttgcttgccctcaagcaaacaatcaagaacaagctggaggtgaggtttgaaagcggggactcaaagccaaagcaccagataaacaagatgaaatcaatgtccaagttggaagttctaagctgcaatatgatcgaattctactcaaaaacgttagccatgcctcattatcaatatatccgactcatatgctcgacctacacatgttttcaaatctaccaatccctttaacattcattagttctggaaagtgaatcaagcaatgcatcatcaatcaactcatttggctaaggtaaaggtcaagggacaaagatggtcccttacaaaataggcttcagtaacaggggatctctcaaaaaatgattaagctttagtagaatgctaaaggtaagtcacaagctatgcatacagagataagatcccatctacccagaatatatcaaatgaagctctaatggttatccaatctccaatcccaatataagaacttaactctaccctttgcattgatgaatcttttaaaccctttttctaatcattcttttctattctcttaactctaggagaagctttctcaacactttgatgcatctagcggatttggatttctttaacaactaaggttcctgtttttaacattttaaaaccaagggcttttgcccatcttcaatagctaacaagaactctttcttttctttacaaatcccaaaacctttactagacttttctacttctttagcttacttcacctagagtcttttaccttttcttatcaatgaatcaaccccctttttttcttttaaacacatcccaaccaaaagtataagcgcccacctagtcctatctagtccaaaaaatgcgaactagaactacatgagacactatctctgtcgttacgaacctaacactttctaccaagcttaatcggaataagacctcacaaacactcacaagtgatatagggcttgaaagaaagtctaggttttggttcgggttaacagctctaataaggagagtcagctacttggattaacaagagtgatcaaaacgaataagaaaatccaagtattttagggtatccatgagttcagatttgatgtagacatgataattaaagatcagattcatgttcaaattgatagggaatggtatcagatcatgacagtgtggtcgagtagagcaatctaggcatggttcagttttatttcaaattcattgactacgcaacagacaactagcaacgagggcactgagtttatccggtgaatcaaaatgcgtacaaggctatctcatcattatcccctaggcatatgcaacaatcctaaatgaaacactctagactcgatcgtaaatgtaatgcaactacatgaacactttttttttttttgtgaaatcattttctgaaatttttcaaaatttttttggtttttctatgccttagataaatgcagactcaaaaatatacacaatgcaacacacacttcctgagccgtcccccaaacttatcatgtttcttgtaccacttctgcagcttgctgttgtttctatgagcttcgctcaaactcttgctttcccgcgatggaggtataagctcgctgaaatgatacatgctcgtgtcaaactccgcctcatttatatcatctgtctcatcaacatcttctgttgtagctcctttggtgtgactaacctcctcagttggcggactgccctcaaaataaagatcttctagcgcaggcttgaagtcaatgttccttccctcaagaatcctagtagcgtcaatgcaggggagaagaatgttggcgattctagaatgctcgaacctgtagcggtggaagtcgccagccatgtcaaactccaagaactcacatcggcgcaaatgatccaagtccatcatcctcggtgctaaccctggttccttgagcggtactccacaagcttccagaattggcgtcaaaacgccacccacaaatagtgctcctctcacattcttcttaatgtttgtcaacgcccacttcctatatccacacaggtggatcaatagaggcattactggtggtgtgttgttgagatcgcctctcaagacattctttccctttgtacggcggagaatccctgtgagcgcggaatctatcatctccatgtccgtgttagacacggtgcctgtagactcccaggagtaaaagacgttggcaactgatcgctcaaagtagcggatcataggactctggattttgttgctcttggaccgcgccgagtttagcgatagattgttccctatagtggcccacaaatccttaagctcctctctgtcaaatctgggtttggttcccttttcactagggaaaccaaacagttcttccaacttcttgatcgaaagctgataccgctgttcatccactgagaacgtcaagaagcctaaccccatggtttccagctcaaagtctgtgagtccctcatacatctccacttgcagcgtggaaagaaactcgattgtctcctccttataggcagcgtaaaggtaagacatgagtgtctccagatgacacttctcgaacagatgctgcacgtcctccagtaaccccagttgggttaaagtctcatagcacggatacctcattccccagaagtcattcatctcaaagagtctgatatattcctccattgtaacctcgtcgggtttgttcagcagcttcgtctccttgcgccatgactctggctcatagtcagtttagatatcctcatcaatcagctcatatctactcgacatcgccctctttcctctggcgatttcagctcttctctgattacgtcgaactgcggagcgttcaaattcatccctgaagctctcgtaagcatgttgcctctcggtctaacggaccaggactcagcttcatccacattataatcagggtccatagaggattctccactgtagttactcatgatgaaacctgaaaacagaagaaactcaaagataaacgtaatagcaaaaccaaaaacacaaaccaatcaagtaaaaaggtcgagtataaccaaaccggtcgagtgtttggaccaaatccctttttttttatatacttcttcgtcggtttgatgtgtccgcggtcgagtgaaggctgtggagtcgagtgatgtggtattgaatgagaggtggtgattgagctggagagatgaaagcagcggcggtaaagtgatgaagctcgaatggaggagaaaacgatttgattggttgatcgtgaagggggtcgagtggttttgagcgagaactgttgaaggcaaattgatggtagggatcgagtgtttggtgagcttgagaggcggaggggttcttgcgacgaagtcgagtgaaacgactacgaatgaagaggtgagagacgattctttgagtgagtgaatggtgagaagcggcgtggtatgaagcggtcgagtgaagtttgagaggatgacagttgtaatgagagctcgagtgattttggtggtggagatgcgatgagagttgtggctgtgaaaggcgagagaggagcggtcgagtgcgtgaggaagagagatggtgaggtcgagtttatgaaaggataaggcgatgggatcgagtgtatagataaggagaggtcgagtggtgctttggatggatgatgatggggttgaagacgagtgatggagagaagggagggttgatttaagaaggatgcggtcgagtttatttggttgtggaggagaaaacgaggtcgagtgatgggggagaagtcgagtgaagatggggttgcgtgaagatcgagttggtgtgaagagattccatgtctcttggtctgctgcatggaggacatgggcgtcagtggtgggttccattgtgtcttcttgtctttcttttgtgctctctgcttattgtaaaagccccaggaaattccgcaatcttctgtaaacttgataaagtctctgtaagactctgcagcttctgttggtcgagtaaaatgatgatttaattttttttcatgttttaaaaacatcactcaaactcgaccaatgtactcgatctctaggccatcaatagagtaaaagctttaaatttttactctaccttcacgttactctctttttttttctgagaaccacaaacacaactaaaacaaatcaaaaataacaagaaagtaaaaattatttacaaggataattatgggacttcctcccaagtgagcttttactctactcctcccaaactgcaacttgatatgctttccaaggttgagacttattttcccttccctgacatctatcactgctcccactgaagctaagaagggtcttcccaggattaagggatccttatgctctacttccatatccagcaccacgaagtctgtaggcacttctactccattaatcatgattggtagatctttcagcatgccgaagggttttcttgaagacctatccgcaaggatctaagtcaggtcacaagttttatactgaatgaactctaaccttcttgccacagagagtggcattcagctgacagaggctctgagatcgcacagacaattgctgaaagcgaattccccaatggaacatggtagagtgaaagatccatgatcttctaacttctcttgaacaatcctcttatcagcagctcgagatggagtggcatcactttcatcatctgaatcgtgatacatcttgatcctttccaatatcaaatttctcacatctttgtgaagatcgagaatcaggttgagaacttccatcagtggcatcactgcttcaatctcgtctagctgcttcgctgcaacagacttgtatctctccacccacgctttcctaaatgtccacggaagagcacatgagggtaatggagtaggtttgaatcgtttcaccattttctagattatggcggccttctcttccgaggtggattgaatgtgatggtgagaaccagtagaatggttgaattcaacaacagagacttcaatccgagtagaagcctcccattcttgaacatcactgtccctagtgattaaatcaaggacaggtcgagttggcttctctcgatcatggagagagtgatggcgtgagcagttgcatactcttttggattctgtatggacttccctggaagtcctgtgactttaggtgcagaggtagatgctgattgtccttccaaatatctgactttggtattcaatgcctccactttggcattcacgtcattgtatctgcaatccagcttatggtgcaattcagataatttcttatcaatttccattgagctagatgcttgtccttgtagcagttgttgtaccatctgtttcatttcagcatcaggagcagcaggaccttggttttgctgaggtgcaaacccaggtggtggtggcggctggtagttcccctggaatagctgcttgggaacgaaaccttggttgtagggaacaaaaggtttgttctgaccttgttcttgctgtggaggatacacttgatcctgaggattagcgatgttggtgttgcggtagaagaggttggggttgttggttttgaagttgttgtatcctttgtagccaccctagttgttgttgatgttgctgactgcttccaactggttaccctccccatcttggacttgaaactgctcgtcatcaacaaggaagtgcacaagcttctgctggctaagaagaatcttgtccagcttgtcattcagcgctttgatctccttcgtgtgtttgtcatcagagtcaactgtgcctctgacggtcctatcacagttctcgttgtaattgccatctgattgagcaaggttctcaaccaattcccagtcttcttcaacatcttttttctggatatttccattgctggcggtacccagaagcattctgatgcgtggtaggactcctctgtaaagagtgctgagcagagaggctttagtaaagccatgatgagggcattggttggtgtaacccttgaaacgctctcatgcttcacaaaagctttcaccagccttctgtaaaaagccagagatctcatttctgagtcttgcagttctggcattggagaagactttgatagaaaagccttcttgcaatcatcccaggtggtgattgaatcatggggcagattcttctcccatatttgtgctttgtcgcccaaggagagtggaaacaaacgaagcttgaatccgtcttcactgacaccattgatctttgttaggttgtagagcctatcgaattcatcaaggtggtcgagtggatcctccattggcagaccatggaatttgttcccctgaatcatcgagatgagaccactcttaatctcgaagttgttgttctggatagcaggaggtgcaattccttttctctaacggtgatcacgtggtgcatctccagaaccaatgttggcagggccattttgttgattctgttcgtcagtcatatcgagtggttgatgaggtacaaggttcactgtgtttctcctttctctgagttcgcgagctatgcggtcaatgttgtcgttgaaaaggaggttctgattgcctgttgattgagttcgcatacagcagaggtgtacatggatcaagaagacaacaagaaaaacacacagttagcaaccagattgaaaattgaaaaagaacttgatctaagcaagtctgaaatctcaaatgtaacaaacaaacacccaattggcaacggcgccaaagtgataacaggttttttagtcaattaatcctaaagcactatcatgtcgttgtagtattttaggttgtcaatccaaatgggtgtgatcctaacaatcaagatgtgatcagaagtcactaagtcaagccaagtaataacaggttttggtgtgttctagcagtcctaagtgaacatgcagaaaacagaaaatcaagcagaaacaataaaacactcgagcaacacagctctttgcggagcattgggtgaggtcgagtgacaagtcgagtagcagacagaaaacaaaacacatggatactcgaccgcatagtctgttgccagacaactgggtggtcgagtataagggcgagtaacaaaaaaaagaattgcagaaactaagcagtagatgacaagatgcagtaaacaacagtagagtaaacaaagaattcaatcagataaagaatttccgaggatggggtaattgagtagtttcgcttcctcagtttacaggtgattgacatgctcaataaattaaccctcgacaacaagttcattaaccaaatctaagtgccaccgcaacagagaccctcaagttaacctagtcctagactcaatcaccattgacgagagctaacctaacaggcattacgaatcaacatgttaaagccaaaacgctccctgcaaccaatacctttgtacagggccacgaatctctggaattagtggttcagaaagcaataggcattaagaacaactaatccagaagggatctatcaatcaatacttaaccacctagcatactgagaattctacactactctaacccatcctcagaaacctattcactactcagacatcattgtagagaacataaacgttgaacaggatgaaaacatgataacaacaatgtaatagcaaaatgataacaggatgaacaacagtaaacgaaatcaaaaacaaatactgaatgttgaatagataaagagaaatccggattagaaaggtctagaacacagtgtctgtggaataaaactagaaaaaaacttgtttgcgaaaatgtgaagtacatgctacttatagccaaatattccaaaaccctaatacttaaaacgacgcagtattgggacggactaagaactgtactcgacccaggtggtcgagtgggaggtcgagtgaatagttggagtcttcttttcttccttgtgcttgagtgccgaatgaagaagactctgaagctcgcaatcgagtatgtagtcgagtggtggtaatggtgatactagacttcaaggtagagtggtgagatcgagtagtggtctggtaatggaggtgaagacactcgaccccggggtcgagtgatgtgatcgagtgatggtcaggtgatggaaatgaagacactcgacctcggggtcgagtggtgaggtgaagtggtgatgtcctctactcgaccagggggtcgagtggtctgctgaggttgtgaagtgctactcgacctgggggtcgagtggttttgtatgatcatgtccgcttcttccaattagctcgtcaacagctccaaatcaactgaaatcaacacaaatatgcaccatgcatgcaaacctatcctaaacatgtaaagtgatgacaaatgatgagaaatagtataaaaaagtgatgatatggtgctaaagtgatgacaaatggatgctcaaaacatgcaaaatacacacttatcaaaggccataagaaagagatgaataagacttaacaaattgcagcaccgaattgtcaacattctaaggatggtcgaattgtagcacgagtgtagatcgacaccaccactcgagtcgatccacacacatcactggttgaagcagagtcatctccgatagctacttttcaagctgggatcattgttataagtctaggcactactgtcacgtcacccactacacctctcatacttcatccacctcctaaacaaccaaggtactaatcttttggggtcagatttcacccaggtaaccgagccgatcaaacaaataacacaagtgccgcgagagctaattttgccgtctccccgaggtgggaacattatcctttatggcccgggcgtcactccacaaacatacccgagccggtcctcgaaacaccttgggcaaacatcaccctgctcggtggttatcctagaagatgattgagctgagtatgacaacgatccgaggaccggtttgacctggctcagatgaactcttgacctgagccaaaggcacacgttcgtccgaggagaagacttttgaactttgacggggccgaaatatcaattccggaaaacctggaaatgatattggagaatcttcgaggatattatcaaatctggaaatcttcctgatgttcccgaagaataaggaaaatctccatttatgaaagatcttccatcgccgactccgagataaatgaaaatcttccgagaatatcgcgagaggtggtttatcaaagacctatataaagcgcctcatagaataaagaaaaggggtagagaaaaaaggctctccacttcaggctatcaaaacgctctgactttgaaggctaaaacacttatctttacctttctaaacacttgtacgatcgaatcatcatcttttcaataataatatcaagaacattgtccgcggtaatcgaataattctgttgttctttgagagtctcgcaaagatctgttctttgaagaaaccctaactacaatttcggttgtgtgagtttcgactctcacaatttggcgctagaaggagggggagagatttctcttactccaagaacacagaaccgacaaatcaagtaacgatgaccaacaaccagatcccccttaccaccgttgacgtggagggaaaccctgttcctccaatccaggtaaacgctcctaaagtcaacgctcccgcagtcctagcaaagctgaggagcatgatggcacaactccagaagaaggtgaacgatcaggagcaagcaaattgatccttgtcccaacagctcgaagtggctacttctcaagggcaggtcaggaccacccgctttggcgcacaacactttcctgatcggtgagcagcggtagatctcaatccaacgagactcgtgttcaacacacaccggtaacacgacgaggccattttggcggactgcgccagcactcggcggaacccgagcagaacatgacgaaccgagtagaggaagcagacccgcaggtcccgattccccgagccgaatctgacgaggctgacgagatcaaagtctctgacgacgaagattcggaggaaaacattagatgggctgaggagtaagccagggagtaggaaataaatgccatcaagctcttcctagccaatgcagatgccgagatgaagctcgtacgatcacagatgcatagcgctgtctcctcggtcccaaacatcgattgcattctagaagtatatcacaacacacctttcactcgcaagatctccaacgcgataatttcagacccggagaaactgagaatcgagtacttcagcgggtcatccgacccgaagggccatttgaaatctttcaaaatttctgtggcccgagccaagttcaaaccggaggagagtgatgctggtctctgtcatctgttcgtcgagcacttgaaaggaccagtcctagattggttctcaagacttgaagggaattctgtcgacagttttcaggagctatcgacgctcttcctcaagcaatactcggtgctaatcgatccgggcacgtctgatgtcgacctttggtcactgtctcaacagccgaatgagccacttagtgatttcctcacaaagttttgatccaccctagctaacgttgagggaataaatgacgttgcggctctctgcgctttgaagaaggcactatggtacaaatctgaatcgcgaaaggaattaaatctgtttaaaccataaacaatccgggaccccctgcactccgctttggcgcacaacactttcctgatcggtgagcagcgggagatctcaatccagcaagactcgtgttcaacacacaccggtaacacgacgaggccatttcggcggactgcgccagcactcggcagaacccgagcagaaccaacagcctcgggagagcagaacatgacgaaccgagtagaggaagccgacccgcaggtcccgattccccgagccgaatctgaagaggctgaccagatcaaagtctctgacggcgaagattcggaggaaaacattagatgggctgaggagtaagccagggagtaggaaataaatgccatcaagctcttcctagccaatgtagatgccgagatgaagctcgtacgatcatagatgcatagcgctgtctcctcggtcccaaacatcgatcgcattctagaagtatctcacaacacgcctttcactcgcaagatctccaacgggataatttcagaccggggaaactgagaatcgagtacttcaacgggtcatccgacccgaagggccatttgaaatctttcataatttctgtggcccgagccaagttcaaaccgtaggagagagatgctggtctctatcatctgtttgtcgagcacttgaaaggaccagccctagattggttctcaagactcaaagggaattctgtcgacagttttcaggagctatcgacgctcttcctcaagcaatactcggtcgctgtctcagcagccgaatgagccacttactaatttcgtcacaaagttttgatccaccctagctaaagttgagggaataaatgacgtcgcggctctctccgctctgaagaaggcactatggtacaaatctgaatcgcgaaagaaattaaatctgtttaaaccaaaaacaatccgggacgccctgcactcagcctcagattatgtttccaataaggaagaaatggaagtgctatcgaaaaggcacgagccgtcgaaacaaacgcctcgtggcgaaaaaatcccaacctagcgctgaaggcgagaatttagtacactatgaggggcgatacttctctggagctcacaattatcaagtcgatacaccccgaggttgagggcgaggccgcgattgaggtcatggacgagaatcatatacttggacgaaagatcaacctacgggaaatgagcaggagtactacgagttatgtaagagctacgaccatcacacttttagatgtcgtaatctcggtgcgaagttggcagccaagttcctagctggtgaaatcggtggatgcttaaccattgaagacttagaagtagagaaggcgaaagacgaacaggtaaatgccgtggcaaaccatgaacaggcagtgtagtgacccgcataaggacatcggccacgggcaagagtccgaatttttaaaagttgcccgaatgcatggccaattgaccttatgtgcccaagatacaatagactatcaaagggcaaatatgggcaagtttgggcaagaatgggcacaaatgggctagtttgggcaagatcgggcgtgccgcgggcgaagtttgccctacagggcgtcgaccgaccgttgaccgcaccaaggacgcgtggctcggctgacttggagccccagaaaagttgcctggagcaaaattttagttgcgtggagccgaagtttgggtggccacgtgtcgctcacccgctagaacggcgagcgtgttatcacgggcggatgacacgtagatcgcttactcgcccaagcacttgacacgtggacatacagacatgccctttcccttgtctatataagccgaactggaccccaattgttttgtgaagagaaagtgagcaaaagtgagaggctgccgaattgaaaccgtctgcaaattcaagttacggtcccatagccgaaaactctgcttgaatcattggaagcttcctgttggttactaagtgagttctggataatggtttaagttgcataatcatattctcatgcattctaaattgatttcgtgagttatatgaattgtgtaaatggttatatttgagtgcatatgtgatctttagattcttatgctaatgtttatggttgggaggttatgttgggatattgatgattctatgtgtttgatttaaccatatgtttcataatatcttaacctttgggatcttggtacgtggtgcttgtggtaggaggcaaagaccataagcgtgcaaagatcgtgatatgtctagctgatagtaggattcttactcaataaatcctaaaacactatcatgtcgttgtagtattttaggttgtcaatccaatccggtgtgatgcaaacagatgagatatgattagaaagttctaagtcaagccaagcagagagttggttggttctaatagtcctagtatgcaaaaacagaaatgaaatgaaactaaaagcaaaaatggcaataacaggtaggtgaataacaaagcagaaatgataacaggcagtcaaatggataaatgattcctaaggatggggttatcgaatagtttaaaaacattatattttaaaaaacaaatttgccatcaaacggcagatattgtgtaaaattacaagaatctgttgtaacataaaacaattctgtcataacattaaaaaattggttatcggttgataaaacttcacagaagctatccctagacaacaagttcaacaacagattaattcaatcccatgatagaaatcctcgagtaaagctagacactgacctaattcccattagcgatctctaactaagcaggcaatatcgaatcaacttgttaaagccaataccctctctacagccaatcccttggggtagaggcagatatctctgaaattaataggatccaacgcccatgaaacgccttctgagcgctggaagtcttgactcatattccacattagccagtgaaacaagcaataagcgcaacgaatccagaagggattctagtattctaaactcaaccacctaaagcgaccaagtaaaccacaactaatctatcccatcctcagaaatacgattcactactcagacataatcaaagacaatagcaaagcaacgattgaaaacatgtcaacagaaatgacgaatgacttaaacaaaaactgaatatcaaatacttaaaaatgaaaaaatacaaagtcgcaagagaaacactacggctatgaaagttgcaaaatgtaaaagtggatgaaaaacgagatgaaaaacgaaaaccctaagaggctacttatataagggaaaatgaaacaaataaggaaactagatatatagcgaatcttcacgtcatgaccctgcgatcgaatgtgtcattggcatctgatgggctgaaatgagcttccttatgattgagtatgtcattgatcaaactgggcttcagggactccaccttgcgatcgagtgagatgcagtgaagacgagattgaatggtccagtgaccctgtgattgagtgcgatcgagtggatgtcatgaggtggtgatcgagtagttgcttcggcttctcttcacttcttcgttctcatcttgtctggttgagtgcagaacgagcagataggcctcctggtgaacgagttattctgatggggtgattcttctggctttgcgattgagtgaaactgagctgctagcttctccggggttgggatagagtgatttgccctagtagggctccgaggctgcaatagagtacttttgctaaaggcgtcattgggcatccggactttctgttctgtttctcctctgtttaaactccaaaagcatccaaagtacctgaaaacaactaaatatgcaatgcacatgcaatcctaatgcaaaatcgtcccccctaagtatgcaaaacacactaaaacgactcctaatgagatgaaatatggatgaaacaatgacaaagtggtgaagaataaatgcctaaatcatgcaaattatagacatatcaactccccaaactttgtctttgctcgtcctcaagcaaacaagaagacataagcggaaggagaggtttgaagttggggattcaaaaccaaagcatgagatatgacaataaagatcaatgtaccagctaacagttctaagatacgaggtgatcgacttctacttaaaaactttagctatgctctattatgatccaaaacctacactcaaatgcacattgcgtcaagatcacccaatccctttaacattcattaagttcaaaaacatgaatcaagatatgcatcgctagtgaactcatttggctaatgacaggttatgagacaaagatggtccctttaactggttcagattttaataacaggggactctgaatgaaaaaagactaaactttagaagaatgctaaaggtaagtgccaacctatgcatacaagaatagcacctcatctacccaatgacataaaccgtgaataacaagtagatggtcctatctctaaacccaatgatgatcctaagtctaccattttgcactaaaggcatattttgattttttgttggatcaatgtttcttttcttttctttgactcttgttcttaaggagaagcttttcttaaactctatgaggctagtctagtgaattgggtttttctttaactcttatggctcttgtaattttttttttcttttttgtttttgttgccatctctttttttagagcatatcttcacaattctatgcttcccaaacattcactagacctcaatatgattttcaacttccttctcctaaagactctaacccattttatttttctttctttttctgcttacacccaatctcaatccccaattaagttcccacctagtcctaccaagtcccaaaacgcggattggaaccacatgagttactactcttgtcggctcaaacctaacacgttctaccaagctcaatcctgaaaataggcctcacatgctctcacaaaataacatggtttgaaagaagggttgggtaagggtgggggaactactccaataatagaagcaactacttggattaacaacagtggtgaataagtgaaagaataccaaatatgtattctatccacgagttcaaaaacgatgcaaacatgataattatgagtcatattcaagttcaaattgacagggaaaggtgtcatgacatgcatcgagtggtttctataaaacatggtgcgattttacttcaaagtcattcaaatgccttagagaactaataactcattttagtgaatcatcatgcttacaaggctatttcctcattatcccctatgcctatgcaacaatcctatatgaaacactctagactcgatcctaaatgtaatgcaactaaatgatcacttttttttttgtggaattcattttcaaaaaatttcattttttttgttttttctatgacttagatgatatgaagactcaaatgatattcacaaaaaacaagtcaaatacgtcttgaaccctcccccaaacttaaattacacagccccttgtgtaatcaaaatttgtgaaagaattcaagataaacacagaaacaaaaacaaaagcggtatttacaaatggttttggtgtgttacctcagtagaatgtcctggagatgtagtcatccatatctgtttgagtgtactcagcaggcacgagcggttcttgatgtgatctgccatctcctcgtcattgtgctcgatcgcaaccccaggaggttgtggagcatgacgctcatgtgttctccggggttgcgatagagtgatttgggcaattccactaggagaccactcgatctgaccacttccaggttgcgatcgagtagtttgacattgtcgttgagaaatatgtgtgtcccaaaaccactagatcgcactcccgagcttttactctcatcttgcgatccagtgattcatcaaaaaattgaaattttttatttgaacactcgattgcatccctgctgttgctccatctgttattcatttcctgagaatcaaaaacaaaaccaaaacaaataaatggtaactaaaaaaaataaaaactatatacagggataggactgggacttcctcccaagtgagcttgttttaagtctctagcttgactcctcacactcattaggctcaatgagggtgattgagtagaattgacgtctcttctccttccttagtagatacaacatcaaattcagcatactctcgtgacaggattgtaattgagtactcaatggccctttcttggtaagctcgtttatcatcatctggatagtcgtcttttctagactgttctaatgtgaattcacatccttcttttctaaccataggaataacttcatcatttgggatgtccttgatgtcgagtagtgcgtggttgactttcccatggagctccttaatttgatctttcagctctctcacagtgtgtgttagctctcttataatagctttgtcgtgccatttagacctctccttgagttctaaccaatcatttgatgccctcatgcttgactttaggtgtttagctgagcactctagtctagtatcaattgaggcttcctcgttcaatgcaacatgctctctttctaacccaatgacacctttaaagatctctgatcctggtactttgttgtgtgagtctaatgacatctcatagctcaaggtctcactggagaaaaatccagcttcactatttttggtcaaagcagtttgaaggtgatctttgtcaataagctcctctagcagttcattagctagttgacccatttcttcaactaagaaggtttgtccttctattgttggcttcttcatagtgttcctgatttcaaacttcattttgaaatcctccccgagattaagattaatttttccttgcttaacatctatgactgctccagctgaagccaagaaaggtcttcctaatatcagaggatccttagattcttcatccatctcaagcacaacaaaatcaatagggacctctactccattaatcattacaggcacatcctctaacaggccaaaaggtctccttgaagtcctatcagcaagaatcaaggttaggtcacaaggtttgtactgaacgaatcccagtttccttgccatagagagtggcattatactgaccgaggctcctagatcacatagagaattgctaaaagtcaattgcctaatggagcatggtagagtaaaagatcctggatcttccaacttttcttgaacaatcttctgttgaatgattgcactgcactcatgacttaataccaccattccttggacttctttgatcctttctgtaatcaggtctttcacgtacttgtgctcgttaggtattagcgcgagacagtccactaaaggcatatcctttatctatttttccaagagggcttcatattttgtaaccaaaactttcttaaatcgacgagggaatggaagtggaggtttataaggggtggcacgaagactgtatctttggtctttgcagttgtcagttttgcaacgaaggtagtaattggcggagcttgtggtcgagtgcgttgactgtcaaggatgggctcttcgattgttttgtcagccaaaacatcatcttgataaaattcctccccctctagaatcacactgtccttagtgtttgatgtagggacatgttgagtttgcagctgtcaatcatgtctgatagtgatggcatgggcagtggcatactcctttggattctagtttgcttttcctagaagctgtcatgggtttttgttaacagatggtgaagcgaggatgccttccacatatctcatcctagtgcctagtgattcaaacttgctgttaagttcgacgccttgtcggtcgactttgttgtttaatttagctagctttttagcgattttcattgctcatgtgacttgtccttgaatgagctgctagagaatagtcagtatgtctgaattctgaggcgcagttgcttattattgttgtggtgtgaaactaggtggtggctgctgttgttgatatcctccttgaaactgctgctttggaacaaactcttggctttggtagtaatgaacaaacggtttgggttgttctgctgctgctgctgctgaggatagacttggtcctgagggttggcgacattggtgcttctgtatgacatatttggattgggtctgtaattgttgtaccccatgttgtagccaccttgattctgaacatagctgatttcagcactttgatcattctccccctcttgcacttggaatggttcatcttgagagatgaagtgaacatgtttctgttgcacttggaggattttgtctagtttgtcattgagagctttcatctctctgcggtgcttttatcagagtcagaactggtgcagatgcttcttgcataatcttcattgtagttgtcatccgactgagcaaaattttcaactagctcccatccttcttcaacatcctttgttagaaaattcccatttgaagcggtgtcaagcagcatccttgtctttggcacgacgcctctatagagtgtgctgagaagagaagcttccttaaatccgtgatgagggcatttggtttgataacccttaaagcgctcccaagcttcacataagctttcattttgcttctaagtgaatccggatatctcattccggagtcttacagttctggagttggagaagaattttaccaaaaaggcctttttgcagtcatccaggtcgtgattgaattctggggtagcatcttttcccacagatgggctttatctccaagtgataatggaaacaagcgaagcttgaaaccatcttcactaactccattgattttagtaaggccacagggcctttcaaactcgtcaagatgatctagcagatcctccattggcaagccatgaaactttttcccctgaaccattgcaatgagacagcttttgatctaaaagttgttgttatgtactggaggtgaaacaattccatgacgctagttgtggttgtgagggaagtcatcagcaccaaagttggtaggtttctcttgctcatctacaatgtcagccattgtgtctatttttgtctgttatctcagttggcgagcagtacggtcgatgttatcgttgaataggaggttctgatttccttgtgaccgtgtatcgcctcctggtgatcgagtggttctgatgaggtgattcctctggcttcgcgattgagtgaaactgagctgctagcttctccggggttgcgatagaatgatttgccctagcagggctcctaggctgcgatagagtacttttgctgaaggcgtcattgggcattttgactttctgttctgtttctcctctgtttaaactccaaaagcatccaaagtacctgaaaacaactaaatatgcaatgcacatgcaatcctaatgcaaaatcgtcccctaagtatgcaaaacacactaaaacgactcctaatgagatgaaatgtggatgaaacaatgacaaagtggtgaagaatgaatgcctaaatcatgcaaattatagacatatcaactctcccaaacgtagtctttgctcgccctcaagcaaacaggaagacataagcgaaaggagaggtttgaagttggggattcaaaaccaaagcataagatatgacaattaagatcaatgtaccagctaacaattctaagatgcgaggtgatcgacttctacttataaacttttgctatgctctgttatgatccaaacctacactcaaatgcacactgcgtcaagatcagccaatccctttaacattcattgagttaaaaaacatgaatcaagatatgcatcgctagtgaactcacttggctaatgacaggttatgagacaaagatggtcccttttaagtggtttagattttaataacaagggactctcaatgaaaaaggactgaactttagaagaatgctaaaggtaagtgccaacctatgcatataagaatagcaccccatctacccaatgacataaaccgtgaataataagtagatggtcctctaaacccaatgatgatcctaagtctaccattttgcactaaaggcatattttgattttttcttggatcaatgtttcctttcttttctttgactcttgttcttaaggagaagcttttcttaaactctatgagtctagtctagtgaattgggtttttcttaaactcttatggctcttgtaattttttttttcttttttgtttttgttgccatctctttttttagagcatatcttcacaattctatgcttcccaaacattcactagacctcaatatgattttcaacttccttctcctaaagactctaatccattttatttttctttctttttctgcttacactcaatctcaatccccaattaagttcccacctagtcctaccaagtcccaaaacgcggattggaactacatgagatactactcttgtcggctcaaacctaacacgttctaccaagctcaatcctgaaaataggcctcacatgctctcacaaaataacatggcttgaaagaagggttggttaagggtgggggaactactccaataataaaagcagctacttggattaacaagagtggtgaataagtgaaagaataccaaatatgtattctatccacgagttcaaaaacgatgcaaacatgataattatgagtcagattcaagttcaaattgacagggaaaggtgtcatgacatgcatcgagaggtttctatagaacatggtgcagttttactttaaagtcattcaaatgccttagagaacttataactcattatagtgaatcatcatgcttacaaggctatttcctcattaccccctatgcatatgcaacaatcctatatgaaacactctagactcgatcctaaatataatgcaactaaatgatcactttttttttttgttgaattcattttcaaaaaatttcaatttttttttgttttttctatgacttagattatatgaagactcaaatgatattcgcaaaaaacaagtcaaatacgtcttgaaccctcccccaaacttaaattacattgtctcttgtgtaattaaaatttgtgaaagaattcaagataaacacagaaacaaaaacaaaagcggtatttacaaatggttttggtgtgttacctcagtaaaatgtcctggagatgtagtcatccatatctgcttgagtgtactcagcaggcacgaccggttcttgatgtggctctgccatctcctcgtcattgtgctcgatcgcaacccaggaggttgtggagcatgacgctcatgtgttctccggggttgcgatagagtgatttgggcaattccacaaggagaccactcgatcacactacttccaggttgcgatcaagtagtttgacattgtagttgagaaagatgttgtcccaaaaccactagatcgcactcccgagcttttactctcatcttgcgatcgagtgattcatcaaaaaattgaatttttttatttgaacactcgattgcatccctgttgttgctccatctgttattcatttcctgagaatcaaaaacaacaccaaaacaaatcaaaggtaactaagaaaataaaaactatatacagagataggactgggacttcctcccaagtgagcttgttttaagtctctagcttgactcctcacactcattaggctcaaggatggtgatagagtagaattgacgtctcttctccttccttcgtagatacaacatcaaattcagcatgctctcgtgacaggtctataattgagtactcaatggccttttcttggtaagctcctttttcatcatctggatagtcgtcttttctagactgttctaatgtgaattcacatccttcttttttaaccataggaataacttcatcatttgggatgtccttgatgtcgagtggtgcttggttggctttcccatggagctccttaatttgatctttcagctctctcacagtgtgtgttagctctcttataatagctttgtcgtgccaattagacctctccttgagttctaaccaatcatttaatgccctcatgcttgactttacgggtttggttaagcactctagtctagtatcaattgagccttcctcgttcaatgcaacatcctctctttctaacccaatgacacctttaaagatctttgatcctagtactttgttgtgtgagtctaatgacatctcatagctcaaggtctcactggagagaaatccagcttcactactttttgtcaaagcagtttgaaggtgatctttgtcagtaagctcctctagcagttcattagctagttgacccatttcttcaactaagaaggtttgtctttctattgttggcttcttcatagtgttcctgatttcaaacttcattttgaaatcctccccgagattaagattaattttaccttgcttaacatctatgactactccagctgaagccaagaatggtcttcctaagatctgaggatcattagattcttcatccatctcaagcacaacaaaatcaatagggacctctactccattaatcattacaggcacatcctctaacaggccaaaaggtctccttgaagtcctatcagcaagaatcaaggttaggtcacaaggcttgtactgaacgaatcctagtttccttgccacaaagagtggcattatgctgaccgaggctcctaaatcacatagacaattgctaaaagtcaattgcctaatggagcatggtagagtaaaaaatcctagatcttccaacttttcttgaacaatcttttgttgaatgattgcattgtactcatcacttaataccaccattccttggacttctttgatcctttctataatcaggtctttcacgtacttgtgttcgtcaggtattagcgcgagacagtccattaaaggcatatcctttatctattttttcaggagggcttcatattttgcaaccaaaactttattaaatcgacgagggaatgtaagcggaggtttgtaaggggtggcacgaagactgtatctttggtctttgcagctgttggttttgcaacgaaggtagtagctggcggagcttgtggtcgagtgcgttgactatcaaggatgggctcttcgtttgttttgtcagccaaaacatcatcttgataaaaatcctccccctctagaatcacagtgtcctcagtgtttgatgtagggacatgttgagtttgcagctctcgatcatgtctgatagtgatggcatgggcagtggcatactcctttgaattctagtttgctttccctagaagttgacatgagtttttgttaacagatggtgaagcgaggatgccttccacatatctcatccttgtgcctagtgattcaaacatgttgttaagtttgacgccttgtcggtcgactttgttgtttaattcagctagctttttagcgatttccattgctcatgtgacttgtccttgaatgagctgttggagcatagtcattaggtctgaattctgaggcgcagttgcttgttgttgttgtggtgtgaaactaggtggtggctgctgttgttgatatcctccttgaaactgctgctttggaaaaaactcttggccttgtgtaacgcccgtgtcccgagttagggagtaaccaagatcttacacacgccgaattcgaggacgaattcagtttaaggggggtagacttgtaacgaccgcgtcccgcgttcataaagaggccaggttgttttaggagaaaactagaccatggtcaagaaacggactaaaatacttagtcggaagaacgagaaagttcaagctgaaccagctaggcgagctggacaagctaggatgaactagctagctaagctaggtgcgctaaaccagctggaagactagctagctcagctaggtgagctgaccgacagctcgattgagctcagtgagctgatcgtgtactgacccagctgggtggtctggtcagctgacactcgagctggtggactggtagctcacaggtgaagaggtgtctcggccaaaaggtgtaaggtcaagcgggtacaaacgaacggttgcatcgccaaaagatgcatggaacagatgtgacctttcggaaggatgcaaggagcggatgtgacctttagggagggtgccaggaagggatgtgatgcttcgggaagcatccattcgccccctatataagggaggacgcccaacgatatctcacatcatctcacaacatccaaacaccattaaatattcttaaaggagtcccaacacatcctagagttgttggtcggaaagggggtgcggctcggcgagtataactcgaccaaactgatgcgcatgctacctcccggtccaacggttcgatggagtgtagaggatggagagggtagaccgttcgtcttaaagacgaatcggatccggtagaccgatcgtgggatcagatcggtcagaccgatcgtcagacggatcggatcggccagacggatcggacagaccgatcgtcggacgggtcggatgggacaggccgatcgtctgacggagcgggtcgaacaaaccgatcgtcggatgggatggatcgagaaaagtgttcaaggaagcacaaggataagtgcatccgaacacacccaagggtcgcccatggatgcaatcttaccggtaaagggagaaagcaccaagaatgggtaaggaacgtgattcaccatataggatcaacatcgcggccgccttcatgtatctatctcctcagccatggtgaaaccgatcagagatcggtaagaccaaagggtgactcgacgggtaaccaacgggaaagtccacggtgggaaccgatggacaaaacgaatgttggacccgcgagcaaacctaaggccgatggaagaaggatttcatgggctagcctacgatgatccagtggatgaatccacggactcttgggtgtgataaggatatagttcggatcgtatggatggatcaataagccgaaagctttatcgaccaccatagaccggacggataaacggttagtaaaccgtggacggtcgtagtaaatgaccggatcagaaacatggatggttcgataagccaagggctcaatcgtccaccatggaaccgaaggggagtacgtttggaggacagatggaccaataagccaagagcttgattcgaccatcgtgaaccaagggaatcgtatgatccccaatctctatcgttgtacttagactagtggggttggttggttgtatggctaagtaacgatagggattggttcatcaattcacgaccgatgacgagtcattgaacgaatggagtaaggcgacaaacgggctaaggaatcaaatccgcatattggccaaggtatgtaacgatctagcttattagttaagatagacgtttggtaattgaccgtgaaagtaggataaaggaatatgcgattgtttggcttagaatggttagcgaacatatgcatgtcttgaccgagtaaaggattgatctaagtctaagggacaaagacgatgaaaccggtacaagagttggttagagttaaaccaaggttagaaagacttccgctgtataataagagagcgattatagaatttagcctcgtaaaggcaattctatgttgaatcgcgaaaaattaagaggttcagccgggaagaggcgcgaacttgagtacaacgtcaccggacgccgatacgtccgggacggggtctcacaagttggtatcagagcatgcttgatcctaggatggataggtgctcgggaaaacgtcatagtaaggttctggcggataaggaagttgagggatcgttgtgtacggaaacggaaatagttacccaactcacgatcaggaaccaagatattatccttgtagtcaaaactcaaacatgacggaaaagtgggttgatatattcggagatggaccgatatcaatgaaatttggatctagtcgaaacttgactaagatcgggtacagacttagtcgggatttgactatttctggggttttgatcctatcggaaattgaccaagatcatggaaaaacgacaaggttggaaagagacctatgtcgggaatattgaccgagtccggtggggaccagggtcggaaatattgacaaagtcggaaaaagactttagtcgagaatatgatcgagtccgggaaaggaccaggatcagaaatttgatcgaatgtcggaagagacaaagatcagaaaacgttgatcaaatccaggaaaggacaaagattggaaaacgttgatcaagtccaggaaacgacaaagatcgggaaataatgatcgagtccgggaaaggaccaggatcaaaaatttgatcgaatatcggaagagacaaagatcagaaaacgttgatcaagtccagaaaaggacaaagattggaaaacgttgatcaagtccaagaaaggacaaagatcggaaaacattgatcaagtccaggaaaggacaaagatcgggaaataatgatcaagtccgggagaggaccaggatcaggaatttgatcgagtgtcgtaagagacaaagatcgggaaacttgatcaaactcggaaatagagatttgatcaaacgtgatatctaaagtcttggagagactaaagatgggaaagcattaaggagtaaacaagatcttacactcgctgaattcgaggacgaattcagtttaaggggggtagacttgtaacgcccgtgtcccgagttagggagtaaccaagatcttatacacgccgaattcgaggacgaattcagtttaaggggggtagacttgtaacgaccgcgtcccgcgttcataaagaggccaggttgttttaggagaaaactagaccatggtcaagaaacggactaaaatacttagtcagaagaacgagaaagttcaagctgaaccagctaggcgagctggacaagctaggatgaactagctagctaagctaggtgagctaaactagctggaagactagctagctcagctaggtgagctgaccgacagctcgattaagctcagtgagctgatcgtgtactgacccagctgggtggtccggtcagctgacactcgagcaggtggactgtagtagctcacaggtgaagaggtgtctcggccaaaaggtgtaaggtcgagcgggtaccaacgaacggttgcatcgccaaaggatgcaaggaacagatgtgacctttcggaaggatgcaaggagcggatgtgacctttcggaagggtgccaggaagggatgtgatgcttcgggaaacatccattcgccccctatataagggaggatgcccaatgatatctcacatcatctcacaacatccaaacaccattaaacattcttaaaggagtcccaacacatcctagagttgttggtcggaaagggggtgctacctcccggtccaacggttcgatggagtgtagaggatggggagggtagaccgttcgtcttaaagacgaatcggatctggtagaccgatcgttggatcagatcggtcagaccgatcgtcagatggatcggatcggccagacggatcggacaaacagatcgtcgaacgggtcagatgggacaggccgatgatctgatggagcgggtcggacagaccgatcgtcggatgggatggatcgagaaaagtgttcaaggaagcacaaggataagtgcatccatcacacccaagggtcgcccatggatgcaatcttaccggtaaagggagaaagcaccaagaatgggtaaggaacgtgattcaccatataggatcaacatcgcggccgccttcatgtatctatctcctaagccatggtgaaaccgatcagagatcggtaagaccaaagggtgactcgacggataaccaacaggaaagtccacggtgggaaccgatggacaaagtggatgttggacccgcgagcaaacctaaggccgacggaagaaggatttcatgggctagcctacaatgatccagtggatgaatccacggacccttgggtgtgataaggatatagttcggatcgtatggatggatcaataagccgaaagctttatcgaccaccatagaccggacggataaacggttagtaaactgtggacggtcgtagtaaatgaccggatcggaaacatggatggttcgataagccaagggctcaatcgtccaccatggaaccgaaggggagtacgtttggaggatggatggaccaataagccaagagcttgattcggccatcgtgaaccaagggaatcgtatgatccccaatctctatcgttgtacttagaccacttgggttggttggttgtatagctaagtaacgatagggattggttcatcaattcacgaccgatgacgagtcattgaacgaatggagtaaggcgacaaacgggctaaggaatcaaatccgcatattggccaaggtatgtaacgatctagcttattagttaagatagacgtttggtaattgaccgtgaaagtaggataaaggaatatgcgattgtttggcttagaatggttagcgaacatatgcatgtcttgaccgagtaaaggatcgatctaagtctaagggacaaagacgatgaaaccggtacaagagttggttagagttaaaccaaggttagaaagacttctgctgtgtaataagagagcgattatagaatttagcctcgtaaaggcaattctatgttgaatcgcgaaaaattaagaggttcggtcgggaagaggcgcgaacttgagtacaacgtcgccggacgccgagacgtccgggacggggtctcacaccttggttgtaagaaacaaacggtttgggttggttctgttgctgctactgttcctgaggatagacttggtcctgagtgttggcgatattggtgcttctgtctgacatatttggattgggtctgtaattgttttagccactttcattctgaacatagctgatttcagcactctgatcattctccccctcttgcacttggaatggttcatcttgagagatgaagtgaacatgtttctgttgcacttggaggattttgtctagtttgtcattgggagctttcatctctctatggtgcttttcatccgagtcaaactggtgcggatgcttctgtcataatcttcattgtagttgccatccgactgagcaaagttttcaactagctcccatccttcttcaacatccttcgttagaaaattcccatttgaagcggtgtcaagcagcctccttgtctttggcaagccatgaaacttgttcccctgaaccattgcaatgagaccgcttttgatctcaaagttgttgttatgtactggaggtggaacaattccatgacgctagttgtggttgtgagggaagtcatcagcaccaatgttggtaggtttctcttgctcatctacaatgccagccattgtgtctgtttctgtctgttatctctgttggcgagcagtacggtcgatgttatcgttgaataggaggttctgatttccttgtggccgtgtatgcatgcaacatatagcagcctggctatgaaagacgaatcagagatgtgtctgtaaagagggttgcaaggtaccaaaaacacaaagacagaaaaggcacaatgttagtaacttgtgtaacaaaaacgaacttgatcttaacgtttctaatgatctaaaatatagcaaacaaacaccaaactcgcaacggcaccaaattgataataggatttttagtcaattaatcctaaaacactatcctgtcgttgtagtattttaggttgtcaatctaatctggtgtgatgcaaacagatgagatatgattagaaagctctaagtcaagccaatcagagagttggttggttctaacagtcctagtatgcaaaaacagaaatgaaatgaaactaaaagcataaatggcaataacaggcaggtgaataactaagcagaaatgataacaggcagtcaaatggataaacgattcctaaggatggggtaatcgaatagtgtggtctccttaatctattcaggcggttgaaaaaacttcacagaagctatcccaagacaacaagttcaacaaccgattaattcaatcccgtgatagaaatcctcaagcaaagctagacactgacctaattcccattagcgatctctaactaagcaggcattatcgaatcaacttgttaaagccaaaaccctctctacagccaatcccttggggtagaggcagatatctctagaattaataggatccaacgcccattaaacgccttctgagcgctggacgtctggactcatattccacattagccagtgaaacaagcaataagcgcaactaatccagaagggattctagtattctaaactcaaccacctaaaacgaccaagtaaaccacaactaatctatcccatcctcataaatacggttcactacttagacataatcaaagacaatagccaagcaacgattgaaactaataacaaaaaggcttaaacgaaaattgaatatcaaatacttgaaagtgaaaaaatacaaagtcggaggagaaacactacggctatgaaagttgcgaaatgtaaaagtggatgaaaaacgagataaaaaatgattgccctagggaaaaccctaagaggctacttatatcagggaaaatgaaacaaataaggaaactagatatatagctaatcttcacgttatgaccctgcgatcgaatgtgtcattggcatctgatgggctgatatgagcttcccagtgatcgagtatgtcattgatcaaacttggcttcagggactccgccttgcgatcgagtgagatgctgtgaagacaagattgaatggtctagcgaccctgtaatcgagtgcgatcgagtggatgtcatgaggtggctatcgagtggttgcttcggcttctcttctcttcttcgttctcagcttgtctggttgagtgcagaacgagcagataggcctcttggtgatcgagtggttctgatggggtgattcctccggcttcgcgattgagtgaaactgagctgctagcttctccggggtttcgatagagtgatttgccctggcagggctccgaggctgcgatagagtacttttgctgaatgcgtcattgggcattttgactttccgttctgtttctcctttgtttgaactccaaaagcatcaaaggtacctgaaaacaaccaaatatgcaatgtacatgcaatcctaatgcaaaatcgtcctaagtatgcaaaagacactaaaacgactcctaatgagatgaaatgtggataaaacaatgacaaagtggtgaagaatgaatgcctaaatcatgcaaattatagacatctcattggcctttgtagtgaaccgtgctatcgtggggtcttgtaacaatgttacttgatcgccatgaagtgcgaagaactcagagagacagggttagctaccctggccgagtgtctacacgacggtgtaacgtttggtagtgatgctccggttatttacctttgtggttgtaacacgggagatcacgggagtgtgtgtgtttggtgttgggattgaaggcagcatatcgggctctttaaaacttaataaaaattagagtcttaatgcattggcatatttttgtagttgcttcgacaagctaccttttgttgccattatctgttgcgtgtttcatgttgggtatttgggttggggtaaactaatgtcagttgcagggaatcccgagctcactgagtaatcttagattactcatgattcaacttgtcttgtaggaaacccgtagtgggtaatagagggcgtggtggacaataggaaacccggagtagttttgtgccttttgtaaaacaagtgtgtttctattatgtaccatgcttttggcagtaggccctggccataaaacttataaatgtttggtaacatgttgtgtaatatttatacttatgaaataaatcgggttttttgtacaaattaacgagtaatgactgataatgacttagtccgagtcggcacaacacttaaatatcgaaagggttggcaaacttaaacgatgttttaagtgtgagagttgtcgtcaatacgccggccaagggttgagattggttcccgaacctcggttggatgttgatgatcaatctcaatgtggcattttcggggcgcccgagacttgtctggtcatagagcgtctcaagggcgttacaggcagccccgcggcgatcctcaaaaggcccaagagaggtcaaggaaaccgcgaggcagatgatgacgagccagaagctgctcgggggagaatcttcacgattttgggcgattcggctttttgtcaggacacaacagcctcaatcaaagcttatcagaggaagaccgacccaatccataacttgacccgaccgttcaacggacaagatgatgaagacactttccaagagagcgatactaacggcttggatcggccgctcaatgatcccttggtcataacactgactatcggtgatttcaacgtcgagcgaattttaatcgatatagggagtacgctggacatcattttctgaccaccccgcgagaaatgaagatcgatatgaccctaatcgtaccgactccacgacctgtgcttggttactctggtgagaccactatgaccctcggcaccatcaaattaccagtccgagccaaaaaggtaacaaaaattgtcaatttctctattacggattagccaaccgtttacaatgcaattatcagcatgccatggttaaatcaattccaagccgtcacctcgacttaccatctccggatggaatttcccacaagcaactacgtgaagaccatctgggggaatcagaaaaatgcctgaatttgcctcatggcagcgcacaaactcagaaaccccatcaccgaatcaacagccgaggggaatcacgaaaaggctaagctgggtcgagctgaagaaaaagcaatctccgagcagttatagcaattaaagatcaaggaggctcggaaatcaacaaagcctgaggtgtgtttgtctcgatgatcgaggaggcctagtaaacaacatagcaattaaagatcgaggaggcccagtaatctctatttgtctcgaagacgaaaaccccgagcagtgcgtggaaattggtggagacttaggcgaagaactaacagctgagctgacttccttcctcaaggataacgtcagcacttttgcctggttgccgtaggatttgcttggagtgagcgtcgaaatcgtatcacacgagctcaacgttgatccaacctttaaacctattaagcaaaagagaagaaaattgggtcgggaacgagcggaagctgtgaaagccgaggtagaaaaacttttaagaatctactctataaccgaggcaaaatatcccgattggctcacaaatccggtagtggtaaaaaagaagaacggcaagtggagattctgcatcgacttcactaacctgaacaaagcctttctgtaggatagtttcccactgccgcacatcgaccgcctcgtagagtcaacctcaggaaacacattgttatcattcatggacgcttttgctggatacaaccaaataatgatgaatcctgaggaccaagagaaaacggcattctacacggaacaaggtatttgctaccgagtgatgccattcggacttaaaaacctcgggacttatgatcttcgccttgcagatcaggaaaacgatggaagtgtacgttgatgacaccttggtaaaatccatggaagaaaaagaacatgtagccaatttgcgcaaatgttttcaacagctcaacctctataacgttaagcttaatccggtcaagtgtcgtttcagggtaagatccggcaaattcttgggatatctagtcacccaactcggcattgaggaaaacccgaagcaaatcgaggcgttattgggaatggcatcacctaagaacaaacgcgaagtgcagcgtttaaccggaagagtcgcagctcttaatcgatttatctcgcggtctaccgacaaatgcctggatttctacgatgtgcttcggggaaacaaaaaatttgaatggatgaccagatgcgaggaggcttttcaagaactcaagaagtatctgatgctccggttgcatactttgtggttgtaatgcgcgagatcacgggagtttgtgtgtttggtgttgggttggaaggcagcatatcttgccctttaatgcatgtgcatattttttgtagtttcttcggcaagctacctttcgttgccattctctgttgcgtgtttcatgttgtgtatttgggttggggtaaattaatgtctcttgcagggaatcctgagctcacttagtaatcttagattactcatgattatacttgttttgcaggaaacccgtagtgtgaaatagagggtgtggtggacaataggaaacccgaagtatgtttctattatgtaccatgattttgtaaagcaagtatgtttctattatgtaccatgcttttggcactaggccctggccataaaacttataaatgttaggtaacatgttgtgtaatatttatacttatgaaataaattgggtttcttgtacaaacttacgagtaatgactgataatgacttagtccgagttggtacaacacttaaatatcgaaagggttggcaagcctaaacaatattttaagtgggagagtggtcgtcaatacaacggccaagggttgggatattggttcccgaacctcggttagatgttaatgatcaatctcaatgtggcgttttcaaggcgccctgtgacttgtctggtcatagagcatctcgggggcgttacaatttgtggtataagagcatggttaatcatgctacaggactcgtatttttcaaaatgttttatcgagtaaatgagtcgcaaaaggcatttaggataatctggtctgttcaccattattaggtagatgggttaagtttaccttggttgaatggatgcagatgtctggtcaaagaacggagaggagtgtgtcgataaatttctcaccagtttacgaaaactggagtcagcatttcggtccggaagactgggtaccgtatgttggaggagaaggagatgagggatactattatcccaatatgtatggagcgcctgattgggatgttcccggaaccacaccggaatactccttaccaaggtctgtgcactatagcacatctgaatgggtcacactcggggatgagaccacatgttcctgtgaatcaacataccgcacacccaaatccgtcgcagccaaaagaagttaatgaaggaaatgcggaaggccgtaatgttcaaaatgtgccagagactcaagagatgttggggatgattcagaccttgttgactcacatgattcaacaacagcaacaccaacaacagatgcaggaaagccagcgtgcagaatctcctggagaaggtcttaaaactggttatgatgatgaaggatcttggtgttcggaagttcaaaggagagcaaaatactgttttagcggataagtgtttgaggaacctggaaatgaattttgaaacttgaaggtgcccggaagactttaagggccagatagcggtaaactttttagatgcggatgttcgagcatggtgggatagtgttgtttcacgataccgcgaccagcctatcacatgggaaatgtttaagaaggagtttgagtctaagtattttccacctgggcacgtgatcgtctggagctacagtttatgagtttggaacaagggcaaaagagtgtcagggcatacgagcaaattttttcaagacttcgaagatatttgtacaatggaagggatgatgaagctatgatggtacgaaggtttttaagaggactaaggcctgaaattaggggacgtcttcaggctgtgacttataccaatgtgagtgaattgactgatagggccgtgaatgttgaagaagggattgagttagaaaagggaaacaagtttcaggagaatgaaaagtctgaaggcaaaaaggggaataatgtagaatttcagcctggtgttttgaggactaattagtcgggaggacgaaacccgaataatgatcgtgggaagcctaaggttggtaaccaaggaggacgtgtaatgaccacttacgatccaagagcctgctatatgtgcggaaagccgggacattttgcacgagattgctcaacggtcgtacagacgaaagtgccaattctggcatttgttacttgttacatttgtggggagtcagaacatgtgtcaaatgcatgcccgaataagcaagcgggactacaggataaccgagtgcgagcttgtttcatttgtagagacctagggcattatgctaacgcatgcccgaacaggcaaataaagcagtataaccaaatggttaaccacccaccgccagttcagaaagctaagggaccaccggtaaagaagcaagccactctagcaaatgtttatgccttagatgtagaacctaccaaaccttcaggacccgcaaaagttcctgtaacaggttagtatgggttcttacttttcttatttatgcgtgtttgagtgattgatcgttgtgtgcgtagtttactagattaaatattgcatacatcattttcatttgcattagggacattacttgttagtggtaaccccacacatgtattgttcaatttgggagcgacaaatagttttgttagttctgacgtggccgataagtttggccatgggtatgagaaaagagaagtgaatgttttggtacatactgcgggaaatcagccacccttgcagacccgagttgtgttagtaggagttccagtagttatccaggatacgattctacaggcaaaccttttgggaatgccgatggaaaggtttgaagttatctttgggatggattggttgtcaggatatcatgcccatttagattgtaggcggagcagagtagtgttcgaactaaggaatcgaccacgactcacttactgtggaatcaatccaagtaagattgcttcgttcgtgtcagcactaaaggttgagaatttactatgggaaggagaagtctaccttgtcactttaaccgccattggtggagaagttgaaggtgactcaaggattgaagagatcccagttgtgaacgaatttgaagatgtgttcaagcccttggaaggattacctccaccgagaaatcatttgtttaccattaatcttgaaccgggggtgactccaattacaagggcaccatataggatgccaccagttgagcttgcagaacttaaaaaagaattggaggatctactcgaaaagagatttattcgtccaagttcatcgccatggggagcttcgatattgtttgttaagaagaaagatggaagtatgcggttatgtatagactaccgaggtcttaacaacatgaccataaggataagtacccattgccacgagttgatgaactattggatcagttgagaggagcaagttagttctcaaaaattgatctagcctctaggtatcatcaaatttcaatcttggagctggatgtaatgaagactgcctttcagacgaggtatgggcaatatgaatttgtagtcatgccatttgaacttacaaatgcacctccagccttcatgagacttatgaacgaggtactccatgattatttggatagcttcgttatcatatttattgatgatatcttggtatattcacggagtgcggaagagcatcgtgaacatcagtggaaagtgttggatagacttagggaacaacggttgttcgctaagtttagcaagtgtaagttctggcaacgagaaattggatttcttggtcacagaattttaggacagggagttacagcggatcctgaaaagattgccgtaatacagcaatggtcgcgacctacatccgttacagaagtacggagtttcttaggattggcaggctattaccgtaagtttgtcaagggattttcgtcaattgttaagcctttgacccgacttactggtaaaggtgtacccttcatatggagtaaggaagttgaggaagccttcgtaaagttgaaaaagacattaacgaccgctctaattttagcattgctagagccgaataaaccatatgatacggatgcctcaagagttggcttgggatgtgtcctgatgcaagaagaaaatatgaatgcctatgcgtcacgataattaagacggcatgaggagaattatcccactcacgatttagagattgccgctgtagtatttgcgttgaaggcctggagatcatacttgttcacgctgccagacctgaatctacgacaacggagatggatggaattaatcgccgactatgatttggagattcagtatcatccgggaaaggctaatgtggtggcagacgccttaagttgccagaaaatgaaagtaaatgttggaaaggatctagagtcgttaactgatgagttaaagaaagtaaatctgttagctttagagggtgaatctagtgagcccttgggtttacaagccgtgactcaagcaaacctacttcaccgaatccgagaagaacaagtacaagatgaaaagttatagaaaattgcggaggagttaaaaacattagatagaccaaacgctagtggctaccatctagctgatgacggcaccttattactcaatgggaaaattacagtgcctgatcgtaaaggattacgacaagaaattttaagggcggcgcatacttctttattgagcattcatctgggaagtacaaaaatgtacaaggatataaggaagtattaccattggcctgggatgaagagatcagtggcaaaatgcgtaagccaatgtgattcatgccaaggagttaaggtggaacaccaagtgccggcaggtttattgtgtaacctaccaatccctggatggaaatgggagtcaatctcgatggattttatcactggattaccaacaagaccaggacgtagcaatgatgctatatgggcagtagtagatcgctagaccaagatggctatttggtatcaatgaaaagcgcaaataagtcacctatcctggcagaaaagtatattgatgaaatcttaagactccatggagtacctgctaatatagtatccgatcgagatcctaagttctcatctatattttggcaagacctccagcatgctttagggactgatgttcacatgagcaaggcattccatccgaaaattgatgggcaaactgaaaagaccatcaccgaaccatagaagatatgattcgactatgtgcactagagtgggctggtgattgggaagactacatacctttagttgaattttcttacaataacaactatcactcgagcatcggtatgtcgccatttgaagcaatgtatgggaggccatgtcgaactcctctttgttggactgaagtaggagagaggatgagttttaataatcggttgatcaatgagactgcggagaaaattcagttcatccgagacaatatgaagaaagctcaagatcgacagaaaaactatgctgaccgaaagaggcgtgaagtggaattccaagaaggcgacatggtttatcttaaggtaactgcgttaaaagggaaagatcgttttggaaaagttggaaagctcgcagtaagatttattggtccatacaaaattgagaagagaatcggggaggtaccctaccgtttgtttatgccagaagaaatgcgagtacataaagtttttcatgtgtcgcaactaaggaagcacgttccggatcctaatgctatcatacccgagccgatacaagagttgaaaacgaatctcacctttcccgaaatccctcttggtactggtgaaagaagaatgcggagataaagaatagaaggattctacaaattcaagtgttctggggaaggcaaaatcgtaaggttattacttgggcaaatgaggaaaagttcctcggacaaaatatccacagtttttcgaaccacggaatgctgaggatgaagtcggaccgtctaatccttctggaatttgggacaaattctattaaggggggggggagaatgtagtgacccgcgtagagacatcggccacaagcaagagtccaaattttagaaagttgcccgaatgcatggccaattgaccttaagtgcccaaaacacaatacactatcaaagggaaaatatgggcaagtttgggcaaaaatgggcacgaatgggcaagtttgggcaagatcgggcgtgctgcgggcaaagtttgccccaccaggcgttgaccgaccgttgaccgcgccaaggacgtgtggctcggctgacatggggcccaagcaaagttgcttggagccgaattttagttgcgttgagccgaagtttgggtggccacgtgtagctcatccgctagagcgacgagtgtgtcatcacgagcggatgacacgtggatcgctgactcgcccaagcacttgacatgtggacctgcagactcgcccttttcccttgcctatataagccgaacacgaccccgattgttttgtgaagagaaagtgagtggaagtgagaggctgccgagttgaaaccgtccgtccgattcaagttaaggtcccatagctgaaaactttgcccgaatcgttgaaaactttttgttggttactgagtgagttctggataatggtttaagtttcatattcatattctcatgtattcttgattgattttgtgagttatatggatcgtgtgaatggttatattggaatgcatatgtgatctttagattcttatgctattatttatggttgggaggttgtgttgggatattgatgattctatgtgtttgatttaaccatatatttcataatatcttaaactttggggtcttggtacatggtgattgtggtaggaggcaaagaccataagcgtgccaagatcatgatatgtctgaccttcatagtgaaccgtgttatcgtggggtcttgtaacgatttacttgatcgccatgtagtgcgaagaactcagagagacggggttagctaccctggccgagtgtctacacgacggtgtagagtttggtagtgatgctccggttgcatacctttgtcgttgtaatgcgggagatcacgggagtgtgtgtgtttggtgttaggttagaaggcagcatatcgggccctttaaaactcaataaaaattggagccttaatgcatgtgcatatttttttgttgttgcttcggcaagctacctttcattgtcattctctattgcgtgtttcatgttggatatttgggttagggtaaattaatatctgttgaaggaaatcccgaactcactaagtaatcttagattactcatgattctacttgttttccaggaaacccgtagtgggaaatatagggtgtggtggacaataggaaacccgaagtagttttgtgccttttgtaaaacaagtatgtttttattatgtacgatgcttttagcactaggccctggccataaaacttagaaatttttggtaacatgatgtgtaatatttatacttatgaaataaatcgggtttcttgtacaaacttactagtaatgactgataatgacttagtctgagtcggcacaacacttaatatcgaaagggttggcaagcctgaacgatgttttaaatgggagagtggtcgttaatacgccggccaagggttgggattggttcccgaacctcgattggatgttaatgatcaatctcaatgtggtgttttcggggcgcccgtgacttgttcggtcatagagcgtctcgaaggcgttatagacgtcctcaccgagatcaaaccgggcccttaggtccaaaagcgaccgctcagtgcacaaagatgaaccaggaggatccggtagtatcgcctttttgctcttcttcttctttttcttctcggccttctcaaaagccctctgctcggtaattcacatgatatcaactttctcatttggaccaaaataaagataatcctcgatcttcacctgcggcaataagggctcggatgtgccctgccagttcgaagtccctgcttcagcaactaccggagctcgggtccttcagagaagagacggctcggggtcctcaggcaaatctaactcccgagcgatatcggcagtagcatcttcccgagccgtgaagggaatagcctgctcggaagcatttgaagacgacaccgcgtcgccctccgacgatgtccaaaccatctttcgcttgtagataggaggaagatcgtctcggtgatttgaatcgcttgagtcaacgaggtaatcgctgggggccaaaggataggggttagagtacgaagaactcattctcggctcggaattgtctaacgcaatgaggatcggagaatagaaattttctaataggcaaaaccaaaactaactcagaagcggcggagcttcaccggaaaaagagagaattataaggaaatcaagatcagagagaagagagcaaaccttgaaatttttcttcggaaatttcaaatgagaatttctcaaggaggtggctcgatatatatagaacttttaagggcccgtcgggtccacaacaattggtgaaacgcgttaaaagcgcgtgggctcggtagagaaagatacgtctgcgtgatcctcgggaataagcaagaaacgtttccacttctcaagaaatagtcggctacacgcaacagaagtttgaccgtccaggaagatgaagcgccagagttatgatgcgggaagaggtacagtcggctcgatcacccactcatgaagctcatcacctcttcctctaaagtcaatgagctggagggcatactgttggagtcggatttcacccaggtaaccgagccgatcagacagatgccacaagtgccgctagagctaaatttgccgtctccccgaggcgggaacgttatcctttatggctcgggcgtcactccagaaatatacccgagccggtcctcgaaacacctcgggcaaacatcacccgactcggtggttatcccagaagatgcttgagctgagtttgacaacgatccgaggactggtttgacctggctcggatgaactcttggcccgagccaaagacacacgtacgtccgaggagaagacttgtgaactttgaaggggccaaaatatcatttccggaaaacctggaaatgatattggagaatctccgaggatattatcaaatctggaaatcttcctgatgttcccgaagaataaggaaaatctccatttatgaaagatcttccatcgccgactccgagataaatgaaaatcttccaagaatatcgcgagagacggtttatcaaagacctatataaagcgcctaatagaataaagaaaagggggagagaaaaaaggctctcaacttcaggctattaaaacgctctgactttctaaacacttgtacgatcgaatcatcatcttttcaataataatatcaagaacaccgtccgcgttaatcgaataattctgttgttctttgagagtctcgcaaagatctgctctttgaagaaaccctaaatacaatttcggttgtgtgagtttcgactctcacaatctcctcctccaaaacctcaagatttcatcaataagagcttaagatttcaaaaaattgttttacggttaagcaagctacgagtttctcgtcgagcgcttgttcgttcttttgatgattgtgcaggaaaagaagtattccacccatacctaagtcccaccctgctgatgcttttgtcttcctagatagacctcatgcgctaactgcttatacgccagcatggatgatgagaggtctttctccgcgatatttactgctaccttttgatctagcttaaaagagttcgacattaaaaagatagatgagtttataatgaggaaatacaagagtttaaatagagaagaagagaaggggaagagttagtcttggaacaagctccaagataactcggaaaaggagaaatcataaatgaaattttgaccacaaaatagacccatggccttccaaattcgtggtcctcttagtgggcttgggccggattgataagggaggatttggaagtgttacttaggcctcgttaaaaacctactaaggaaaacccaatgggacaaaaccttagcagggaaaaatagcacccaaagcaacacttagcccattaccaatcgtcttggaaagatattgcaaccatcatggttcatgtccaagtgtttgggtagtccgaaatagcttggttgagaagtttggtcttcgagcgagtcatttgtcttcttggttcggccaacgcttcctccactacatgctgctcctcggctccaagttgttcctcggctataagctgctccgctggttcaagtttcgggtggtgctcgggaatagtcatatcatgctccccctcttcaaaaggatttgcccttaaatccgtttcacctacatcaaaaggaaaaatttaggcacaacgaacaagaaaaagcataaatggacattagcaaagtagtattttagagtggagcatccttttgcaattgtggtcgtcttccttaagtacttccaattccaaactccaaagagatgcgtccttgcttcacttgctttacttgctttcatttcggaccaagcttgatccatgtcttcttttgatccataatcaaaaggattagggaaaccataactcttcctaatgtttaaaatcgcatccttaaccggtttttcattatctttcacaaacactaaaggaaacacattaaatgtgcgtgagaaaccaaatagctccctatgaaaatgtttaaacatgctttcacaacctaaaacatttgattccaattctaaatgaattccactttcatagaatgatccaaaaacacaaaaatcagtttaaagcgaaattttcacacaagggaacacttcatacaacttaggttcatttcgagctctaataagattagatatgctaccaaactcaaaaacactcaaagaggaattaatttcatgcaagtcattagctaaaagatctttcggttttaaaatagtttcaagtgtgaggttttcaaaggtaggaatcatgtcgctaaacacaggacttgaaactctaaattcctttactttttctaaaccaaaacgtttttcttcttgagtagaaaccaacacaaaccaagtaggctcctttctaaataaatcaatttccttatagtgcttttgttcgtattcatttgacttaaggattggttctgtaatggagatagtttgttgctccaaatcggtaacaatcgatgacaaactcctttgaccttctttttgagatctttcttcaagaacctgcgaaaaacaagacatactactcggttgcaccggctttgaaaagattagtttttcacaagcttgattatttcaagcacaaaatcagttttctcataaagatcacaagtatctttggtaaattcggaaggaagagcaatcttagctttttttgaattagaaggaagaggatgcttggctttcttcagtttgttgtaagcgttgagaatcataagaagctcatcctttaactgttcatttgaggatagactttcctttcggttttgcttcatggtcttaacttctttcacatcattaggttgttgtctagcttgctcaaaacgtctatgatcatcacgaatatagtagtaacaatttgattcatctttggttggtctactcctccaattatgcttctcttggggtctatttggttttgcctctttttgatgcgagatctgctcatattgctctattcctttgagttggtcgttgatcggcttatgtttggcatcaattattttctccatttgtaacgtgatagcatcgatgatggcttggtcattaacactcactcccgagcttgatttggatgtcaccattcctgccaacaaacaacactaaaccagtcactagttcaaggagaatatcaaacgtttttctaagaacaggcaaactagatcgaacaaaataaattatcaaatcatgctcaaaaattccagaaacaattgtataaattactagactcgtcctagattcagatccaattgatttcgcaattttatcccaagccagttatttatgaaaattaaagcaagatgacagcgaagatgaaaagacagatgagaagatgaacgaacaaaatgaaatgaggtgatgaaatgatgaatagaataaaacgaaatgatgaagtgatgaaaggatagagtactcaacttcagaatgtgctctgataccacttaatatgatttccctaagatcgacactcttgaggttgagtaggggatagactttgcatctaagagatcatgagatcactcaaaccaaaggatatggagcgaatggtcacacaaaggatgcggatggcctttgatataccttcgatctagcttaaaagagtttgagattaaaaagatagatgagtttacaatgagaaaatacaagagtttaaatagagaagaatagaaggggaagagttagtattggaacaaactccaagacaactcggaaaaggagaaatcataattgaaattttgaacacaaaatagacccatggttttccaaatttgtggtcctcttagtgggcttgggccggattgataaggggggatttggaagtgttacttaggcctcattaaaaacctactaaggaaaacccaatgggacaaaaccttagtagggaaaaagagcacccaaagcaacacttagcccattaccaatcgtcttggaaagatatcgcaaccatcatggttcttgtccaagtgtttgggtagtccaaaatagcttggttgagaagtttggtcttcaaacgagtcatttgtcttcttggttcggccaaagcttgctcctcggctacaagctgctccgctggttcaagttccgggtggtgctcgggaatagtcatatcaggtaagaatgtttcccatcaccccattgttatacattattaggaatgatcaattataaaggttggatatatttcgagggtgtcaatccagttggcgagttcccctttgtttactctttaaaaagaataagttttgggggagagaaagaataccaaaataaaagaaaatataaagaatggtcaatttatcatagtatagtaaatgaataagtctagaaggttcttgaatattagcttgtttgatgagacccagcgatgaaagcatggtggatatagttgtggaacttaggtacggaatctagaatgttgtgtaagcttggagagaagtacatgttggttaggatttgaatagaactgctaggcatatggatttggttagaatgatcatggcaataggctagagaatgttgggagttcttgtgttttcaaacctcttccacgggttcagcttttgtgttttgcttgagggcaagcaagagctaagtctggggagttgatataaccctatttttactgttttaactatgttttagatataggattttgagtctttttgttatttctagagtcttttctagtgttttacaggtctttacatgtttgggattcatttggagataatagagcattctggagaaaacaaagaatttatgctgtagaagaaatccgaatactaaaaatcgcgtaggtgtcgaacgacactaatacctgacggcaattcaaagacgcaacttattgaagttttgaagatttccaaattcggcccagaactttcccttatttctaaagaaggcccatcacgttttaggtcatagatatataattttaaagttcattatttagacctaagcttggagaggctaatctccttatctcttttgtacttgggagcaaaaccctgtggagactcgctagagaagatctttcttactctttcttttgttattttcattattgatttcttattcagactttaatttgtgttcctttgatcatgtttgagtagctttcttgttaggtttagggtttctcattaaggatttagatgatttagtagattgcccccttgctaggttatctgttaggattctttatcttagttgttcttgttcttaatgctagttctagagtagctaactagaacttgattccagataatagatatacccgccataagtatcttttatttgatgagcctgctctataggtgtgtaataagaatcggcctatttactaaggtgactttattgaattcgtttataatgcatgattaagtataagatttctcggcttctctggttattcttagctctaggcatagggagtttcacggaccgccaccggttattccacaataagagttagagtttatgaacggtttgataacaacctagctatcactagatatactaatcatctaccctaagcctgactatttttccatctaatttacatcttgatatttattgcttttctttgcttcttaatttataatctactggtttagcttaattcgatatccatatagtctattgtgtgattcgagagctttgtggaattcaaccctgaagtactacaatcgatctcttatttgagagagtggtcttaaggcaatttgacctacattagaactgttcggctttgggtctttttttcttctaaaactcttaaaaccgtcttggctcgcaaaatacatgttcatctccttcgtggctctaaaatagcaccaaattgtctctgaaacataagaaaacaatacctaaaacgggctaaaatgctgtgttatcacctgtttgaaaacccaaaaccaaaaacacaaaggtactttagctacagcatcaaagctttgagaagtaagaaaaagctttattacggtttttgtattcaaatatgattagatttcatttgtatgattgtatataaggactagaatcacaaccaaatcgcgaaagctaaagtagtgtttccatgttagaagatccaaaacggaaaactcaaaggaactttggcaacacggtcaaagctttgagaagcaacggaaaggttggttagcgttttaaagtcaaatatgactaaatgttgtgtatatgattgagtataacaactagaaccgcaagcgttcccgaaacttaaagtagtgtttccctgttagaagatccaaaaccaaaagctcataggcacttcggcagcaccatcaaagatttgagaagcaagaataaggttggttagtgtttttggagttgaatatgactagatgtcttgtgtatgattgagtatatgaactagaaccgcaaccgcatcccataagctaaagtagtaattcctggttacacgatccaaaataaaaacacataaggacttcggctacaccatcatagctttgagaagcaagaagaagcttggttggtgttttggagtcaaaaatgaccaaaatgtcgtgtgtttgattgggtatacgaagtagaaccgcatgtggaacacaaaagctaaaaggtctaataccaaaaaatcatagagactttgttagcgtcaaagctttaagaagcaagaagaagcttctttagcgtgtttggagtcagttttaactagatcttgtgtgtatgattgagtataagaactagaaccacaaccggatcctgaaagttatagtaatgtttccctgttagcatttttggagtcaaatatgactacatatcgtgtgtatgattgagtatgggaactagaactgcaattggatccacgaaactatagtagtgttttcctcttagaagattcaaatccagaaactcatacggacttcgactacaccatcaaagcttcgaaaagcaagaagaaggttggttagcgtttttggtgtgaaatatgactagatgttgtgtgtatgatagagtataaaaactagtaacgcaattggatcccaaaagataaagtagtgtttcattgttagaagattcaaaaccaaaaacatcatacggactttggctacaccatcaaagctttgagaagcaagggaaaagttggttagagttttggagtcaaatataagtagatcttgggaaaatgattaaatataagaactagaaccgcaattggaatctcaatggtaatgttgtgtttccctcttaacagatccaaaaccatattatcattggtacttcggcaacaccatcaaagcttgagaagtaagaagaagcttggttagtatttttggattcgaatatgactagatatcgtgtatttgattgagtatatgaactagaaccgcgaccgcatcccataagctaaagtggtaattcctgattaaaatatctaaaggaaaaacacgtaaggacttcggctacatcatcacagctttgagaagtaagaagaagccttgttggtgttttggagtaaaaaatgtccaaatgtcgcgtgtatgattgggtataagaattgtagaaccgaatgtggaacacaatagctaaattagtcttttcttgttaaaaggtctaataccaaaaaatcattgtgacttggttagcgtcaaagcttgagaaacaagaaaaagctgggatactgtgttttgtgtcagttataactagatgttgtgtgtatgattgggtataagaattagaaccgcaaccggatcctgaaagataaagtagtgtttcctttttagaagatcaaaaaccaaaactcataggtatttcggccgcacgatcaaagctttgaaaagcaagaagatgctttgttagcgtttttggagtcaaatatgactaaacatcgtgtgtatgattgagtataggaagtagaactgcaatcggatccacgaaactatagtagtgttttcctcttagaagattaatatacctcgatttttactggttttagctatgatttaggtatagtttttagagtccttttgttatttgtagagtcttttctagtcttttttagatccttacatgtttgagatgcatttggagattatggagcattctagagcaaaacagacaacttaagctgcagaagcaatccggagacaaaaattgacgtaggtgtcgatcgtcacaacccccagtgtcgagcgacaccaatacctaaaaccaattcaattgcgcaacttattgatgttttgaagatttccaaatttggcgcataactttctcctatttgtaaagaagtccctgcacgttttaggtcatatatatatagttttaaaggtcattgtttagacctaactcttattatttattctgtacttgggagaaaaaccttgtggagactccctttagagaagatctttctaaactctattctcttattgtttcttacattgattttttattcaatcaagatttgttcttctatgatcatgcttgagtagttctattgttgggtttagggatttggatgaattagtagatcgaaaaccctgttaggataatatttttagaattcttcatcttagattgttcttaatgctagttttagagtaactaactagaacttgattttaggataatacgtatgcccaccataggtatctattactggaactatcttagatgagcctactatttagatgcgtgctagctttgattacttaggtgaacttatcaaacctgattataatgcttgcttagttctagggatttacaagagagttgggatcaatactattaagcatagtaagtttcgcggaacaccaccggttactttatattagtgatttgtgttctagaatggttcgttaataatcctagtttactgctagatcaactattctgatattttcttagaattttcctaaacccgacgtcttaatcatctgaatctacaaccaattttaattgctttcttgtcttttacttttacaatattttctgtttagctttattcaaaactgttaatctattgtgtgatccgagaactttgtggaatttgatccctaagtgttataacaacctctttatttgagagagtagtcatttgggtaatttgactcatattaaatttggcgcatttgccggggatttttcttcgattcaccattagattaggtgtagaatttagtttaagcttttcttttcttttgttacttacgcgtttttatttctttttcttcttgtgtttcagaagtttaaagaattcaaacgcaactcaagattctgatagtaatacctgatgctgctggagtgttacgcgacaaagcttgtcagcatacaacgaagagggtcagaaaatagatgaacagtgaaacctgataccagaaatcgttgatggtgtcgatcaacaccatatgggtgtcgctcgacaccaagaagaaatcagagcagatggtcgtcggaggactcttgatgactacaacagaccggatctcttctattccaatcggtctgcaatccgaccacctacattcgaaagaagcgattttgagataaaccctgctttctatacactcttgtgagtacccacccttttcatggtctagcacaagatcatcctatcgatcatattgagcagtttgaagacttggtttcgagtattaaggcagaaggtgtttcttctgactaccttccctgcaagctcttcccatattctggggatgcatcttcttggcttaagcagttgaagcctggatctctgacaacttggaaagaaataaaggttgcttttcttaacaacttttataatgatgcaaggtccgaggagctgagaatgaagatctctatcttctctcaagaagcagctgaagaatttaaagccgcttggatcagattcagagcattgacgttatcagatggcattggatgcagctagtcatgggaatttcatgtcaagatatccagaagatgcaacaatgttgattgacaacttagcttccaacattagtaccaaaagtgttgacattgcaaggaaaacgcaagttcagtatgttgcacatgttgacagtttagccacttcagaaaagatggatcaacagagatacatgagcttcaatcagcaatctacacatcaaaaaccggttcagcaaactacaagcttcattcagaatcatgcttcttcaacacaagcccaccctccacccgacaccactaaaacgatcgaatctatgctcgaacagattctcaaaggtcaagagaagcaaacaacagattttgatcacaaaactggttgcattatccgacgatgtgaatgggaagattcaaatattgaacaattggatcaagcaattgactacaaacaaagaagatgttcgtgctattgacttaaggagtggaaaacagctaaatctagtgcttcaacgagagcttcctgcagccaaaattgtcaatttggaagaaaatgatgttgcagtttttgcagactagacaccagtgtcgatcgacaccagccaacacagacactatagaacccgacagtgtcaacctacatcaattgtgtgtcgatcgacaccaacccagtccagccttgcgaattctctaaaacccgatttcagctgcagcaaaggtaaccaaacccaaggttccttttcccaagagtcctaggaagtccaaacaagagcttgatgatgctagatgcaaagttatgatggataagctgattgtagagatgccacttatagatgctgtgaaatcttctcctatgatcagacagtttgtgaagaggatcgttactaaggatatgcttactgagaccgttgtgatgacgatgtctacacaggttagcgacattattcagaacaagattccacagaaacttccagatcgaggtagcttcgttctcaattgtggtatccttaacgagagttttgatcgatgcttgtgcgatcttggttctagtgtcaacttgatgccctgttgagttgcgctccggcttggtttgacagatttagagcctacgcaaatcactcttgttcttgctgatcgatctgttcgtagatccgatggtatcatatgcgatgtccctgtacaagtcggtactagctacattcctacagatcttgtggttttatcttatgagaaagaacctaaagatcctctaatcttgggaaggcctttcttagtcacaactggtgccattattgatgtaaggaagggcataataggcttgaatgtaggtgatcttacaatgcagtttgacatcaataaggtggttaagaagcctaccatcgatgggaagactttctatttggatactatctcttttttggctgatgaatttctcatgaagatgacacttgctgttcctttgaagcatgctctgattccctcaatagacaaagttcccaaagggtatggtaagctgctggataggattgagcatgtaatgcaattggttgctcaagaggagttaattggcacatcttcccaagcagcaacaattggcgattggagcctagaaaaagctcctaaagttgatctaaaaccacttcctccagggctaaggtacgcatttcttggtgaaaactctacttatcatgtcattgttaatgcttctttaaacaaggtagagctcactttattgctaagcaagctgcgcaagtatcgcaaagctcttggctattctcttgatgatattacaggtatctctccagacttgtgtatgcataggattcacctcaaggatgagtctaagccctcagttgagcatcggcggagactaaacccgaatctcaaggatgctgttaagaaggagatcatgaagttgttggaagttgggatcatctatcctatttaagacagtgattgggttagtccagtgcatgtggttcctaagaaaggaggtgttagagttgttaagaatgacaaaatgagctgattcctatacggactgttaccgggcacaggatgtgtattgactgcaggaagctgaacgctgcaacaaggaagaatcattttcctttacaattcattgatcaactgctggaaaggttatctaatcacaagtactactgcgttcttgatgggtactcaggattctttcagataccaatccatccagatgatcaggagaagaccatgttcacgtgtccctatggtacttttgcttatagcagaatgccatttggtctatgcaatgctcctgcgatatttgagagatgtatgatgtcaatcttcacagacatgattgagaatttcatagaagtctttatggatgacttttctgtttatgggtcttcatttgaagcatgcttggagaaccttcgcaaagttctagctagatgtgaagagaagaatttggttcttaattgggagaagtgtcatttcatggttcaggaaggtatagttcttggtcacaaagtttcaggtgctggtattgaggttaataaagccaagatagaggttatgacaagtttacaggcactagatagcgtgaatctgtgaggagttttcttggacatgttggattttacaggaggttcgtcaaggatttcagtaagattgccaggccactaacagctttgctttgtaaggatgtgaagtttgacttcaattctgagtgtcatgatgcttttaatcagattaaaaatgcattagtgagtgctccaatagttcaacctctggactggaatttaccttttgagatcatgtgtgatgcaggtgattatgcggttggagctgttttgggacaaaggaaaggcaataaactacatgctatccactatgcaagtagaacacttgatgatgcacagaggaataatgcgacaacagagaaagaattgttagcagtggtgtttgcttttgacaagtttcgctcttatctggttggttcaaaggtaattgtgcatacagatcattcagcactcaagtaccttatgcagaaaaaggatgctaagccaagattactacgatggattcttcttcttcaagagtttgacatcgaagtacgggataggaaagggattgagaatggagttgctgatcatttatcaaggatcaaggttgaagatgacattcctatcaatgattttgttaggaattatgatctctctttcgagtttattgcttgaattgcttaagtactgcagtttcaaatcaatccgactaatgaaaaatccagaaggccaaccaacaaacttaaggacatccattcccaacataatatacagaggctggagctaatctcattgctcttccttttacctcatcaaaacagttagtgttcgtaggacttgactcattgttcatacatgataaatcgactaatgtgataaaaagaaagtattcctctcccttgaaagaaaaaaaatatatatatatatatgtataataatgagagattgacatgattttcagatactgtataggggtatgaatgtttcctatgaccccattattatacattgtttgaaatgatcaattacaaaggttggaaaaatgtcgagggtgtcgatccagtatgcgagttcccctttgtttactctctaaaaagaataagtctgggagagaaagaataccagaaataaaaagaaaatgaatggtcgatttgttatagtataatacaggaatgagtctagaaggttcttaaacattaacttgattgatgagacccagcgatgagaacctaatggatatagttgagtgctttggtatggaatctaggatgttgtgtgggctagcggaaaattacatagtggtcaggatttgactagaactgtttagtgcatggattaggtttgtatgatcagggtaataagctagagatattggaagttcctatgtttttaaacctcttccacgagtttggcttttgtgtttgacctgagggcaagcaaaagctaagtctggggaagttgatatacctcgatttttactgcttttagctatgatttaggtatagtttttagagtccttttgttatttgtagagtcttttctagtctttttcaggtctttacatgtttgggatgcatttgcagattatggagcattctggagcaaaacagacaacttaagctgcgacaacaatccagagacgaaaattgacgtaggtgtcgatcaacacaatccctagtgtcgagaaacaccaatacctgacggcaattgaattgcacaacttattgatgttttgaagattttcaaattcggcacagaacttgttcctatttctaaagaagtccctgcacgttttaggtcatatatatatatatatatatatatatatatatatatatatagttttaaaggttatcgtttagacctaactcttattatctcttttattattgggagcaaaaccatgtggagactccctttagagaagattcttctaatctattttctcctcttaatttcatcattgatttcttattcaatcatgttatgttcttctatgatcatgcttgagtagttctcttgttgggtttagggattctcattagggatttggatgaattagtagatcaaaaaccctgttaggataaaatatttagaattcttcatctttgattattcttaatgctagttctagttagttctagagtaaatagctagaacttgattttaggttattagggatgcccaccataggtatctaatactgaaactattttagatgagcctagtatttagatgcgtgctagtgtccattacttaggtgaacttatcaaacctgattataatgcttgtttagttctagggatttacaagagagttgggatcaatactattaagcatagtgagtagcacggcacaccaccggttactttatattagtgatttgtgttctagaatggtttgataatatcccttatttactgctagatctactattatgatatttcttgagaatttccctaaacccgacgtcttaatcatctgaatcgacaatctcttttatttcttgtcttgtcttttacttttattacattctctaataagctttattcgaaactgttaatctattgtgtgatccgaaaactttgtggaattcgatccctaagtgctataccaacctctttatttgagagagtagtcattagggtaatttgactcatatcagcccttatctggttggttcaaaggtaattgtgcatacagatcattcagcactcaagtaccttatgtagaaaaaggatgctaagccaagattactacgatggattcttcttcttcaagagtttgacatcgaagtacgggataggaaagggattgagaatggagttgttgatcatttgtcaaggatcaagtttgaagatgacgttcctatcaatgattttctacttgaagaaagtatctacttggttgagacaagtttgtaggaaaatcatggcagtgtcaattcacgtgcagatgagagttgcatagaatcagtgtcgattgacaccacacacctgtcgatcgacaccatcgcgtttcacagacagatggttctgcacaattagtgtcgatcgacaccagatgctgcacatagccgatatgtttacacatcgcctttgaaggcgagattgcagcataagtccaattttcctccatccaagtcctgaactccaaccaagtcaagctattgactttaaacaagcgcttagtggaaggtaacccactgatatgttttttttttcttttttttttttttcttttttttttcttgcttactctggatttgaatgccactgaggacagtgacgtttaagtctgggggaagcagttattaactacgtttttctttttgagtcttattcttactcttctttttcttatttttgagtcgtttcattgagtcaaaacttttctctgaaattatgatctctctttcgaatttattgcttggattgcttaagtattgaagattcaaatcaatccgactaatggaaaatccagaagaccaaccaacaaacttaaggacatccattcccaacttaatccataaatgatggagctaatctcactgctcttccttttacctcatcaaaacagttaatgttcgtaggacttgactccttgttcatacctgataaatcgactaatgtgataaaaagaacgtattcctctcccttgataaaaaaaatatgtataataatgagagattgacaggattttcagatagtgtataggggtaggaatgtttcctatgactccatcattaaacattgtttgaaatgatcaattacaatggttggaaaaataccgagggtgtcgatccagtatgcgagttcccctttgtttactctctaaaaataataagtatgagggagataaagaacaccagaaataaaaagaaagtgaatggtcgatttgttatggtatagtacaggaatgattctagaaggttcttaaatgttaacttgattgatgagacctagcgatgagagcctaatagatatagttgagtgctttggtatggaatctaggatgttgtgtgggctagcggaaattacatagtggtcaggatttgactagaactgtttagtgcatggatttggtttgtatgatcagggtaataagctagagagattgggagttcctgtgttttcaaaactcttccacgggttcggcttttatgttttgcttgagggtaatcaaagctaagtctgggggagttgatatacctcgattttcactgcttttagctatgatttaggtatagtttttagagttcttttgttatttgtagagtcttttctagtctttttcaggtctttacatgtttgggatgcatttggagattatggagcattctggagcaaaacagacaacctaagctgcagaagcaatccggagacgaaatttgacgtaggtgtcgatcgacacaacccctggtgtcgagcgacaccaatacctaatgccaattcaattgcgcaacttattgatgttttgaagatttccaaattcggtccagaactttctcttatttctaaagaagtccctgcacgttttaggttatatacatatattttaaaggtcattgtttagacctaactcttattatctattctgtacttgggagaaaaagcttgttgacactccctttagagaagatctttctaaactctattctcttattgtttcttacattgatttcttattcaatcatgttttgttcttctatgatcatgcttgagtagttctcttgttgggtttaaggattctcattagggatttggatgaattagtagatcgaaaaccctgttaggataatatttttagaattcttaatcttagattgttcttaatgctagttttagagtaactaactagaacttgattttaggataataggtatgcacaccataggtatctattactggaactatcttagatgagcctagtatttagatgcgtgctagcgtcgattacttaggtgaacttatcaaacctgattataatgcttgcttagttctaggaatttacaagagagttgggatcaatactattaagcatagtgagtttggcggaacaccaccggttactttatattagtgatttgtgttctagaaatgtttgttaataatcctagtttactgctagatcaactattctgatatttcctgagaatttccctaaacccgacgtcttaatcatatgaatctacaaccaattttaattgctttcttgtcttttacttttataatattttctatttagttttattcaaaactgttaatctattgtgtgatccgagaactttgtggaattcgatccctaagtgctataacaacctctttatttgagagagtagtcattagggtaatttgactcatatcaaagattcaaatccaaaaactcatacggacttcgactacaccatcaaagctttgagaagcaagaagaagcttagttagcgtttttggtgtgatatatgactagatgttgtgtgtatgatagagtataagaacttgtaacgcaactggatcccaaaagataaagtagtgtttccttgtcagaagattcaaaaccaaaaacatcatacggactttggctacaccatcaaagctttaagaagcaaaataagctagaaccgcttatttgggagtcaaatatgagtacagctttggtaaatgatttaagtataagctagaactgcaagtggatcctcaaagctaatgttgtgtttccctgttaaaagatccaaaaccaaattatcatagggacttcggccacaacaacaaagctttgagaagcaaaataagctttcttagcatatttggaatcaagtttggttagtagtcgtgtgtttggttgagtatatgaactagaaccgcaaccaaatcccagaagctaacgtagtgtttccatattagaagatcaaacaccaaacaatcatatggacttgggtgcactatcaaagctttttgaagcaagaagaagcctaatgagggtttttggagtcgaatatgactagatgtcaggtgtacgattgagtataagaactagtaacgcaattggatccctgaatctaaagtagtgtttccctattagaagattctaaaccaaaaaatcgaaggaacttcggccacaccatcaaagctgtgagaaccaaaaagaagcttggttagtgctttagaagtcaaaatgactatatctcatgtgtatgattgagtataagaactaaaaccgtaaaagaatcctgatagctaaagtaatgtttccttattaaaagatctaaaacccgaaactcgtagggacttcaactacaccatcaaagctttgagaaataagaagagtcttggttaacattttggagtctaatataactagacttcatgtatatgattgagtataagaactaaaaccgcaaccggatcccagaaggtaaagtagtaatcccttgttagaaaatccaaaacaaaaacgcataaggactatggctacaccatcacagctttgagaagtaagaagaagcttgcttggtttttaggtgtcaaatataactaaatgtcctgtgtatgattgattataagaaccgcaattggatcccaaaaactaaattagtgtttccctatttaaagatccaaaaccaaaatttcatagggactttggctataccattaaagctttgagaatcaaaaaagagcttggttagcgtttttggagtcaaatatgactagatgtcgtgtgtatgattgagtataagaactagaacttcaaccgaaacaaaagctaaagttttgttccctttaagaagatccaaaaccaaaacctcttaggtacttcagccccaccatcaaagctttgaaaagcaaaaaaaccttggttagggtttttggagtcaaatatgactagatgtcatgtggatgattgagtataagaaatagtaacgcaacttgatcctagaagctaaagtagtatttccctactagaagatgcaaaaccaaaaactcaaatggacttcggccacaccatcaaaaaaagctgagatacaaaaaaagtttggttattgtttgtagtcaaaaatgactagatctcatatgtacgattgagaatatgaactaaaaccgcaataggataccgatagctaaagtaatgtttccctttaagaagatccaaaaccaaaagctcataggaacttcagctacacgatcaaagctttgagaaacaagaagatgacttggttagcattttggagtctaatataactagatcgcatgtgtatgattgagtataggaactaaaaccgcaaccggattcgagaaggtaaagtagtaattccttgttagaaaatccgaaacaaaaatgcataaggactacaactacaccatcacagctttgagaagtaagaagaagcttgcttggtgttttggaatcaaatatgactaaatgtcgtgtgtatgactcagtataagaactagaaccgtaacaggatcccaaaatttaaattagtgttttcttgttaacagatccaaaaccaaaacttcatagggacttcggctacaccatcaaaacttttagaagcaagaagaaggttggttagcatttttggagtcaaatgtgagtagatgttgtctatatgattgactacaagaactagaaccacaatcgaatccccgtaactaaagtagtgtttccatgttagaagatccaaatccaaaagcatataggaactctcgcaaaaccatcaaatctttgagaagtaagaagaagcttagttagaatttttagagtgaaataagactagatgtctcgtgtatgatagagtacaagaattagaaatgcaatcggatcccatatgctaaagttgtgtttccaggttagaagatccataaccaaaaacgcaatcggttcatattctttggtttctggaagagagttaaggagagtgttcgtaacagagaaatagagagttagtgtagagagtgatgggtgatcaaggaagacgattcccaacgagatgtcgatcggggaagctataaggatgggtacatcaaagactgctaaaaatcctggaagattatttcattagtgtcataatggatctgttgaggtaatttcaattttcatatatgttttattgtgtttgaaacattattatgaatttcgttttgtgttagagagtcagtggtataacatgtttactctttctctcattcgaaacaatgaacccgaaaacataattttaattttttttcccatactaaaacgacgtcgtttcctcaatacgagttaaacgacgttgtttttaaaatgcccaaatgtcatgccatcgacctgttgtcgctgactcacatttgttaaagatcaactaacaccgttaaaatttatattgaaattggctaatttaataaaggttatgttttcaatttcaattttatttcggttcaggttgaaatagactggggggtctgaatcttaggtttttcccagcaaaagtctgggttaataaaggttatttttcccaaaagctttgtgaagccagaggaaggttggttagagttttggagtcaaatatgactaattgtagtgtgtatgattgagtataagaaccaataatttttaaactaagtttaattctaaaatcttgtggtgtttgcaattgatccctggcaacggcggcaaaaatttgttacgggtaaaattcctataacaagtttaccctaaattaaactgtaaatccacatgaaatcatagtagtatttagggatcaaatccacaaagatcaagaaaacacaaaaaaagacttacaaagaatgaaactaagcttgtataaaaaggagtactaagaactcaaaggcgttttgcaaaaggaaaagaatacataatataagaaatagagttttagagaacacatcatagatatatagtaaagccatgctagaatagattaagatcatgtatgattctagatttctattacaaattaccctatggttaagtgatattatcatatgaaggatttcttcacatcataagtgaagaacgactacttactttatgagaggaaataaatcaaacattaagatcacattttaatagattctaaaaaaacaaataattgtcctcaagatttgcctttaactagattgatccacctcatccaatatccttttgagactagaggtgattttggttttaacataattgtagtgtttcagcctaagctttaaaacacaatcttagagttagtaaacaatagaaacatagcaaataacctgcactctaggtatcaaaacacatctttgttggggttcttcaactgtcgtaattgaaacggtaccaatcctaccgatcggtatactccataataaagctactcattcatgatcaaggtacatcttatctttgtagagagaggatcatgagtactaaaggagttttcctcgagagatcaacaaattaaagcaataaaataaattaaagaagattaaggaaggaaagaacactttacaactaaataaaacgtaaaagtaaaaaccttctatgcggctacaaataaaggagtatatatcaaagggacgtatgcctaaaagagatagaggctattaataataaaagctcatagattggtggacagacccaactgattggcagaacagttgattcttcactagttggcgcaaaacctttgccgaacgggcctgaccttctcttcataagctatatttcagcctattttgttcttataatgctcattttagttttacagaattcctaaaaagccttataaacacgaagaatggtttgttctttgataaaagactaaataaaacaagtaaaacctatcacttagcagtggttggttcaaagaataatcatagaatattatttggtgcaaagtgtcttcggaggtgcccttccctctacaatcggagttggaagctttaacttggaatgaagaattttctttcaagaaaagattagttgtcatgaatttgtaatagattgttctaccatgctctgtttttctcttatgtattctctttatttgatttattataataacgacgtaagaaaaaagaaaagaaaaaaaaaacagattaatttagttttatggaattggtgactgcagattttctgaatctggctgaatgtcttaccatatagactcataatgatccaaatgagtaaaattcaattaatattataagtttataacttcgtagaaaaaggaaagaaaattaaaagaacatgaatgacaaaagcatataaagaaaaactggaacttcaaattcgaattacataaaaatttagacctcgagctgagatcacgtcaaactagattgttactacatatatcctctctcattgtttgtaaccttgcaagtcttcccaagaaatacttaaacgtgtatggatatgacgaatttcacgtaagctcgtatatcttccttacaaaggcctagtatgtcgtcctcttgcccggccgcacaaacgcgaattcttcgggatagggtactcatctctcaaagacgtagatgacgtgaagacacgtaagtaaagttgttgtcccaagtactgtcttgcccaaaattctgatcttaagttccacattccaacgttgtctaatgcaatgtatatggctgtccatgattttgggtacacctgaattcccgtaaatggataatgtttataattagaacaagaaaacacaatgtgttaatttgacaatgaaagggggaaaaaaaaagggctcacttggactgtggaacgtgaaactgcatcgcgtaaattataaccatttctgcttcctgtcttccactgtccaccatccatcctgcagttgatccaaccacaacacactttgtttaactcgtaagaaaacaaagaaaataataaatgaagagcgtgaaaatagacagacatacccgaccacccaaaaggagtaaccattgagatgataactttggacgatatcttcttggttctcgaatacaatctcgataaaggttcgatagtcgacttgcaaaactgaggtgtcaaggtataaacctccatatgtgggtttgtctgagatgctgttgatcttatagacaccgctaatcttgaagaagtcagccagttttagaggggtatcagctggcacaaatgacacactattgacaccatatctttgtttcccgtttatctgtccggctgaactaccgaacacaattgtcctaatgagcggtataagaccataatggtatgagccttgcgggtttggtcttggtccactagctgtcaaattggttctacgaaagaaaaattattcatagcacttattggagaggagcataaaacacttaatcacatatgcaagaaagataagtacctgatggcacgtgcttggttcaaggaccaatcaacctgaatagtgggaccgccaggaataggaccagaagcaggggtagacgagccactgtagcgaagaaccccggtggtggttatgattttatccgtgaatcgagacgaaacaaccacgtagtagtcacgaggagattggtcagcagtaattagaacggagtaagactggccaacgtgaacgtcaagagaggaaaacatggtttgaagtgtgtgcgtcccttcgacttccacaagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgaaccccttgcggccgcccgggccgtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgcccttgggatatatcaac

SEQ ID NO: 195 - DNA, 90336 bp, Arabidopsis thaliana
gaattccaatttccttcctcattcattggagagctctctttgggctttccgaaaaggtatcacatgcgaagtttcgcctcacaatctaaaagttatatagtcatacatttttaacaaaacaaatagagaaaaaccgaaaaaaagaatgatacaacacaacgactttcccggaggtcacccatcctaatactattctcgcccaagcaagcttaactgcagagtattgatgggatctgatgcataagtgctgatatgatcgcatccgttactacatgcaatgcaatcgtatctattcgtttttgaagactttatgatccatttgccgtgggtcccaccagctatgtaggaataccctatcttgtttataagagctttgatacatgcaaaaaattggaaaacaatgtctgaacatataatttttgtcccgtaatatagcaaagatcacgaaaaggatagaaaaagtacattaaggtcaaaattttgagtagaaaaaaaatcaatagaaggattccaatttccttgctcattcatatagctctctttgggctttccgaaaaggtatcacatgcaaagtttggcctcgcggtctaaaagttatagaggtatacttttttaccaaaaaaaaagaagaaaaaaaccaaaaaaaagagggattcaacacgaggactttctgggaggtcactcatcctattactactctcgcccaagcacgcttaactgcggagttctgataggatccagtgcattagtgcgggtatgatcacatccgttactacatgcaatgcaatcgtatatattttttttgaagactttatgatccatttgccgtgggtctcaccagctatataggaataccctatcttgtttataagagctttgatacatgcaaaatatttgaaaacaatgtccgaacgtataatcttcgtcccgtaatatagcaaagatcactaaaaggctagaaaaagtacattaagatcaaaattttgagtagaaaaataaacaatagaaaaattccattgtccttcctcattcatcggagagttctctttgggctttccgaaaaggtatcacatgccaagtttggcctcacggtctaaaacttatagaatcatacattcttaacaaaaaaaaaagagaaaaaccgaaaaaaagaagaatttaacacaaggactttccaggaggtcaaccatcctagtagtactctcgcccaatcacgcttaactgcagagttctgatgggatccggtgcattagtgctggtatgatcgcatctgttactacatgcaatgcaatcgtatctgttactacatgcaatgcaatcgtatctgttactacatgcaatgcaatcgtatctattcttttttgaagactttatgatccatttgccgtgggtcccaccagctatgtaggaataccctatcttgtttataagagctttgatacatgcaaaatattcgaatacaatgtctaaacgtataagtttcgccccgtaatatagcgaagatcacgaaaaggcccgaaaaagtacattaaggtcaaaatttggagtagaaataaaaaccaatagaagaattccaatttccttcctcattcattggagagctctctttgggctttccgaaaaggtatcacatgcgaagtttggcctcacaatctaaaagttatatagtcatacatttttaacaaaacaaatagagaaaaaccgaaaaaaagaatgatccaacacaaggactttcccggaggtcacccatcctaatactattctcgcccaagcaagcttaactgcagagtattgatgggatctgatgcataagggctgatatgatcgcatccgttactacaagcaatgcaatcgtatctattcgtttttgaagactttatgatccatttgccgtgggtcccaccagctatgtaggaataccctatcttgtttataagagctttgatacatgcaaaaaattggaaaacaatgtctgaacatataatttttgtcccgtaatatagcaaagatcacgaaaaggatagaaaaagtacattaaggtcaaaattttgagtagaaaaaaaatcaatagaaggattccaatttccttcctcattcatatagctctctttgggctttccgaaaaggtatcacatgcaaagtttggcctcgcggtctaaaagttatagaggtatacatttttaccaaaaaaaagagggattcaacacgaggactttctgggaggtcactcatcctattactactctcgcccaagcacacttaactgcggagttctgataggatccagtgcattagtgcgggtatgatcacatccgttactacatgcaatgcaatcgtatatattttttttgaagactttatgatccatttgccgtgggtctcaccagctatgtaggaataccctatcttgtttgtaagagctttgatacatgcaaaatattcgaaaacaatgtcagaacgtatgctttttgccccgtaatatagcatagatcatgaaaaggccagaaaaagtacattaaggtcaaaattttgagtagaaaaaaaaacaatagaaaaattccattgtccttcctcattcatcggagagttctctttgggctttccgaaaaggtatcacatgccaagtttggcctcacggtctaaaacttatagaatcatacattcttaacaaaaaaaaaagagaaaaaccgaaaaaaagaagaatgcaacacaaggactttccatgaggtcaaccatcctagtactactctcgcccaatcacgcttaactgcagagttttgatgggatccggtgcattagtgctggtatgatcgcatctgttactacatgcaatgcaatcgtatctattcttttttgaagactttatgatccatttgtcgtgggtcccaccaactatgtaagaataccctatcttgtttataagagctttgatacatgcaaaatattcgaaaacaatgtcagaacgtatgctttttgccccgtaatatagcatagatcatgaaaaggccagaaaaagtacattaaggtcaaaattttgagtagaaaaaaaaacaatagaaaaattccattgtccttcctcattcatcggagagttctctttgggctttccgaaaaggtatcacatgccaagtttggcctcacggtctaaaatttatagagtcatacatttttaacaaaaaaaaaagagaaaaaccgaaaaaagagggatggaacacaaggactttccgggaggtcacccattctagtactactctcacccaagcgcgcttaactgtggagttctgatgggatccagtgcattagtgatggtatgatcgcatccgttactacatgcaatgcaataatatcttttcttcttgaagactttatgatccatttgtcgtgggtcccaccagctatgtaggaataccctatcttgtttataagagctttgatacatgcaaaatattcaaaaacaatgtccgaacatataattttcgccccgtaatatagcaaagatcgcgaaaacgccaaaagagtacattaaggtcaaaatttggagtagaaaaaaaacccaatagaagaattccattttccttcatcattcaccagagagctctcttttggctttttgaaaaggtatcacatgccaagtttggcctcacggtctaaaagttatagagtcattcattttaaaaaaaaaaatagagaaaaaccaaaaaaaaaaagagggatgaaacacgaggactttccgggaggtcacccatcctagtactactctcgcccaagcacacttaactgcggagttcttatgggatctggtgcattagtgctgctatgatcgcatccgttactacatgcaatgcaatcgtatctattcttttttgaagactttatgatccatttgctgtgggtcctgatatgtctataatttacatcttttcagtgtccattcatcaccgttttgagtccagttttgtatcattcatcgctgttttatatcatttctcatcattcttgcatactttgcatgattaggatagttttgcatacatattgcatttctaagttgttttcaggtgatttggagctgtttgcgagcaaattggaagaaacgagccagaaccagaagacatactcgaccaccaggtcgtgtgcatccagcaccatactcgaccccctggtcgagtgactttggagccattcttcccatctactcgaccccctagtcgagtatcctcagctcaggctactcgatgacgccatcgaccccctggtcgagtatcacttcgccacaccacctgaccacactcggccattcactctaccaagttagtcgaccccctggtcgagtatcatcactcaccaccatcaccatcactcgaccggacactcgatcacgtcttcacagtctactcaaatccgcactcaaccagacaagctgagcacaaggaagagaagaggagaagacaaagtgtttggaagcggcctggacctccatcggatcacaaagcccatctcggcccattatcactctattggtcgggcgattaggttattggcccgtctactatcattttgttttgtataaatagatgtcttagggttctttcctgagacatctagtcgacattgagtttttgtttcagttttattttctattttactcttctgcgccgcttttgcttctacaacctataattcgagatttttccaagttattcagattctgcatttgattttatctatcatcctgtttctctactctttatctctttacttatgcaatattatcatttatctgcgtttatgtctttgagcatgttgtctgagtagtgacatagaattcttagggatgggatagagtagttgtggaatccgtagtctgtagaatggttaagttttagaattgattgaatcccttcaggactagttgcgtttactgcttatttctttctgatcaactggaattcgatcccaagcattctcgcacccagaaggtgttcgatggaatgcttgatccactagttcctgagatattcgtctctatcccaagggattgggcgtttagagcgtttattgactttatcagtctgttcttattgcctgcatagttagattgcgttaatgggaattagtctgggctagctttgcttgaggatttctatcacagaagtgaattgatttgttgttgaacctattgtctagggatagcttgattgcgcttgttaaccattcgaatatgctaggatatgataaggtctgaccctatcgaagacaagaaaaagactaagagtgataaaataacaagataataggaaatgcaccttgaacggcggagagtgtagatgagagagagaatttcaagattaatgttgttgattgtttattttgataacaaaaccctaaaagggaaggttccttaaatagcatctactgagactcaatacaaaacgcagcatttcgataacccaaaagtaaaacgacacagttggcgagctgtctttctgtgccgagctggcgagctgtctttctgtgccttagccacttttaaatagaagcttcctcaggaacttctcacgagctctgcctttccttccatttgatttcgcccttcttctcacaccagccaacgtcacctgtaacctatcaatgctcccgcgcagaagactgaccttgtcctcaaggtcgaagtccgggtactgctgcaccaaagtgaggagcggctcccaagttgattccaaggttgataatccagaccactgtaccagcacctctggtcctgaatttgtgttgctctgtcggatatctagcagcttctcaggtcctgtgttccattccagtgtgggtgatagtatcttgggaagttcctgcggggtgaatgacggaggtacagcccttttcagttgagagacatggaacaccgggtgaattgtgctgtgttcgggtagttggagcttgtaagcgacctgacctatgcggtgcagcactttaaatggaccgaagtagcgctgggacagcttttcattcttcctatgagccacagaactttgcctataaggacgcagcttcaagtaaacccattcatcaatttcaaacgctacatcacgtcgacttttatcagcagcctttttcatttgagcttgagctatctccaagttctctcttaattcaaccagcattccatccctatccttaagtaactcctctacattcgcattattggttggaatatcgccatacctgagcagaactggtggttctctaccatagactgcttgaaagggagtggttttggtggctgaatggtacgaggtgttgtaccagtattctgcccaaggtaaccactgaaaccacgatgtaggcctcctccctgcaaagcatcgcaaataagactcaagacatctgttaacaacctcggtctgcccatcagtttgtgggtgataggctgtactcttctgtagccccgtgccctgcagcttaaacaactcagaccagaatccgctcaggaaaatcctgtccctgtccgaaaccagtgtgtttgggaagccatgtagcttgactacatctcttatgaaggcctcaactacagtcttggcagtgaatggatgtttaagtggaatgaaatgactatacttacttaatctatccaccactaccaatatacagttaaacctgttagagcttggcaacccttctacaaagtccaagctgacatcactccaaatctgttgtggaatagggagaggtgatagtaaaccggctggagagagggtagagtatttattctcttgacagatttggcatcccttgatgtagttaaccacgtctttccgcaaccctctccagtatacttcacttgtgagtcgtttgaatgtcttaagggcaccttcatgacctccaataggactggtgtggaacttctctagcatctttggaatgaagggagatcctacaggaattaccaaacagccttttctgtaaatcaagccatctgccacagtgaagtcagaatcatggtggtccccttgtgcccagttcttaagtatctggctcaactcatgatcctgctgaatttctgcctttagtgcagtcaagtcgatagtaggaggaccagttatagtgagctgtgagagagcctcagttggaggtctccttgagagtgcatcagctaccttattgtcaactcctggtttatattcgatcctatacttcagtccactcaacttagacgcccatctctgctgtattgtggacaccgacttctgttccaacaaatgtctgaggctgcgttgatctgtcttgataatgaattctttacttgataggtaatgcttccactttgtgacagctttcactatggctaacagttcacgttcataaactgaccttattctgccttgactggagaaggcttggctgagaaatgcaataagcctcttattctgtgacagtactgctccaatccccatccctgatgcatccgtttccacagtaaactcctgctggaaatctggtaacactagcacaggtagtgctgaaacagctgctttgagagcctgaaatgcagaagtagctgcctcattccaatcaaaactgttcttttttaactgatctctgagtggtctggcgatttggccgtaattcttgacaaatcggcgatagtagccagtgaatcctaggaagcctcttaactcagtcacagatttaggtaaaggccactggagcattgcttccaccttttctggatctgttgcgactccttgctcagagataatgtgtcccaaatatgagatcctagtgcttccaaatgtgcactttttaaaattggcatagaactgatgaagatgcagtagctgtaagacggtttccaaatgcttcaaatgtgtcttcatatcaggactataaactagtatatcatcgaagaaaaccaagacgaactttcgcaagtatggcctgaataggtcattcatgacgctttgaaaggtggagggggcgttggtcaagccaaatggcattaccagaaattcataatggccctcatgtgtcttgaaggcagtcttctccacatcactcagtttcatccttatctggaaatagcctgatttaagatccaactttgaaaacactgtggctcctttcagttcatccaatagctcttctataacaggaatcggatacttatcgggtattgtagcttcattcaatgctcgataatcaacgcagaagcgccatcctccatctttctttttcactaggagaactggacttgaatatggactcacgctaggtcttataatctgagcattcaacatttcacgcacaagcttctctatctcattcttttgagcaaaagaatacctgtatggtcggatattgactggtgaagacccttcttgtaaggtaatggcgtgttctctgttgcgaactggtggcaatagctgtggagtttgaaaaaccccttggtactgatccaaaagcctctggattgcaggctgcaaggctgtttgctcttcctgtttcttgctttcaaacaaagatgctagttccaagagatatgcagttccagtgtatttgataactctttccatagacctcatcgaaatttgtcctctacatagatccgggtcgccgtataaggatacccatgtgcgacctatctgccaactgatcctcaaatctctccagttggctcttgtttctcctagtcctgccaaccaagaaaatcccagaaccaaatccaaatctcccaagtcaaataagtagtagtcttgtacaaactcaattccttggacctctagtggtatatcgacacacttcccactacttttgatgattctgcctccaccaactttaactccaaaactgcgagtttgagtcactaaccatcctttctctcttaccaaagcctcactaatgaagttgcaagttgctcctgaatcaaccaataacaccactttggtgttgccaatgtatcccctcattttcattgactgctcttgagactcatcattcaaggagctgagtgtcattaccttgaaaccttctgcaggttctggatccccttcttcttctgtcagtggttcattcaactcttcaattagaggactctcctcttcaacctcttctgttatggctagacccttgagcttttgtggtttgcatttatggccttgaaaccatctatctccacagtagcggcacgggtttgagttcctggcttccccactgcctgaagcacgagttgtatccctactaggaatgaagggttgtctcgttggagcacggtctaccactctagatcctgtggagacctgattgttgaatggagctgtgttggttctagcttgatttcgcacttggtaactaacagcattccgctcttgtgactcaatgagtttagctatctcaacaatatctgcaagattcactggcctacagcgaactacctggtctcgaagacttcttctcagtccattgaggaatgcagattccaatatgtcagatgtgacatggggtaagtcgactgtgagctcttcaaaacgttctctgtattcctccacggttcctgtttgtctcacgttgaggagatgatccacagcagaactgcctctgcttggtcgaaaacgtaacatgaacttttcttgaaattccctccaggtatagatttgttctctgtccttagagcagcgccaccatgtaactgatgctcctgttaaacaagacacagccttttccagtttttcttcctctagggtgcgattggataagaagcactgttctagccggaacaaccaatcgtcggcattgcctccttcataagccggataatccacagtcctacgcggggctgcttcaaaccgaggttgatgtggcgcagattgaggcggaaacgtttgtgtttggaaggttggagtagtctgaaaccccgtggaaggattagatggaaaacctgaagatgatggaagacccgtggaggcattcagctgaaaccctggtggttctaatggtgacgagtgaaagcgacgcggttcgaagggtgaagctggaagtcgaggtatctctgaagtcgacgcctggtatcgcgactggtcaaagagtaagggccgagggtgtgtgtcccgttgatttgtgccggaaaacagagtctctctgttctgtacctccaagtgttgaggatgagaggtgtagactggtaacgccggagctggagaagaaaaacggactcctctattcggtccttccagatgttgtgggtatgaagcttgtaaaggcagtgccggtgtcggagtggagaaccctatcggagctgcacttccctcacgcgtaaccccaaagatctgatttctaaggatctgggttagagcctctctgacataagtcatctctttctccactttgtctactcgtgtgtccaaatgtggagctggcggaggttcctcaggtggtggtgttgttgtcgagccgagttcaggtgactcgacggcggtatcagatgcggtggctttaggtaacggtggagccatcggtctctccaatgaagaagcaccaatgataaggtctgaccctatcgaagacaagaaaaagactaagactgataaaataacaagacaataggaaatgcaccttgaacggcggagagtgtagatgagagagagaatttcaagattaatgttgttgattgtttattttgataacaaaaccctaaaagggaaggttccttaaatagcatctactgagactcaatacaaaacgcagcatttcgataacccaaaagtaaaacgacacagttggcgagctggcgagctgtctttctgtgccgagctggcgagctgtctttttgtgccttagccacttttaaatagaagcttcctcaggaacttctcacgagctctgcctttccttccatttgatctcgcccttcttctcacaccagccaacgtcacccgtaacctatcaggataccactctactcgattaccccatccttaggaatttctcgtctatactatttctctgttttatcgttatcgcttaatcgttctcattgcctgtttcttagtttttacaattactcgaccaacttactcgaccacacccagtgtctggcaacagactgtgcagtcgagtacagttgtctcatttcctgtctgttactcgaccagtatactcgaccacacccagtgtctggcaacagactgtgcagttgagtatatctgtttcatatcctacctgttactcgaccacatcctacttctggcatcagcctgttgtggtcgagtgattttagtaattttgttattgtttctgttttctgcatgttcacttaggactgtagaaaccccaaaactgttattgcttggcttgacttagtaacttctgatcacatctcatctgtttgcatcacactcatttggattgacacctaaaatactacaacgacatgcttggtgttttagaataattgactaaaaacatattatcaggtcccaccagatatgtaggaataccctatcttgtttataagagctttgatacatgcaaaatattcaaaaacaatgtccgaacatataatttttgtcccgtaatatagcaaagatcaagaaaaggccataaaaagtacatttaggtcaaaatttggagtagaaaaacaacccattcctcattcgtttgagagcactctttcggctttccgaaaaggtatcacatgccaagtttggcctcacggtctaaaagttatagagtaatacatttttaacaaaaaatatgagaaaaatcgaaaacaaaagagttatgcaacacaaggactttcctggaggtcacacgtcgtagtactactctcgcccaagcacgcttaactgcggatttctgatggtatctggtgcattagtgctggtatgatcgcatctgttactacatgcaatgcaatcgtatctattcttttttgaagacttcatgatccatttgttggggtcccaccagctatgtaggaatatcctatcttgtttataagagctttgatacatgcaaaatatttgaaaacaatgtccgaacctataattttctcaccgtaatatagtaaagatcacgattgtgaggcctgtttcaggattgagcttggaagaaagtgttaggacaagagtcagagttgtcaaagaaaaccaaaagtccactagatccatcaaagtaaaagaaacttctccttagaataagagtcaaagaaaagaaagagtggtttgatccaagataagaatgagaaaaaaaaataccttgagtgcaaagggtagaactaggatcatattttgggcttgatggtagtaccatctgctggtgtatacactgtctatgttattgggtagatgggatactatttttgtatgcataggttggctcttacctttagcattctccaaaacctcagtccatttcttttgagagtcccctgttactaaacttgaacaaccagaaagggatcatctttgtctcctgaccttcaccttagccaaatgagttcattgatggtgcattgcctgattcacgttcctaaactaatgaatgttaaagggattggtagatttgaaatcatgtgtaggtcgagtataagagtgagatttaactataataaggcatggctaacgtttttgagtagaattccatcatatcgtatcctagaactgtcattttggacattgattttatctgatttatttgatgatttggttctggatccccaccttcaaacctctccttcagcttatgtctacttgtttgcttgagggcaagcaaagactaagtttgggggagttgatatgtctataatttgcatgttttacacatcctgttttcaccactttgagtctagtttcatccatctttcatagcattcatcatcattcttgtacattttgcgtctttagtcgagtctaggactagtcttgcgtctattggtgctcagaaagaggaaaaacagaacagaaagtcacatttccaccaacatactcaatcaccagtaggagagagggaagcagttagctcaacagtccatccagacacttatactcgatcgcagaggagaggagtcaatcccaactgcagttctactcgatcacagagttgaaggagtccatcctgaaaattctactcaatcgcagaggcgaccatgcagtccactttgccagtccaccaattctactcgatcgcagaggagaagaaccaatccatcctgacagctaacacacatactcggtcacagaggccaagaagcagcccagaccattctgtcaaccaacctactcaaccaccacctcgaccctttgatcaatccgcactcaaccagacaacctgagcaacggaaagagaagagaagagaaggcccattcgaagcccattcgaagtccatcaggaagcccactttgagtcgacactcttgatcacatcgtccatgggccgttaagtgggctcgaaacccgctttcttatcttagtataaataagtctcaaagggtttcgccttgagacatacactttgagagacacgaattttgcactagtattcagcagccacttttcattcctgcaactttgtatttcgatttttcttctaagttattcagattttgatttcatttgcttgttcatctttgtttcattccctttaatatttttagtatgcaatattcaatcgtttctatgttgttgtctttaagcatgttgtctgagtagtgattagagtttctaaggatgggatagggtagctgtggaacccctggtcgaatctgttggttaagtgtagatttattgaatcccttctggattagttgtgtttactgtttattcctttatgatcaactggaatccgatcccagacgttccagcgcttagaaggcgttttatagaacgttgcatctactaattccagtgataatcgtctctatcccaagggattggccgtttagagcggttattggctttaacagtcggttcttattgcctgcttagttagagatcgctaatgggaattaggtcagtgtctagctatgcttgagaatttatatcacgggagtgtattaatctgttgttgaacctgttgtctagggatagcttaattgagatttgttaaccaactgaattgattagggagaccacactattcgattaccccatccttatgagtttctcatccaattgatttctttgtttacttacctacttcattcacttgctattgaattttagtattttcgtgttttcaaccatcctactcgatcacaccctgctactgacagtgagactgtgtgatagagtaaactggtccatttctgcatttttactctctgtcattctattgtactcgatcacagggtcctttctgggagtcgaccctgcaatcgagtatatcagtcatttctgcgactttttactgtttactgcatcaacactaggactgttagaaaaccaaccaaattgtgcttggcatgacttagaaacttctgattatatctcatatgtctgcatcacacccatttggattgacacctaaaatactacaacgacaagattagtgttttaggattaattgagtaagaacctattatcatagttcttatacgcaatcatacacatgacatcaagtcatatttgactctaaaacactaactaagcctcttcttgcttctgaaagctttgatagtgtagctgaagtccgtatgagtcattggctttgtatcttctaacaaggaaacactatttgggctttcaagatccggttgccaatctagttcttatactcaatcatacacaggacatcaattaatatttgactccaaaacactaatcaagcttcttcttgcttctcgatggtgtagccgaagtctgtatgagtatttggctttgtatcttctaataaggaaacactacttgggctttcaagatccgattgcggttttagtttttatattcaatcatacacatgccatctagtcatatttgactccaaaacactaaccaagcttcttcatgcttcctaaaactttgatggtgatgtcgaagtccgtatgagtctttgggtttatatcttcaaacaacgaaacactacttagatttttaagatcaggttgtggttcttgtacttatactccatcatacacatcacatcaagtcatatttgactccaaaacactaaccaagcttattcatgcttctcaaggtctttatggtgtagccgaagtccgtaagactctatggctttgtatcttccaacaaggaaatacaacttgggctttcaagatgaggttgcggttcgagtttttatactcaatcatacacatgacctgtagtcatattttactccaaaacactaaccaagcttattcttgcttctcaaagctttaatagtgtaaccaaagtccacatgagtctttagctttgtatcttctaataagcaaacactactcaggcttttaagatatagttgtggttctagttcttattctcaattatacatattacattaagtcatatttaactcagaaacactaactaagcttcttcttgcttctcaaagctttgatggtctagctgaagttcgtttgagtcattggctttgtatcttctaacatcgaaacactacttaggcttttaatatcgcgttgtggttctagttttacacgccatcataaacatgacatccagtcatatttgactccaaaacactaacagaacttcttcttgattctcaaagttttgatggtgtagccgaagtccatatgagtctttggatttgtatcttctaacaaggaaacactacttgggcattcaagatccgattgcggtttgagtatttatactcaatcatacacatgtcatctagtcatatttgactccaaaacaataaccaagcttcttcatgcttcctaaggctttgatggtgatgtcaaagtccgtatgaatcttttgttttgtatcttctagcatggaaacactacttttgcttttgggataagtttcaagatctagtccaaatacttaaccatacacatgacatcaagtgatatttgatccaaaacactaaccaagcttcttcttgcttctcaaagctttgatggtttaaccaaagtccgtatgagaatttggctttgtatcttctaacaaggaaacactacttgggctttcaagatctggttgtagttcgagtttttatactaaatcatagacatgccatcttgtcatatttgactccaaaacactaaccaagattcttcttgcttctcaaagttttaatggtgtaatcaaaatctgtattagtcattggctttgtatgttctaacaaggaaacactatttgggctttcgggattaggttgtagttcgagttcttatactaaatcatacaaatgtcgtctggtcatatttgactccaaaacactaaccaagattcttcttgcttctcaaagttttaatggtgtaatcgaaaatctgtatgagtctttggtttgtatcttctaacaaggaaacactacttagacttttaagatccggttgtggttctagttcttatactcaatcatacagattacatcaagtcatatttgactctaaaacactaactaagccccttcttgtttctcaaagctttgatagtgaagccgaagtccgtatgagtcattagctttgtctgttctaacaagaaaacactatttgggctttcaatatccggttgccaatctagttcttatactaaatcatacacaggacatcaattcatatttgactccaaaacactaaccaagcttcatcttgcttcttgatggtgtagccgaagtccgtatgagtatttggctttgtatcttctaacaaagaaacactacttgggctttcaagatctggttacggtttgagtttttatactcaatcatacacatgcaatctagtcatattggactccaaaaaactaactaagcttcttttggcttcctaaggctttgatggggatgtcgaagttcgtatgagtctttggctttgtatcttctagcatggaaacactacttttccttttcagatccgtttgcggttcaagttctaatattcaaccacagacaggacatcaatttatatttaactccaaaacataaaccaagatttttcaaagctttgatggtgtagccgaagtccgtatgagtcattggcgttgtatcttctaacaaagaaacactacttgggctttcaagatccagttgcggttcgagttcttgtactcaatcatacacatgccatctaggcatatttgactccaaaactaaccaagcttcttcttgcctctcaaagctttaatggtgtaaccaaagtccgtatgaatgtctggctttgtatctgttggagtaagcttgagtattacttaagaaataagttatttagttttgagaaggattagattaaatctttgggagttatctaaagatattattaggagttatctaatattaatctaaatgtttattctagaattatctattgatctctatataagagttaccaaagttgtggttaaccttatcgttttttagagattgtgaagagatcaatagctttaggttttgagtaattttcctaaagagattaaagagagttattctttactttgagttcttaaacacatctctaaactacaattggtatcagagcttacaaatcttgagaccataaagaagaatttgtaaggagaagatatgagcaaaatagttacgtcgggaacgaaaccaaaagaaggaggaggaacttcttcgatccaatgccctatgctaactcaaacaaattacacggcatgggctatgaagatggagattgctcttcaagtacacaaagtctgggaagctattgaaacagagtcaacagaacccgttgatgcagacaagaacatcatggctatagctttaatgattcaatccatacccgaatccctagctttgcaaattggagaatttaaagtagcaaagaaggtttgggaagctattcggtcgaggaacgtgggagcagaacgagttagagaagcgagactacagactctaatgaatgactttgatcgcttgaagatgaaggatattgagaagattgatgattttgtaggaaagttagcagaaattgcatccaaatctgcagctttaggagttcaaatcgaagaaccaaaactagtgaagaagtttctctcaagtctgcctcgaaagaaattcattcacatagttgcatcactcgaacaagttcttgatcttaacacaaacggatttgaagacattgtaggacgaatgaaagtatatgaagaacgagtggtagatgatgaagaaccacaagaagatcaaagcaagttgttgtatactaatcaagattaccaaacaaatcaagagtacaacaactgctacagaggaagaggtcgaggaggacgctcttattacagaggaagaggacaaggaaggtcgaatggtggaagagatacatccaaagtaacttgctatagatgtgacaaattaggtcactacgcctctgactgcccgaatcgtcttttcaagttgcaggaagcccaagagaacgagaaagacgatacacaaactgcagatgaactcatggttcacgaagttgtgtatctaaatgagaagaattgtattccaagcaactatgaaactaacaatggagagaatgatgtttggtatctcgataacggagcaagtaaccacatgacaggagatcaaagatacttcactagtatagataattctatcaccgggaaagtacgctttggcgatgattcacggattgatatcaaagggaaaggaacgatctcgttttttgacaggaatggcgaacaaagaaaaatgtcagatgtctatttcattccagatttaaaaagcaacatcattagcttgggacaagctagagaatcaggctgtgacataagaatgaaggatgacattctaacaatgcatgaccgagagggaaaattacttgtcaaagcaacaagatcaaagaatcgacttaataaggttcggatggcaaaaagaggaacaatgtgtctatatctaacaaacctcagcgaatcaagtagatggcattcaagattgggacacataaatctcgacacaatcaagtcaatgatacaaaaggagctagtaagagggatcccacacgttaagatcgaaaaagaagtttgtgattcatgtttgtttgggaagcaatcaaggcaatttttcccgcaagcaacctcatacagagccaccaagatacttgaactcgttcatggagacttatgtggtcctataacaccaagcacagctgcaggaaacaggtacatctttgtcattattgatgatcattctagatacatgtggacaactctacttaaggagaaaagtgatgctctcaataaattcaagcgcttcaaggtcttagttgaacaagaatctggaagcaaaattcagactttcagaatagacagaggaggagagtttgtatcacatgagttcactaagttttgtgaagaatcgggtattaaaagacatcttactgctccatatacaccacaacagaatggtgtatttgaaagaagaaacagaactctaatggaaatgacaaggagtgtcatgaaacacatgcatatacctagttacttatggggagaaacagtatgacacgccacctacctgctgaaccggatagctacaagatcgttgaatgacaacactccatatgaagctttctaccaaaagaaaccaaacgtgaatcatctcacagtatttggctgcattggatacgcagaagtggagacaccacacttgaggaaactagatgacaggtcgagaaagctagttcatctaggtactgagccgggttcaaaggcatatcgtctacttgacccagtaaatcggaaaattgtggtgagtagagatgttgtattcgatgaagaaaaaggatgggattggaatcacaacgaacctaaacaagatggaagcttcagtgtcacacttggagaattcgggaatcatggtctacaagaagaagacaacgaatatggtgagacagagcaaacacagcctattcacgtgaatgaagaacaacatgatcatgaaacctttgcagaaaatgaagaagtctctgctgatcttggaacagaaagtcaacaacctaatctaagaagatcgcaaagacaaaccataagaccaaagtaccttgaagactatgcattacttgtagaagaagaaggagaaaggctacttctaatattgaataacgaaccgagcagtttcagtgaggctaaggagtccagagagtggacacttgcgtgtgaagaagagatgttttcaataacaaagaataagacatggagtcttgaagatctgccgcatggagttaaacgtataggtctaaagtgggtttttaaactcaaacgcaactcggacgggagcatcaacaaatacaaggctcgattggtcgcgaaaggttacgttttggcgctatggagtggactttgaagaagtgttcgctcccgtagctcgccttgaaaccaaacgactacttgtgaaccttgcagcatcaaatggttgggagatacaccatcttgatgtcaagacagcatttctccttggagaactaagagaaaccgtgtatgtgacacaaccagaaggattcgaagaaagaggataggaagggaaagtctataggcttcacaaagctttgtatggattacgacaagcaccgagagcatggaaccataagctgaatcagattcttacagaactacaattcgagaagtgttccaaagaaccatcagtatatcgtaaaactgtaagtgggaatatttttcttcttgtggtagtgtacgtagatgaccttttcataaccggaacagatgaaagaagtattagtggattcaagagagagatggcttctaagttcgagatgagtgatcttggaaaattgacgtactatcttggaatagaagtctgtcaacaagagcaaggaatcacactaagtcaacaccgatatgcaatgaagattttagaagacgctgggatgaaggactgtaacttgatgcacataccaatggaatctggtttgcaattgtccaaatcacatcatgaagaaggaattgatgctaccggatacaggaaaaaagttggttgccttcgctatttaattcatacaagaccggatctgtccttttgcgtgggagtgttaagtcgatacatgcaagatccaaatgaatcacatggtgctgcaatgagacaatgtttgaggtacttgaaaggtacgactacactcggtttggtatttaaacgatcaagtgaaaagataccaaagctagtaggctatagtgacagcaaccacaatgttgatcctgatgatggcaagagtacagccggtcacatttcctaccttggagagagtcccatctcgtggtgttcacagaaacaagaaacaatggcaatgtcctcatgtgaagcagagtttatggcaggaacagaagcagctaggcaagcaatttggcttcaagacttgcttagtgaagttataggagaaccaagcgagaaggtgctcataagaatcgacaacaaatcagcaatcgcccttaccaagaatccggtcttccatggctgaagcaagcacattcataggcgttaccacttcataagagaatgcgtcgaaaatggacaagtggaagtagagcatgttccggggaatgagcaaaaggcagacatcctaactaaagcacttgggagaatgaagtttaaagagatgagagatcttatgggtgttcaagaagtgaagaggagtgatctcaagcttaaaggggagattgttggagtaagcttgagtattacttaagaaataagttatttagttttgagaaggattagattaaatctttgggagttatctgatagtagttttttatggtcaattatcctaaaacaccaatcatgtcgttgtagtattttaggtgtcaatccaaatgggtgtgatgcaaacagatgagatgtgatcaaaagtcactaagtcaagccaagcaataacagttttggggtttctaacagtcctaagcgaacatgcagaaaacagaaacaataatagaattactaaaatcactcgaccacaacaggctgatgccagaagtaggatgtggtcgagtaacagacaggatatgaaacagatatacttgactgcatagtctgttgccagacactgggtgtggtcgagtattctggtcgagtaacagacaggaaatgagacaactgtactcgactgcacagtctgttaccagacactgggtgtggtcaagtaagttgatcgagtaattgcaaaaacgaagaaacaggcaatgagaacgaataagcgataacgataaaacagagaaatcagatagacgagaaattcctaaggatggggtaatcgaatagagtggtatcctagcctatccgaatggttaacaagcgcaatcaaggtatccctagacaacaggttcaacaacagatcaattcactcccttgatagaaatcctcaagcaaagctagcccagactaattcccattaacggaatctaattatgcaggcaataagaacagactgataaagtcaataaacgctctaaacggccaatcccttgggatagagacgaatatctcaggaactagtggatcaagcattccatagaacaccttctgggtgcgggaatgcttgggatcgaattccagttgattagaaagaaataagcagtaaacacaactagtcctgaagggattcaatcaattctaagacttaaccattctacagactacggattccacaactactctaacccatccttaagaattctgagtcactactctgacaacatgcttaaagacaataacatagaaacgaaagatgaacaagcaaatgaaagcaaaatctgaatgacttagaagaaaaatcgaaatataaaattgcaggaatgaaaagcggctgctgaataatagtgcaaaattcgtgtctctaaaagtgcatgtcccagggcgaaacccttagagacttatttatactaaaataagaaagcgggcttcgagcccacttaacggcccatgaacggcgtgatcaagagtgtcggctcaaagtgggcttcttgatgggcttcgaatgggtttcgaatgggcttcgaatgggccttctcttctcttctcttttcgatgctcaggttgtctggttgagtgcggattgataagagggtcaaggtggtggtcgagtaggttggttgacagaatgatctgggctgcttcttggcctctgtgatcgagtaagtgtgtcagcagtcaggatgtactggttcttcacctctacgatcgagtataactggtggactggcaaagtggactgcatggtcgcctctgcgatagagtagaattgtagaatggattgcctcctctcctctgcggtcgagtatatctggcagaatggactgcctagtctcctctatgatcgagtagaagtgtctggatggactgcttagctgactacttccctctcagctactggtgatcgagtatgtttggtggaagtgtgactttctgttctgttttccctctttctgagcaccaatagctccaaaacacctgaaacaactccagaatgtagaatgtatgcaagattagtcctagactcgactaaagatgcaaaatgtacgaaaatgatggtgaatgctatgaaagatggatgaaactagactcaaaatggtgattaaaggatgtgtaaaacatgcaaattatacacatatcaactcctccaaacttagtctttgcttgccctcaagcaaacaagtagacataagctgaaggagaggtttgaaggtggggattcagaaccaaagcatcaaataaatcagatagaatcaatgtccaagttggcagttctaggatgccatattatcgaactctactcaaaaacgttagccatgccttattatagttcaatcccactcttatactcgacctacacatgctttcaaatctaccaatccctttaacattcattagattaggaacgtgaatcaagctatgcatcatcaatgaactcatttggctaaggtgaaggtcaagagacacagatggtccctttctggtggttcaagtttagtaacaggggactctgaaaagaaatggactgagctttaggagaatgctaaaggtaagagccaacctatgcatacaagaatagtatcccatctacccaaaaacatacacagtgtatacaccagcagatggtactacccttaagcccagaatatgatcctagttctaccctttgcactcaaggcatttttttctcattcttatcttggatcaaaccactctttcttttctttgactcttattctaaggagaagtttcttttactttgttggatctagtggactttggttttctttgacaactatggctcatgttatcttcttgtgatcaagacttttctagactttttttcttttgttgtgagcctattttttttttagttccccaaaatccattactagactaacttgtttctcaacttccttctcctaagaacatcaacatttcctttctctcttattttctcatatactcgatccccacttcaagaatagacacccaccttgtcctatctagcccagaaaacgtggactagaactacatgagacactactcttgtcggctcaaacctaacactttcttccaagctcaatcctgaaacaggcctcacaatcgcacacgatatataacagggctcgaaagaaaggtttggttaagggcaagggaaactacttcaatgatggaagcagctacttgggttagcaagggtggtgaaaagtttaaagaaaacccaagtatgtatatggtatccatgagttcaaattcgatgctaagacatgataattgcaagtcagattcaggttcaaattgatagggaatggtatcagataataacagtgtgatcgagtagagcattcaagacatggtgcagttttacttcaatttcattgactacacatcagacaactagaaacgatgaacaaaaatgcttacaaggctatctcatcataatccccaatgcatatgcgacaatcctatatgaaacatcctagactcaatcctaaatgtgatgcaactatatgaacactctgtttttgtggaatacattttcagaaatgttttcattttttttttattttttttctatgtcttagatgaagttaagactcaaatgatgcaaataagactcactagcaaacatgttaaatacttcttgaatcctcccccaaacttaaactatacagtcccttgtgtaatagaagtctaaagaagagttcaagagacactaaaacaaaacgaaaacagaaaatggtatatacaatgatggttgtgtgtgccatctcctctctggtgtaatcccatggaatactgggaccttgttgttgttcctcctcctctggtgcatgatactcgatcgcagggttcacatgacgtttggtccgacggtcgagtatattggtctgagaaatggtctaaagtgtcgccttggtgatcgagtgaaaacgggcagttgggatgcctccatggtcgagtaaacttggtgacctgtagatgttaactcggcttcgagcccacttaacggcccatggacggcgtgatcaagagtgtcggctcaaagtgggcttcctgatgggctttgaatgggtttcgaatgggccttctcttctcttctcttctctttccgatgctcaggttatctggttgagtgcggattgatcagagggtcgaggtggtggtcgagtaggttggttgacagaatgatctgggctgcttcttggcctctgtgatcgagtaagtgtgtcagctgtcaggatgtactggttcttctcctctgcgatcgagtataactggtggactggcaaagtggactgcatggttgcctctgcgatagagtagaattgcagaatggactgcctcctctcctctacggtcgagtatatctggcagaatggactgcctggtctcctctgtgatcgagtagaagtgtctggatggactactgagctgactgcttccctctctgctactggtgatcgagtatgtttggtggaagtgtgactttctgttttgttttccctctttctgagcaccaatagctccaaaacacctgaaacaactccagaatgcagaatgtatgcaagactagtcctagactcgacttaagatgcaaaatgtatgaaaatgatggtgaatgctgataagtgtgtattttgcatgttttgagcatccatttgtcatcactttagcatcatatcatcactgttttatacaatttctcatcatttgtcatcactttacaatttttggatagatttgcatgcatgttgcatatttgcgttgatttcaggtgatttggagctgttgacaagctatctggaagaagcgggcctgatcatatcaaacgacttgaccccgaggtcgattaggagcttcaagatctcaacagatcactcgaccccctggtcgagtagaggacatcactacttcaccacatcactcgaccacgaggtcgagtgtcttcatcccatcacctgaccatcactcgatcacgtcactcgaccctgaggccgagtgtcttcaccttcattgccagaccactacttgacctcttcactctacgtggaagtcgagtatcaccatcaccaccactcgactacatactcgatgacaagcttcagagccttcttcattccgcactcaaccagacactcgagcacaaggaagaaaagaagactccagctattcactcgacctcccactcgaccacatgggtcgagtacagttcttaatccgtcccaatactgcgtcgttttaagtattagggtttcggaatatttggctgtaagtagcatgtacttcacattttggcagacaagtttttatctagttttattccgtagaccttgtgttctagaccttttgtaatccagatttctctttatctatttagtattcagtattcagcttttgttcttgatttcgtttactgttgttcattctgttatcatcttgttgttacacagttgttatcatgttttcaacttgttcaacgtttatgcttactgttatgatgtctgagtagtgaataggtttctgaggatgggttagagtagtgtagaattctcaatatgctaggtgattgagtattggttgatatatcccttctggattagttgttcttaatccctattgctttctgatcaactggaatttgagcccagacatttccgcgcccaaaaggtgttcgatgaaatgtctgaaccactaattccagagtttcgtgaccctgtaccaaggtattggttgcaaggagcgttttggctttaacttgttgattcgtaatgcctgttaggttatctctcgtcaatggtgattgagtctgggactaggttaacttgagagtctctgttgcggtggcacttagatttggttaatgaacttgttgtctagggttaatttattgagcatgtcaatcacctgtaaactgaggaaacgaaactactcaattaccccatcctcaggaattctttatctgattgaattctgtgtttactccactgttatttactgcatcttgttatctgtcgcgtaatttctgcagttctttcttgttactcgaccacccaattgtctggtaacagactgtgcagtcgagtatctgtattttattttctgtctgttactcgacctgtcactcgacctcacccagtgctctgcaaagagctgtgttggtcgagtgttttactgtttctgcttgaatttctattttctccatgttcacttagaactgctagaacacaccacaacctgttattgcttggcttgacttagtgacttctgatcacatcttgattgttagcatcacacccatttggattgacaaccttcagtattacaacgacatgatagtgctttaggtttaattaattaaaaacctattatcaaatgctatgaaagatggatgaaactagactcaaaatggtgataaaaagatgtgtaaaacatgcaaattatagacatatcattacctaaagatattattaggagttatctaatattaatctaaatgtttattctagaattatctattgatctctatataagagttaccaagttgtggttaaccttatgggtttttagagattgtgaagagatcaatagctttaggttttgagtaattttcctaaagagattaaagagagttattctttactttgagttcttaaacacatctctaaactagaaacacatctctaaactagagtatcttctaaaaaagaaatactacttaggcttttaagatccggttgcggttctacttcttatacccaatcaaaaacatgaaatcaagtcatatttgattccaaaaaactaaccaagcttcttctttcttctcaaagcattgttggtgtagctgaagtccgtatgagtctttggctttgtatcttctaacaaggaaacactacttaggattttaagatcgggttacagttctagtttttatactcaatcatacacatgaaatctagtcatatttgactccaaaacactaaccaagcttcttcttgattcccaacgctttaatagtgttaccaaagtccacaacaatctttagctttgtatcttctaacaaagaaacactactttgggttttaagatccggttgtggttctagttatactcaatcatacacatgacatcaagtcatatttgactctaaaacactaactaagcttcttcttgcttcacaaagctttgatggtgtagctaaagtccgcatgatttattggctttgtatcttctaacaaggaaacactacttaggcttttaagatccggttgtggttctagttcttatactcaataatacacatgacatcaagtcatatttgactctaaaacactaactaagcctcttcttgcttttcaaagctttgatagtgtagccaaagtccgtatgagtatttggctttgtatcttctaacaaacaaacactagttgggctttcaagatccggttgcgatttgagtttttatactcaatcatacacatgtcatctagtcatatttgactccaaaaagctaaccaagcttcttctggcttcctaaggcgttgatggtgatgtcgaagtccgtatgagtctttggctttgtatcttctcgcatggaaactctacttttccttttcggatccgtttgcggttcaagttctaatactcaaccatagacatgacatcaatttatatctaactccaaaacacaaaccaagattcttgttccttctcaaagatttgatggtgtagccgaaatccgtatgagtcattggcgttgtatcttctaacaaggaaacactacttgggctttcaagatccagttgcggttcgagttcttgtactcaatcatacacatgacatctaggcatatttgactccaaaacaataaccaagctttttcttgcttctcaaagctttaatggtgtaaccaaagtccgtatgaatgtttggctttgtatcttctaaaaaacaaatactacttaggcttttaagatccggttgcggttctagttcttatacccaatcatacacatgacatcaagtcatatttgactcgaaaacactaaccaagtttcttcttgcttcgcaaagctttgttggtgtagctgaagtccgtatgagtttttggatttgtatcttctaacaaggaaacactaactaggcttttaagatcgggttgcagttccagtttttatactcaatcatacacatgacatctagtcatatttgactccaaaacactaacaaagcttcttcttgcttcacaaagctttaatggtgtaaccaaagtccgtatgaatgtttggctttgtatcttctaaatactacttaggcttttaagatccggttgcggttctagttcttatacccaatcatacacatgacatcaagtcatatttgactcgaaaacactaaccaagtttcttcttgcttctcaaagctttgttggtgtagctgaagtccgtatgagtctttggctttgtatcttctaaaagggaaacactaactaggttttaagatcgggttgcagttccagtttttatactcaatcatacacatgacatctagtcatatttgactccaaaacactaaccaagcttcttattgattctcaacgctttaatagtattaccaaagtccacatgagtctttagctttgtatcttctaacaaggaaacactaatttgggttttaagatccggttgtggttctagttcgtatactcaatcatacacatgacatcaagtcatatttgactctaaaacactaactaagcttcttcttgcttcacaaagctttgatggtgtagctaaagtccgtatgattcattggcttgtatcttctaacaaggaaacactacttaggctttaaagatccgattgcaattcttgtcctgatactccatcatacacatgacatcaagtcatatttgactccaaaacaataaccaggcttcttcttgcttcccaaagttttgatggtgtacccaaagtccgtatgagtctttgtctttgtaccttctaataaggaaacactacttggactttcaagatccggttgcggttcgagttcttatactcaatcatacacatgtcatctagtcatatttgtctccaaaacaataaccaagcttcttcatgcttcctaaggctttgatggtgatgtcgaagtccttatgaatcttttgctttgtatcttctagcatggaaacactactttaaattttgggataagtttctgataataggtttttatggtcaattatcctaaaacaccaatcatgtcattgtagtattttaggtgtcaatccaaatgggtgtgatgcagacaaatgagatgtgatgagaagtcactaagtcaagccaatcaataacggttttggggtttctaacagtcctaagtgaacatgtagaaaacagaaacaataacagaattactaaaatcactcgaccacaacaggctgatgccaggagtaggatgtggtcgagtaacaggcaggatatgaaacagatatactcgactgcacagtctgttgccagacactaggtgtggtcgagtatactggtcgagtaacaaacaggaaatgaaacaactgcactccactgcacagtctgttgccagacactgggtgtggtcgagtatgttggtcgagtaattacaaaaactaagaaacaggcaatgagaacgattaagcgataacgataaaacagagaaataagatagacaagaaactcctaaggatggggtaatcgagtagagtggtatcctagcctattagaatggttaacaagcgcaatcaagctatccctagacaacaggttcaacaacagattaattcactcccgtgatagaaatcctcaagcaaagctagcctagactaattcccattaacggaatctaactatgcaagcaataagaacagactgataaagtcaataaacgctctaaacggccaatcccttgggatagagacgcatatctcaggaactagtggatcaagcattccatcgaacaccttctgggtgcgggaatgcttgggatcgaattccagttgatcagaaaaaaataagcagtaaacacaactagttctaaagggatacaatcaattctaaaacttaaccattctacagactacggattccacaactactctatcccatccctaataattctaagtcactactcagacaacatgcttaaagacataaacgcaggtaaacgataatattgcataagtaaagagataaagagtatagaaacaagatgacagatgaaatcaaaagcggaatctgaataacttggaaaagtctcgaattacaggttgtagaagcaaaagcggcgcagcaaagtaaaacagaaataaaactgaagcaaaaactcaatgtcgactggatgtctcaggacagaaccctaagacatctattaatacaaaacaaaataaaatgatggtaaacaggccaataacctaattacccggcccatagaaagataatgggccgagatgggcttcgtgatccgatggaggtccaagccgcttctaaacactttgtcttctcctcttctcttccttgtgctcagcttgtctggttgagtgcggatttgagtagactgtgaagacgtgatcgagtgtccggtcgagtgatggtgatggtgtggcgaagtgatactcgaccatggggtcgagtgatgtggtagagtgaacggtcgagtgttgtcaggtggtgtggcgaagtgatactcgaccatggggtcgagtgatgtggtagagtgaacggtcgagtgttgtcaggtggtgtggcgaagtgatactcgaccaggggatcgagtagtgtcattgagtagcctgagctgaggatactcgaccaagtggtcgagtaggtgggaagaatgactccaaagtcactcgacctgggggtcgagtatgtcttctggttctggctcgtttcttccaatttgctcgcaaacagctccaaatcacctgaaaacaactcagaaatgcaatatgtatgcaaagttatcctaatcatgcaaagtatgcaagaatgatgagaaatgatataaaatagtgatgaatgatacgaaactggactcaaaacgatgatgaatggacactgaaaacatgcaaattatagacatatcaactcccccaaacttagtctttgcttgccctcaagcaaataagaagacatagttgaaggagaggtttgaaggcggggactcagaaccaaagcatatgttagagcaaataaaatcaatgtccaaattggtagttctaagatgcgatatgattgaattttactcaaaaacgttagccatgccttgttatcaatcaatccgtctcttatactcgacctacacatgctttcaaatctaccaatccctttaacattcattagttctggaacgtgaatcaagcaatgcatcatcaatgaactcatttggctaaggtgaaggtcaagagacaaagatggtcccttacagaataggcttaagtaacaggggatccctcaagaatgattgagctttagtagaatgctaaaggtaagtcccaagttatgcatacagagataagatcccatctacccagagtatagcaatgaagttctaatggtaatcccaactcctgtcccaacttaactctaccatttgcactcatgaatctttcaaactctttttcatatcattcttttattttctcttaactctaggagaagctttctcaacactctgatacatctagcggatttggatttctttaacaactaaggttcctgttttaaatctttaaaaccaaaggcttttaacccttcttctttagctaacaagaacctcattcttttctttaacattcccaaaacctttactagatttttttctaacttctttagcttacttcccctagaattctttccctttccttatcaacaataaattcacccttttcttttaaagacatcccaacccatgatataagcgcccacctagtcctatccagtccgaagaacgcgaactagaactacatgagacactatctctgtcgttacgaagctaacactttttaccaagctcaatcgaaataagacctcacaaacactcacaagtgatatagggcttgaaagaaagttcatgtttgggttcgggttaactgctctaataaggagagtcagctatttggatcaacaagagtggttaaaaggagtaagaaaatccaagtattttagggtatccatgagttcaaattcgatgccaagacatgataattctaaatcagattcaagttcaaattgatagggaatgatatcagatcctaacagtgtggtcgagtagagcaatctaggcatggtgcagttttacttcaatttcaatgacaacgcatcaaacaactaacaacgagggcactgagcttatctggtgaaccaaaatgcttacaaggctatctcatcattatcccctatgcatatgcaacaatcctaaacgaaacactctagactcgatcctaaatgcaatgcaactacatgaacactctatttttgtgaaatcattttctgaaatttttcaatttttttggttcttttctatgccttagatgaatgcagactcaagattatatacaatgcaatacacactttctgagccctcccccaaacttaaatcacacagtccactgtgtgaccaaatttggaagagagtacttaggacaaaacacatcacaaaaacaaaataaaaacaagagatggtatattacaatggtggagtgaggtgcatacctcagtggaagaaggagcgaagttggtcgccaatagctgcctgtgattgctcccaggccatcgaagaatctccctgctgtgtctcagcttccccctgggggtactcgacctctgctccttcgtcgcggccagcaccgctctgatgatactcgacctctcttcttctgctgcggccagcaccgcggtcgcgtaagctacgggactggagaagtcgtgtactcctgctgccagaccgagcgagtgcagccttcttctttctcccgagctcccgaggctcgaatgatgaatgccttgcagggactggtgggactactcggtcactaggctcaggcttgtggtgacttggctcaggcctgtgatgacttggccctggcgcgtcatatctcctcgaaggcatgtcctgaggacgctctccctgcggaatagctgtggtagaagagaagcagctaagcttgtctgtcagaaacgtgatggctttgaagcacttgatgagtagcctatcttgtttcttgcaccacctctgcaacttactgttgtttctgtgagcttcactcaagctcttgctctcccgcgctggaggtacgtgctctctgaaatgatacatgctcgtatcgtactcctcctccctatcctcatccgtctcagcaatatcatcctctatagcttccgtcgtagggacattatcatcagtcggtggagcgctctcaaagtagaggtaatcacgtgcaggtttgaagtcaatgttcctaccctgaagtatggtcgtggcctcgatgcagggaagcaaaatgttggctgttcggatcagggagtgctcgaatttgtagcgatagaaatcgccaaccatatcatactccagaaactcacaacaacgcaagtgatctaaatccatcatcctcggatcaaaccttggagacgtgagaggtacaccacatgcaatcagaatcggtgtcacaacgccacctacacaaagggctcctcgcaccttcttcttcccgttggtgtgcgcccacttcctgtatccacataggtggatcaacagaagcataaccggtggtgcatcattaaggtcgccctttaggaccttcttcccctttgttctccggagaatgcccttgagtggagaatcaatcatctccatgtctgtgttaaacacggtgcctgtagattccctggggtacagaacattcgctactgagcgctgatagtagcggatcacagggctacgaatctggttgctcttagaccttgcaaagttgagcgccaaatcgttcccaatggttaaccacaaatccttcaactcttccctctcgaacttgggtttagttccctttccactgggaaaaccaaataatccttccaagctcttgatagatagctggtaacgctgctcgttcactgaaaaagtcaagaaccccaacccttcactctccagctcatctgctgtaagtccctgatacatctccacttgcagagtgaagagaaactctattgtttccttcttgtaagcgacgtacgggtaagacatcagcgtctccagatggcacttctcgaataagtgatgtacgtcctccagtagccccagctatgctaaagtctcataacaggggtacctcgttccccagaagtcgttcatcaggcttgttcaacagcttcgtttctctgtgccatgactcaggctcatactcgacgtcaatatcttcgtcgatcaactcatatctgctggtcattgctctctttctctagcaatctcagctctcttctcattgcgtcgagctactgagcgttgggtctcagctctaaagctctcataagcctgtcgctctctctctggtccagttgaccaagattcagcttcatcgacgttgtaatctgcatccatggaggattcgccactgtagttactcatattgatttcctgaaaaataatgtaacttaaaaccaaatatcaatatgttagtccaaataaacacaaacactaaaccaatcaagttcacggtcgagtaaccggtcgagtatagtcaaattgtgtgttcaaattttgtggtcgagtggaagagaatgagaaacggtgactgtgtggccgagtaaatgtcgaatggagagaagacggtggcggtttgaggagcggtcgagtgaagagatgaacggaggcgaagtgaatggcgaggtcgagtgaacggtgagaacggagagttgagagaaagagatcgaagtagaggctgaggtgctcttgcggtcgagtgaatgggaggcgagatcgagtgaggaatgttgaagttggagcggcgagatcgagtgaaaaggaggcgacggtgagagtccggcggagtgaagggcggagtggtcgagtgaacgacgagaagctccggcgaagtcgagttagcttgcgagaacgagagagagaaactctggccgtttatcgaaaatcgaatgaagagcctctttgtccaaattgcgatgcggtcgagtgaaagaagtcgagtagcggttgagtgaagatgaaacctgtcccgtcgtcgagtgaatgagagagagagggcggaggcgtgagcagtgagagctgggacgacgaggtcgagaaagcggcggatggagaggagggcgttgcaatcgagtaaatgggaggcggtgcgagagatgacgagtgaggtttggtcgagtgagagggtgacaaagcagcgagagatggtgaagccggaggggagagatcgagtgaacggtgaggtcgagtgtgatggtgcggtcaagtgcttggagaggaagagagatggtgaggtttggtcgagtgagaaacgtgaggtagagtgaatcttcttggtcgagtgtttggagagggagagagatgatgtcggtgggagaggatagggatagagtgagatcgagtggttgggaaagagggaagagattttgttatctctaaaaacgcgtgggggaacaaaggtgagaggtggttggccacgctctgtctgtttgtcctgaagcgctgttctctgttgactagaaccttctgtaatcctctgtaaacttgttaaactccctgcaagtctctgtagcttctgttggtcgagtatagatatgatttaaaaattttgggtttttttaaaatcatcactaatactcgaccaaacttactcgacctcatggcctcttagtgcaacaaaagtttttcaaactcttgaatttctgacatactcgttctcctgttgctctgtagagtaaaatttttaaatttttactctacctccacgctgtttctctgttcctgagaatcacaaacacaaccaaaaacaaatcaaaaataacaagaaaataaaagttttatttacagaaacagtcttgggaattcctcccaagtgagcttgtttaaagtctctagcttgactcctcacactcattaagaagaaaatgggtgatagagaggatcttcatagtcctctctgatctcatcatcatattcagcatcctctcttgagagatgagtagcagaatactcaattcttctttcctcgaaataggcctctttctcttctggtggataatctatctccttagaccatcttgaagtaatcttttttctcgggatagtgttattcccgcatttggattgagctatctcttgcatatgatccagtttactcttaagttcctcaactgtctgagctagcttctctatggtctcttcttgctcatcagatttctttttgagatctcgcaagttaggtgtagaggctgtgcttggtctggtgattgaattcgaacgttgaggttgagccctgatcttttcttctacagctgacctttgcgaagtttcgttgatgtcaaactgcatcttgatgtgcttcccaaggttaagacttattctcccatctctgacatctatcatcgcttccactgaggctaagaaaggtcttcctaggattagaggatccttaggttctgcttccatatcaagaacaacgaaatccgtaggcacttccactccattaatcattactggcagatcttgtagaaggtcaaagggttttcttgaagacctatcagcaaggatcaaagtcaggtcgcaaggcctgtactgagtgaattccagcttccttgccacggagagtggcattaagcttactgaagctcccaaatcacaaagacaatggctgaaaaccaattgaccaatgaaacatggtagagtgaaagttcctggatcttcctgtttttcttgaacactcctcttagcagtggtcctaaacggaatagcatcacattcgtcttctgaatcttgatgaatcttgatcctttccagaattgactttctcacatctttgtgaggatccgggattaggttgagaacttctattagaggcatcaccgcttccatctcatcaagccgtttccatctcatcaagctgcttctctgcaagagaattgtatctttctatacatgctttcctgaattttctatggaagagcacgtgaaggtaatggtgctggcttgaatcgttttaccatcctctcaatgatggctgctttctcgtctaggttggactcggtttgaaaacgggatccagctgaatggtcgagtccaaccactgaaatttcaatctgagtagaagcctccccgtcctgaacatcactgtcctcggtgattgatgtggaaacatgtcgagtaggcagctctcgatcatgacagatggtgatagcgtgagcggtggcgtattccttcgggttctgtattgactttcctggaagtcctgttacttttggagcagaagttgacgctgtttgtccttccatgtatctgaccttagaggtaagtgcctcaagtttgatattcagatcattgaaagtacaatcaaccttgttgtggatttttgccatctttttggcaagatccattgcacctgcagcttgtccctagagaatctgctgtaacatgttcttcaagtctgaatctggagttgttgaagctagttgttgttgctggtgtgtgaacctaggtggtggaagttgctgctgatagttgccctgatactgcggcttaggaacatacccctgaccttggttgtatgaacaaagggcttgggttgattttgctgctgtgaagggtagacttggtcatgcgggtttgcaacatttgtactcctgtaagacagatttggatggctctgcttgaagttgttgaaacctttgttgtaacctccttggttctgcacatagctgacctccttggttctgcacttggactgtctcatcatcacccagaaaatgaatgtgcttttgttgcacaaggagtagcttgtccagtttgtcattcatggctttcatttccctgcggtgcttctcatcagaatcagagctggtgcggatgcttctgtcataatcttcattatagttgccatccgactgagctaagttctctaccagctctcatccttcttcaacgtctttgttgaggaagttcccgttggaagcggtatcaagaagcattctgatcttgggaaggacacctctatagagagtgctgagaagtgaagctttggagaaaccatgatgaggacattgcgtctgataacctttgaagcgctcccatgcttcacagaaagtctcattattcgtttgagtgaaactggagatatcattccttagtctcgcagtcctggagtttgagaaaaacttagccaagaaggctttcttgcagtcattccaggaggtgatagagccttgaggaagtgacttttcccactgatgtgctttgtctccaagagagaatggaaacaatctgagcttgaaaccatcctcactaactccattgatctttgttaggctgtagagcctatcaaactcgtccaggtgatcgagtggatcctccatagggaggccgtggaacttgttgctctgaaccatggcaatgagaccgctcttgatctcaaagttgttgttctgcacaggtggaggcacgatgccattacgctgattctggttgcgtggtgcatcgcctgcacctatgttgtttggttgcacctgctcatcaacaactgcagccattgtctctgtttctgtctgtgttctgagttggcgtgcaatacggtcgatgttatcgttgaacaggagattctgatttcctcgtgaccgtatttgcatacaacgagtaccaacttgtaaagctggtatcgtagtacctaaatcaaaacagacaaacagaaaaaacacaaagttagtaactttcagaaaaaatgaaaaagataacagcgccaaattgataataggtttttatggtcaattatcctaaaacacctatcatgtcattgtagtattttaggtgtcaatccaaatgggtgtgatgcagacaaatgagatgtgatcagaagtcactaagtcaagccaagcaataacagttttggggtttctaacagtcctaagtgaacatgcagaaaacagaaagaataacagaattactaaaatcactcgaccacaacaggctaatgccaggagtaggatgtggtcgagtaacaggcaggatatgaaacagatatactcgactgcacagtctgttgctagacactgggtgtggtcgagtatactggtcgagtaacagacaggaaatgaaacaactgcactcgactgcacagtctgttgccagacactgggtgtggtcgagtaagttggtcgagtaattgcaaaaactaagaaacaggcaatgacaacgattaagcgataacaataaaacagagaaataagatagacgagaaattcctaaggatagggtaatcgagtagagtggtatcctagcctattcgaatggttaacaagcgcaatcaagctatccctagacaacaggttcaacaacagattaattcactcccgtgatagaaatcctcaagcaaagctagcccagactaattcccattaacggaatctaactatgcaggcaataagaacagacttataaagtcaataaacgctctaatcggccaatcccttgggatagagacgaatatctcaggaactagtcgatcgaacattccatcgaacaccttctgggtgcgggaatgcttgggttgaattccagttgatcataaagaaataagcagtaaacgcaactagtcctgaagggattcaatcaattctaaaacttaaccattctacagactacggattccacaactactctatcccatccctaagaattctaagtcactactcagacaaaatgcttaaagacataaacgcaggtaaacgataatattgcataagtaaagagataaagagtatagaaacaagatgacagatgaaatcaaatgcggaatctgaataacttggaaaaatctcgaattacaggttgcagaagcaaaagcggcgcagcagagtaaaacagaaaataaaactgaagcaaaaactcaatgtcgactggatgtctcaggacagaaccctaagacatctatttatacaaaacaaaataaaatgatggtaaacgggccaataacctaattacccggcccatagaaagataatgggccgagacgggcttcgtgatccgatggaggtccaggccgcttccaaacactttgtcttctcctcttctcttccttgtgctcagcttgtctggttgagtgcggatttgagtagactgtgaagacgtgatcgagtgtccggtcgagtgatggtgatggtgtggcgaagtgatactcgaccatggggtcgagtgatgtggtagagtgaacggtcgagtgttgtaaggtggtgtggcgaagtgatactcgaccatggggtcgagtgatgtggtagagtgaacggtcgagtgttgtcaagtggtcgagtaggtgggaagaatggctccgaagtcactcgacctgggggtcgagtatgtcttctggttccggctcgtttcttccaatttgctcgcaaacagctccaaatcacctaaaacaactcataaatgcaatatgtatgcaaagctatcctaatcatgcaaagtatgcaagaatgataagaaatgatataaaacagtgatgaatgatacgaaactggactcaaaacgatgatgaatggacactgaaaacatgcaaattatagacatatcagtttccatttctagtccaaatacttaaccatacacatgacatcaagtcatatttgactctaaaacactaactaagcctcttcttgcttctcaaagctttgatagtgtagctgaaattcgtatgagtcattggctttgtatgttctaacaaggaaacactatttgggctttcaagattaggttgtagttcgagttcttatactaaatcatacacatgtcgtctggacatatttgactccaaaacactaaccaagattcttcttgcttcttaaagttttaatggtgtaatcaaaatctgtatgagtctttggtttgtatcttctaacaaggaaacactacttaggcttttaagatctggtagtggttctagttcttatactcaatcatatacattacatcaagtcatatttgactctaaaacactaactaagcctcttcttacttcccaaagctttgatagtgtagatgaagtccgtatgaatcattggctttgtatgttctaacaaggaaacactatttaggctttcaagatctggttgccaatctaggtcttatacttaatcatacacaggacatcaattcatatttgactccaaaacactaaccaagcttcttcttgcttctcgatggtgtagccaaagtccgtatgagtatttggctttgtatcttctaaaaaagaaacactacttcggcattcaagatccggttgcagtttgaattcttatactcaatcatagtcatatttgactccaaaaaactaaccaagcctcttctggcttcctaaggctttgatggtgatgtcgaagtccgtatgagtctttggctttgtattttctggcatggaaacactacttttcctttttggatccgtttgcggttcaagttctaatattcaaccatagacatcacatcactttatatttaactccaaaacacaaaccaagattcttcttgcttctcaaagctttgacggtgtagccgaagtccgtatgagtaattggcgttgcatcttctaacaaggaaacactactttggctttcaagatccagttgtggttcgagttcttgtactcaatcatacacatgccatctaggcatatttgactctaaaacaataatcaagcttcttcttgcttctcaaagctttaatggtgtaaccaaagcccgtatgaatgtttggctttgtatcttctaaaaaataaatactacttaggttttaagatccggttgcggttataattcttatacccaatcatacacatgacatcaagtcatatttgactccaaaacactaaccaagcttcttcttgcttctcgaaactttgttggtgtagctgaagtccgtatgagtctttggctttgtatcttctaacaaggaaacactacttaggctttaaagatcgggttgcagttctagttcttatactcaaatcatacacatgaaatctagtcatatttgacaccaaaatactaaccaagcttcttcttgattctcaatgctttaatagtgttaccaaagtccacatgcgtcttttgctttgtatcttctaacaaggaaacactactttgggttttaagatccagttaaggttctagttcgtatactcaatcatacacatgacatcaagtcatatttgactctaaaatactaactaagcttcttcttgcttcacaaagctttgatggtgtagcgaaagtccgtatgattcattggctttgtatcttctaacaaggaaacactacttaggcttttaagatccggttgcaattctcgtccttatactccatcatacacatgacatcaagtcatatttgattccaaaacattaaccaagcttcttcttgcttctcaaagttttgatggtgtacccaaagtccgtatgagtctttgtctttgtaccttctaaaaaggaaacactacttgggctttcaagatccggttgtggttgagttcctatactcaatcatacacatgccatcaagtcatatttgacttcaaaacaccaaccaagcttcttcatgctccctaaggctttaatggtgatgtcgaagtcagtatgaatattttgctttgtatcttctagcatggaaaaactaattttgcttttgggatccgtttgtagtttaagttctaatacttaaacatacacatgacataaagtcatatttgactccaaaacactaaccaagcttcttcttgcttctcaaagcattgatggtgtagccgacgttcgtatgagaatttggctttgtatcttctatcaaggaaacactatttgggctttcaagatccggctgtggtttgagttcttatactcaatcatacaaatgacatctggtcatatttgactgaaaaacacaaaccaaacttcttcttgcttctcaaagctttaatggtgtaaccgaagtccgtatgagtcttgggctttgtatcttctaacaaggaaacactacttgggttttcaaaatccggttgcggttctagctcttctacttgataagtgtgcattttacatgttttgagcatccatttgttatcactattgcatcatattaccatttttttatattatttctcatcatttgtcatcactttgcatgtttaggatagttttgcatgcatgttgcatatttgtgttgctttcaggatatttggagctattggcgagttaattggaagaagcggacctgatcatatcaaaccactcgacctacctagtcgagtacatggcttaacgacttcaacacaccacctgacaatcactcgatcacaccactcgaccccctggtcgagcatccccatcacaatcactcgatcactcactcgattacacgaccgagtcccaccatcatcacacactctacgatcactttaacaccaagccgagtaccaccatctcaatcactcgacttcttactcgacttccagctttagagtcttctccattccgtactcaaccaacactcaagcacaaggaagagaagaagactccagcttatcactcgacaaattactcgacaacctgggtcgagtaccgttcttaatccgtcccaatattgtgtcgttttgagtattagggtttcataatatttcgctatcagtaccatgtattttacattttcgtttacctaagttttattttccgcagacactgtgttcttgacgtttttgtaatccggatttctcttaatctattcagtattcagtatttgcttttgatttggtttaccaagttgttcatcctattatcatcctgctattactttgttgctatcatgttgataagtgtgtattttgcaagtttgagcataccatttgtcatcactttagcaccttatcatcagtgttttataccattctcatcatttgtcatcactttgcatgtttaggataggtttgcatgcatgttgcatatttgtgttgatttcaggtgatttagagctgttgacgagctaactggaagaagcggacctgatcatgtcaaaccactcgaccccgaggtcgagtagaagcttcaagacctcaacagaccactcgaccccctggtcgagtaggggagttcacaatttcatctcatcactcgaccctctggccgagtaccaccacgagagatactcgatcacctcactcgaccacctggtcgagtgtattcacctccaccacctgaccagtcactcgatcacatcattcaacccccaggttgagtgtcttcaccaccaccactcgactacatactctatggcaagctttagagtcttcttcattccgcactcaactagacactcgagcacaaggaagaaaagaagactctagcatatcactcgacctctcactcgaccatctgggttgagtatagttcttaatatgtcccaatactgcatcgttttgagtattagggttttcgaatattttgctataagtagcatgtactttacattttcgagaagaggtttttatctagttttatttcgcagacattgtgttctagaccttttgtaatctggatttctctttatctattcagtattcagtatttgttcttgattttgtttattgttgttcatcctgttattgttttgctattacactgttgttatcatgttttcatcctgttcaacgtttatgttctcttcaatgatgtctgagtagtgaataggtttctgaggatgggttagagtagtgtagaattctcagtatgctaggtggttgagtattgattgatagatcccttctggattagttgttcttaatccctattgctttttgatcaactggaatttgagcccagacatttccgcgcccaaaaggtgttcgatgaaatgtctgaaccactaattccagagattcgtggctcagtaccaaggtattggttgcagggagtgttttggctttaacttgttgattcgtaatgcctataaggttagctctcgtcaatggtgattgagtctgggactaggttaagttgagggtctctattgcggtggcacttagatttggttaatgaacttgttgtctagggataatttattgagcatgtcaatcacctgtaaattgaggaaacgaaactactcaattaccccatcctcgggaattctttatctgattgattttattgtttactctactgttgtttactgcatcttttcatctgttgcttagtttctgcaattctttactgttactcgacctgttacttgaccccccagttgtccggcaacagactgtgcaatcgagtatccctgttacattttctgtctgttactcgaactgtcactcgaccacacccagtgctctgcaacgagctgtgttggtcaagtgttttattgtttctgcttgattttctgttttctgcatgttcacttaggactgctagaacacaccaaaacctgttattacttggcttgacttagtgacttagtgacttagtggcttgctagaacactgctagaacaccaatcatacacatgccatcaagtcatccttattgttagcatcaaactcatttggattgacaacctaaaatattacaacgacatgattggtgttttaagataattgactaaaaaacctattatcaatttgtccctgttgccaattgggtgtttgtttgttacatttgagatttcagacttgcttagatcaagttctttttcaattttcaatttggttgctaactgtgtgtttttcttgttgtcttcttgttctaggtacacctctgctgtatgattggtgttctagcagtgttctagcaagccactaaaatactacaacgacatgattcgtgttttaagataactgactaaaaaatctattatcaatttgacgccgttgccaattgggtgtttttttgttacatttgagatttcagacttgcttagatcaagttctttttcaattttcaattcggttgctaactgtgtatttttcttgttgtcttcttgttctaggtacacctctgctgtatgcaaactcgatcaacaggcaatccgaacctccttttcaacgacaacatcgaccgcatagctcgcgaactcagagaaaagagaaacacagtcaacctaataccacaacaaccactcgaaatggctgacgaacagaatcatcaaaaaggccctgccaacattggtgctggaaacgcaccacgtgatcaccgttagcggaaaggaattgcacctcctgctatctagaacaacaacttcgagattaagagcggtctcatctcgatgattcaggggaacaaattccatggtctgccaattgaggatccactcgaccaccttaatgaattcgataggctctgcaacctaacaaaaatcaatggtgtcagtgaagacggattcaagctccgtttgtttccattctccttgggcgacaaagctcacatttgggagtagaatctgtcccatgactcaatcaccacctgggatgattgcaagaaggcttttctatcaaagttcgtctccaacgccagaactgcaagactcagaaatgagatctctggctttttacagaaggctggtgaaagcttctgtgaagaatgggagcgttttaagggttatacaacccaatgccctcatcatggcttcactaaagcctctctgctcagcactctttatagaggcgttttgccacgcatgagaatccttctggaaaccgccagcaatgggaacttccagaacaaagatgttgaagaaggctgggaaattgttgagaaccttgctcaatcagatggtaattacaacgaggactgtgataggaccgtcagaggcacaactgaatctgatgacaaacaaaggaaggagatcaaagcactgaatgacaagctggacatgattcttcttagccagcagaagcatgtgcacttccttgttgatgacgagaagtatcaagtccaaggtggggagggtaaccagttggaagaagtcagctacatcaacaacaaccagagcggctacaaagggtataacaacttcaaaaccaacaaccccaacctctcctaccgcagcaccaacgttgttaatcctcaagatcaagtgtatcctccacagcaacaacaagatcagaacaaaccttttgttccttacaatcaaggttttgttcctaagcagcaatttcaggggaactaccagccgcaaccaccacctgggtttgcacctcagcaaaaccaagatcctgctgctcctgatgctgaaatgaaacagatggtacaacagctgctacagggacaagcatctagctccatggaaattgctaagaaattatttgaattgcaccataagctggactacaactacaatgacctgaatgccaaagtggaggcattgaataccaaagtcagatatttagaaggacaatcagcatctacctctgcacctaaagtcacaggacttccaaggaagtcaatacagaattcaaaggagtatgcaactgctcacgccatcactaactgccatgatcgagagctgccaactcgacatgtccctgacttaatcactagggacagtgatgttcaagaaaggaaggcttccactcagattgaagtctctgttcttgaattcaaccattcttcttgttctcgccatctcattcaatccacctcagaagagaagtccgccataatcgagagaatggtaaaacgattcaaacatacttcattaccctcacgtgcttttccgtggacattcaagaaagcgtggatggagagatacaagtctgttgcagcgaagcaggtagacaagattgaagaagtgatgccactgatggaaattctcaacctgattcccgatcctcacaaagatgtgagaaatttgatactggaaaagatcaagatgtatcacaattcagatgatgaaagtgatgccactccatctcgagctgttgataagaggattgttcaagaaaagttagaagatcctggatctttcactctaccatgttccattgggtaattagctttcagcgattgtctgtgcgatctcggagcctctgtcagcttaatgccactctctgtggcaagaaggttagagtttattcagtataaaccttgtgacctgactttgatccttgcggataggtctttaagaaaaccctacgacatgctgaaagatctaccagtcatgattaatggagtagaagtgcctacagacttcgtggtgctggatatggaagtagagcataagggtccttaatcctgggaagatccttcttagcttcagtgggagcagtgatagatgtcagggaagggaaaataagtctcaaccttggaaagcacatcaagttgcagtttgacatcaacaaaactccacaagggtcaacagaagatggaaaaacctttggaaatgatagagcgatctcaggagaaggatatgagactaaaagagtaaaggaacttaaaaagaggtctgagaagcaagatgaaactatagagaagcaagcccacactgttgaggaacttagaagtaagcagaatcagttgcagaaggaagctcaacctaaaggcgggattgacactatccctataaagaagttcacttcaagatggtctgaagagatagataaccctccaaaagagaaagaagcatattttgaagagaggggaattgagtattctgctgtagacctctccagggaggacgctgagtatgatgatgatattagagaggactatgcagaccctctctatcattcattttcttcttgataagtgtgaggagtcaagctagagactttaaacaaactcacttgggaggaagtcccatgattatccttgtaaataatttttactttcttgttatttttgatttattttagttgtgtttgtggttctcaggaacagaggaataacgtaaagctagagtaaaaattcaaaacttttactctacagacggcctagggaccgagtacattggttgagtgtttaaaatctaaaacttttaaatcatcatttcactcgaccaacagaagctacaagttcttacaggaagtttattaagtttacagaagattgttggatttcctgagactttcctagtgaagaaagaataataatttagaataaggagacagacgagggacccactgctgcaccctatgtctcccacgctcctaaccaacagacaagaaatccaactctttcttctcacaaccactcgaccccctcaccttatcctatctccactcaacctcgacgccatccccatcccacacctatcacttactcgacctcgttatctcctccacacctattaactcgaccccatccctcctcattcattacaaccaacaacccaactctcatactctcatccactcgacctcctcaccatcctcttcatatactcgacctcaacatctttctccacacaccaaacttttcgcaactctctcatctcccatcgtcgctcattgcaattcaagtcttcaagtgttcgttttaatcactcgacctccaagctcacaaccactcgattgcggcaactcacctcttcaccaaagccaccaccatcttctcttcttccgtgagctccacttcactcgatccctcataataaacttcttcatcgcctcttcactcgatcgcgtcttctcttctcacattcgcaaccgaggaatcattcagctcacctcgcctctcaaccaccacaatcactcgaatcaccgctcctccattttcacttaacctctttcaaaccgcatcaccatatctcctcctcttcaagctcaccactcgacctacgcatcactcttaccacgaaacgaacttcactcggtcgtacgaaatcacttgatcaaccgaaagaaaagaaaaaaaaaaaaaaattaaacgaaggtttactcgattacatcactcgaccggtttactgtgttggtttgtgtttttggttttgttgagactaacttattaacgtttatctttgagtttcaattgtttacaggtttgatcatgagtaactacagtcgagaatcctctatggatcctgattataatgtggatgaagctgagtcctggtcctctagaccggagagagaggaacatgtttacgagagcttcagggatgaatttcaacgctcctctgctcgacgtaatcagagaagagcagaaatcaccagagggaagagagcgatgcccagtagatatgagctgattgatgaggacatcaaaactgagtatgagccaaagtcatggtgcaagaagacgaagctactgaacaaacccgaataggttacagtggaggagtatatcagattctttgagatgaatgatttatggggaacgaggtatccctactatgagactttagcccagctggggttactggaggacgtgcagcatctgttcgagaagtggcatctggaaacactcatgtcttactcttacgcttcctataaggaggagacaatcgagtttctttccacactgcaagtggagatgtatgagggactcacatacattgagtttagggtttagggtttagggtttagggtttagggtttagggtttagggtttagggtttagggtttagggtttagggtttaaggtttagggtttagggtttagggtttagggtttagggtttagggtttagggtttagggtttagggtttagggtttagggtttagggtttagggtttagggtttagggtttagggtttagggtttagggtttagggtttagggtttagggtttagggtttagggtttagggtttagggtttagggtttagggtttagggtttagggtttagggttagggttcttgacgttctcaatggatgaacagtggtatcagctttcgatcaagaagttggaagaactgttttgtttccctagtggaaagggaaccaaaaccaggtttgacagggaagagcttaaggatttgtgggctactattgggaataatttaccgctaaacttggcgcggtccaaaagcaaccaaatccggagtcctgtgatccgctactttcaccgctcggttgccaacgttttttactctagggagtctacatgcaccgtgtctaacacggacatggagatgatagattccgcgcttacagggattctctgctgtacaaagggaaagaatgtcttgagaggcgatctcaacaacgcaccactagtcatgcctctgttgatccacctgtgtggatataggaagtgggcgttgacgaacgacaagaataaggtgacaggagcactatgcatggatggcgttgtgacgccaattctggaagcttgtggagtaccgcttaaggaaccagggttagcaccgagaatgatggacttggatcacttgcgccgatgtgagttcttggagtttgacatggctagcgactttcaccgctacaggttcgagcattcatcgattagaatcgccaacattcttctcccctacattgatgctactaggattcttgagggcaggaacattgacttcaagcctgcgcttgaagatctttatttcgagggcagtctgccaactgaggagattagtcacaccgaaggagctataacagaagatgttgatgagacagatgacatagattaggcggagtttgacacgagcatgtatcatttcagtgagcatatacttccagcgagggaaagcaagagtttgagcgaagctcacaggaataacatcaagctgcagaagtggtgcaagaaacaggataagtttctcgccaagtgcctcagggctatcaagtttctgaaggataagatcagctgctccacttccactacagctattccacagggacagctccctcaggacatgccttcgaggagatatgacgcgcccgagccaattcggcgcaaacctgagcctagagagcaggagattctgcatgtccctgcgaggcattcatcattcgagcctcatgaatctgggaggaagaggaggaccacactcactcaatctaacaacaagggtagacgacttctgcattctcgtagtttacatgaagaagagaggtcgagtatcctcagagcggtgatggccgccacagagctgaggaggtcgagtacccacctactggagctgatacggaacagggcggttcgtctatggccagggagcaatcacaagcagccattgacgaccgacttcgttcattcttcgactgaggtaagcgcctcacttcaccattgtattatatcatctcttgtgatttgttctttattttgtttctgtgaatggatttgtcctgggtactctcttccaagtttatccacacagtggactgtgtgatttaagttttggggagggctcaggaagtgtgtattgcattgtgtatattttttagtccgcatacatctaaggcatagaaaaaccaaaaaaattttgaaaaatttcagaaatgatttcacaaaaaaaagaatgtttatgtagttgcattacatttaggatcgagtctagagtgtttcatttaggatttttgcatatgcataggggataatgatgagatagccttgtaagcattttggttcaccggataaacttagtgccctctttgctagttgtctgttgcgtagtcaatgaattagaaataaaactgaaccatgcctagattgctctagtcgaccacactgtcatgatctgataccattccctatcaatatgaacctgaatctgatctttaattgtcatgtttgcatcaaatttgaactcatggataccctaaaatacttggattttctgatgagaaaaggtaaaagactctaggtaaggtaagctaaagaagcagaaaaaatctagtaaaggttttgggatttgtaaagaaaagaaagagttcttgttagctattgaagatgggcaaaagccctcggttttaaaatgctaaaaacaggaaccttagttgttaaagagatccaaatccgctagatgtatcaaagtgttgagaaatcttctcctagagttaagagaaaagaaaagaatgattagaaaaagggcataaaggattcatgaatgcaaagggtagagttaggtttttatattgggattggagatgggattaccattagagcttcatttgatatactctgggtagatgggatcttatctctatatgcatagcttgggacttacctttagcaatctactaaagcttaatcattttttgagagatcccctgttactgaagcctattctgtaagggacaatctttgtctcttgaccttttaccttagccaaatgagttcattgatgatgcattgcttgattcacgttccagaactaatgaatgttaaagggattggtagatttgaaagcatgtgtaggtcgagcatatgagtcagattgattaataacaaggcatggctaacgtttttgagtagaattcgatcatattgcagcttagaactatcaatttggacattgatttcatatggtttatcaggtgctttggctataagtccccgctttcaaacctcaccaccagcttgttcttaattgtttgcttgaggggaagcaaagactaagtttaggggagttatatgtctataatttgcatgttttcagtgtccattcatcatcgttttgagtccagttttgtatcattcatcactgttttatatcatttctcatcattcttgcatactttgcatgattaggatagctttgcatacatattgcatttctgatttgttttcaggtgatttggagctgtttgcgagcaaattggaagaaacgagccagacctagaagacatactcgaccaccaggtcctgtgcatccagcaccatactcgaccccaagtcgagtaactttggagccattcttcccatctactcgaccccctggtcgagtatcctcagctcaggccactcgatgatgccactcaaccccctggtcgagtatcacttcgccacaccacctgaccacactcggccattcactctaccaagttactcgaccccctggtcgagtatcatcactcaccaccatcaccatcactcgaccggacactcgatcacgtcttcacagtctactcaaatccgcactcaaccagacaagctgagcacaaggaagagaagaggagaaaacaaagtgtttggaagcggcctggacctccatcggatcacgaagcccatctcggcccattatcattctatgggccggggattaggttattggcctgtctactatcattttatttcgttttgtataaatagatgtcttagggttctgtcctgagacatctagtcgacattgagtttttgcttcagttttattttctgttttactctgctgcgccgcttttgcttctgcaaccagtaattcgagatttttccaagttattcagattccgcatttgatttcatctgtcatcttgtttctctactctttatctctttacttatgcaatattatcatttatctgcgtttatgtctttgagcatgttgtctgagtagtgacttagaattcttagggatgggatagagtagttgtggaattcgtagtctgtataatggttaagttttagaattgattgaatcccttcaggactagttgcgtttactgcttatttctttctgatcaactggaattcgatctcaagcattcccgcacctagaaggtgttcgatggaatgcttgatccactagttcctgagatattcgtctctatcccaagggattggccgtttagagcgtttattgactttatcagtctgttcttattgcctgcatagttaaattccgttaatgggaattagtctgggctagctttgcttgaggatttctatcacgggagtgaattgatttgttgttaaacctgttgcttgaggatttctatcactagcttcatcagttggtactcgttgtatgcaaacacggtcacgaggaaatcagaatctcctgttcaacgataatatcgaccgtattgcacgccaactcagaacacagacagaaacagacacaatggctacagttgtagatgagcaagtgcaaccaaacaacataggtgcaggcgatgcaccacgcaaccacaatcagcgtaatggatccgtgcctccaccagtgcagaacaacaactttgagatcaatagcggtctcattgccatggttcagagcaacaacttccacggcctccctatggaggatccactcgatcacctggacgagtttgataggctctgcagcctaacaaagatcaatggagttagtgaggatgacttcaagctcagattgtttccattctctcttggagacaaagcccatcagtgggaaaaatcgcttcctcaaggctctatcacctccaggaatgactgcaagaaagccttcttggctaagttgttctcaaactcctggactgcgagactaaggaatgatatctctggtttcacacaaacaaatatccctggtcctggctgacagatctgttagaattccccatggtctcctggaagacttaccagtcatgaaaggcgtggtcgaagtacctacagactttgtggttctagaaatggatgaagaacctaaagaccctttgatattgggaagaacatttttagctacagtcggagctatcattgatgttaagaagggaaagatcgatcttaacctcgggagagatctcaagatgaccttcgatatcaccaacaccatgaagaaacctacaatagaaggaaatgttttctggattgaagagatggatatgttagctgacgaaatgctagaagagctaagagaaacagatcatcaacagagtgctctaacaaaggatagctaagaaggagatttacatttggagactctagggtaccagaagctgttagatgaacacaaagcagttgagaatccaggagaatatgaagatttgggtgaaagagcaaggaaggaatatatacttgaccacatcactcgactaacagtccattcagtgtactcgaccgaactactcgaccacaacccctcctctgaagccaacttagtatccgatgactggtctgaactcaaggcacccaaagtagatttgaaaccgctaccaaaagggctaaggtacgtttttcttggactaaactctacttatcctgtcatagtgaatgatgagctaactgctgatcaagtaaacctgctgataactgagctcaagaagtataggaaagctataggatattcgttagatgatattaaggggatttcacccaccttgtgcacccatagaatccatcttgaaaatgaatcctactctagcattgaacctcaaaggagattaaatccaaacttgaaagaggttgtgaaaaaggagatacttaaactattagatgctggggttatttaccctatctctgatagcacttgggtatctccagttcactgcgttcctaaaaagggaggtatgacagttgttaaaaatgctaaagatgaactgatacccactaggactataactcgacataggatgtgtattgactataggaagttaaatgctgcctctagaaaagaccatttcccattgcccttcattgatcaaatgctagaaagattagcaaaccatccttactattgcttgttggatggctatagcggattttttcaaatccctattcacccaaatgaccaagagaaaactacttttacttgtccttatgggacctttgcttacaagcgtatgcctttcggtctctgtaatgcacctgctacttttcagcggtggttgacttccattttctcggatttgatataggagatggtagaggtattcatggatgatttttctgtgtatggctcttccttctcctcgtgtttgttgaacctatgaagggtactcaaaagatgtgcagagacaaacctggtgctgaactcggagaaatgccatttcatggttagagaaggcatcgttttggggcacgaaatttctgaggaggggatagaggttgataaggctaaggttgacgtgatgatgtagttatagccaccaaagactgtcaaggacatcaggagttttcttggacatgcagggttttacaaaagattcatcaaggatttctccaagttggcaagaccgctcacaagactactgtgcaaggaagccgagtttacatttgatgaagaatgtttgacagcctttaagttaatcaaggaagctttggtcacggccccaatagtccaagctccaaactgggacttcccattcgagatcatgtgcgatgcttcagattatgcagtaggagcagttttgggccagaggattgataaaacgttgcatgtgatatactacgcgagaagaacgatggatgatgcacaggtaaggtatgccactacagagaaggaactgctagctgtggtatttgcattcgaaaaatttagaagctacctagtcggctctaaggtgacagtctacactgatcatgctgctctgaggcatatatacgcgaagaaggataccaaacctaggctgttgagatggatcttattgctccaagagtttgatatggagataattgataagtagggaatttaaaacggtgtagctgatcatctaactagaatgagaattgaagacgaggtccctattgacgattccatgccagaagaacagctaatggcaattcagcaacttaacgagagtgctcaaattcggaaatcactcgatcaagtatgtgcaattgaagaaaagcttttgtggtatgctgatcacgtcaactacttggttagtggtgaagagcctccgaatttgtcgagctatgagaagaagaagttcttcaaggacattaaccacttctagtgggacaaaccttatctctacacactctgcaaggataagatctacaggagatgcgtttcagaagacgaaatcgaaggcatcctactgcactaccatgggtccgcctatggttgccactttgcaacgttcaagacagtgtcaaaaatcttgcaagctggtttttggtggacgacaatgtttaaggatgctcaggaatttatctcgaaatgtgactcatgtcaaaggaaagggaacatcagcagaaggaatgagatgcctcagaatccgatcttagaagttgagatctttgacgtttggggaattgattttatgggtccgtttcctttttcttacgggaacaagtacatactggtcgtagtagactatgtatcaattgggtggaagccatagccagccccaccaatgatgctagagttgtgctaaagctgttcaagacaattatcttccctagatttggagtcccgagagttgtgatcagtgacggagggaaacattttatcaacaaggtttttgagaaccttttgaagaagcatggagtaaagcacaaggtagccactccttatcatccacagacgagcgggcaggtggaaatctccaacagggagataaaagcaattttagagaaaacaatgggaattacaaggaaagattggtctactaagctcgatgacgcactatgggcttacagaacagccttcaagacccctattggaacgactcctttcaacctcctctatggaaaatcctgtcatttgcctgttgaactcgagtataaagccatgtgggcagttaaactcctgaactttggcattaaaaccgccaaggagaagcgattgatccaactgaacgatctcaacgagattcgcttagaagcttatgagagttccaaaatctacaaggagcgaaccaagtctttccatgacaagaagatagtctcaagagattttaaggttggtgatcaagtgttgctgttcaactctcgcttgaggctttttccaggcaagctcaagtctagatggtctggtcctttctctgttactgcagtccgaccttatggtgctatcactctagctggaaagaatggagacttcacagtcaatggacaacggctcaagaaatacatgatagatcagtttattccagaaggaacttctgttcctttggatgagcctataaacgcctaatgagtatgaagagtcaagctagagacctaaaacaagctcacttgggaggaagtcccatgcctatctttgtacatatctttaatttttcttgttgtttttgatgcatcttgttagtgttttcaggcgataagtatgaagagctgacggaaatagattctggctttgagggaacagcaatacactcgaccaaagagcaatcaaggatactcgacattgttctggtttctccaccccatgaaatcactcgaccacaccctacagggactgaatgacgatgtgatcgagtatagcgagtggtgcaatcaaaacttctccatgtcagtaaatcactcgaccacggtgctggccgcagcagaagaagagaggtcgagtatcatcagagcggtgctggccgcgacgaaggagcagaggtcgagtacccctagggggaagctgagacacaactgggagattcttcgatggcctgggagcaatcacaggcagctattgacgaccaactctgctccttcttccactgaggtatgcacctcactccaccattgtaatataccatctcttgtttttattttgtttctgtgatgtgttttgtcctgagtactctcttccaaatttggtcacacagtggactgtgtgatttaagtttgggggagggctcaggcaatgtgtgttgcattgtatataatcttgagtctgcattcatctaaggcataggaaaaaacaaaaaaattgaaaaatttcagaaaatgatttcacaaaaatagagtgctcatgtagttgcattgcatttaggaacgagtctagagtgtttcgtttaggattgttgcatatgcataggggataatgatgagatagccttgtaagcattttggttcaccagataagctcagtgccctcgttgttagttgtctgatgcgtagtcattgaaattgaagtaaaactgcaccatgcctagattgctctactcgaccacactgtttggatctgataccattccctatcaatttgaacttgaatctgatttagaattatcatgtcttggcatcgaatttgaactcatggataccctaaaatacttggattttcttactcattttaaccactcttgttagtccaagtagctgactctccttattagagcagttaacccgaaccaaaacctaaactttctttcgagccctatatcacttgtgagtgtttgtgaggtcttatttcaattgagcttggtagaaagtgttaggttcgtaacgacagagatagtgtctcatgtagttctagttcgcgttttcggactggataggactaggtgggcgcttatatcacgggttgggatgtgtttaaaagaaaagggtgaattcattgttgataaggaaagggaaagaattctaggggaagtaagctaaaagaagttagaaaaaaaatctagtaaaggttttgggaatgttaaagaaaagaatgaggttcttgttagctaaagaagaagggttaaaagcctttggttttaaagattaaaaacaggaaccttagttgttaaagaaatccaaatccgctagatgtgtcagagtgttgagaaagcttctcttagagttaagagaaaagaaaagaatgatttgaaaaagaaaaaaaaaagtttgaaagattcatgagtgcaaagggtagagttaagttgggactggagttgggattaccattagagcttcattgttatactctgggtagatgcgatcttatctctatatgcataacttgggacttaccttaagcattctactaaagctcaatcattcttgagagatcccttggtacttaagcctattttgtgagggaccatctttgtctcctgaccttcaccttagccaaatgagttcattgatgatgcattgcttgattcacgttccagaactaatgaatgttaaagggattggtagatttgaaaacatgtgtaggtcgagtataagagacggattgattgataacaaggcatggctaacgtttttgagtaaaattcaatcatatcgcatcttagaactaccaacttggacattgattttattcgctctatcatatgctttggttctgagtccccgccttcaaacctctccttcaactatgtcttcttattagcttgagggcaagcaaagactaagtttgggggagttgatatgtctataatttgcatgttttcagtgtccattcatcatcgttttgagtccagttttgtatcattcatcactgttttatatcatttctcatcattcttgcatactttgcatgattaggatagctttgcatacatattgcatttctgagttgttttcagatgatttggagctgtttgcgagcaaatttgaagaaacgagccagaaccagaagacatactcgaccaccaggtcgtgtgcatccagcactatactctacccccaagtcgagtaactttggagctattcttcccacctactcaaccccctggtcgagtatcctcagctcaggccactcgatgacgccactcgaccccctggtcgaatatcacttcgccacacaacctgaccacactcagccattcactctaccaagttactcgaccccctggtcgagtatcatcactcaccaccatcaccatcactcgaccggacactcgatcacgtctttatagtctaatcaaatccgcactcaaccagacaagctgagcacaaggaagagaagaggagaagacaaagtgtttagaagcggcctagacctccatcggatcacgaagcccatctcggcccattatcattctatgggccgggcgattaggttattggcccgtctactatcattttatttcgttttgtataaatagatgtcttagggttctgtcctgagacatctagtcgacattgagtttttgcttcagttttattttctgttttactctgctgtgccgcttttgcttctgcaaccagtaattcgagatttttccaagttattcagattccgcatttgatttcatctgtcatcttgtttctctactctttatctctttacttatgcaatattatcatttatctgcgtttatgtctttgagcatgttgtctgagtagtgacttagaattcttagggatgggatagagtatttgtggaatccgtagtctgtagaatggttaaattttagaattgattgaatcccttcaggactagttgcgtttactgcttatttctttctgatcaactggaattcaagcaaagcattcccgcacccagaaggtgttcgatggaatgttcgatcgactagttcctgagatattcgtctctatcccaagggattggccgattagagcgtttattgactttatcagtctgttcttattgcctgcatagttagattccgttaatagaaattagtctgggctagctttgcttgaggatttctatcacgggagttaattgatcagtctagggatagcttgattgcgcttgttaaccattcgaataggctaggatacaactctacttgattaccccatccttaggaatttctcgtctatctgatttctccgttttattgttatcacttaatcgttttcattgcctgtttcttagtttttgcaattactcgaccaacttacttgaccacacccagtgtctggcaacagactgtgcaatcgagtacagctgtctcatttcctgtctgttactcgacatgtatactcgaccagacccagtgtctggcaatagactgtgcaatcgagtatatttgtttcatatcctgcctcttactcgatcacatcctacttcttgcatcagcctgttgtggtcgggtgattttagtaattctattattgtttctgttttctgcatgttcacttaggactgtaagaaaccccaatactgttattgcttggcttgacttagtgacttctgatcacatctcatctgtttgcatcacacccatttggattgacacctaaaatactacaaagacatgattggtgtttaaggataattgactaaaaacatattattagggagttaataagtgtgtattttgcatgttttgagcatccatttgtcatcacttaagcaccatatcatcactgtataataccatttctcatcatttgtcatcactttgcatgtttaggataggtttgcatgcatgttgcatatttgtgttgatttcaggtgatttggagctgttgacgagctaactggaagaagcggacctgatcatgtcaaaccactagaccccgaggtcgagtagaagcttcaagacctcaacagaccactcgaccccctggctgagtaggggacttcacaatttcatctcatcactcgaccccctggccgagtaccaccacgagagatacttgatcacctcactcgaccacctggtcgagtgtattcacctccacaacctgaccagtcactcgatcacatcactcgacccccaggtcgagtgtcttcaccaccaccactcgactacatactctatggcgagcttcagagtcttcttcatttctgcactcaactagacactcgagcacaaggaagaatagaagactccagcatatcactcgacctctcactcgaccatcagggtcgagtacagttcttaatccgtcccaatactgcgtcattttgagtattagagtttcagaatattttgctataataagcatgtactttacattttcgagaagaggtttttatctagttttattccgcagacactgtgttctagaccttttgtaatccggatttctctttatctactcagtattcagtatttgttcttgatttcgtttattgttgttcatcctgttatcgttttgctattatattattgttatcatgttttcatcctgttcaacgtttatgttctctataatgatgtctgagtagtgaataggtttctgaggatggattagagtagtgtagaattctcagtttgctaggtggttgagtattgattgatagatcccttctggattagttgttcttaatccctattgctttctaatcaactagaatttgagcccagacatttctgcgcccaaaaggtgttcgatgaaatgtctgaaccactaattccagagatttgtggctctgtaccaaggtattggttgtagggagcgttttggctttaacttgttgattcgtaatgcctgttaggttagctctcgtcaatggtgattgagtctgggactaggttaacttgagggtctttgttgcggtggcacttagatttggttaatgaacttgttgtctagggataatttattgagcatgtcagtcacctgttaactgaggaaacgaaactactcaattaccccatcctcgggaattctttatctgattgattttattgtttactccacaggactttctatcaaagttcttctccaacgccagaactgcaaaactcagaaataagatttctgatttttcacagaagacgggtgaaagcttctatgaagcatgggagcgtttcagaggttacatcaaccaatgccctcatcattgcttcacgaaagcctctctgctaagcactccatagataggcgttttaccacgcatcagaatgcttctggataccgccaacaatgggaatttccagaacaaggatgttgaagaaggctgggaattggttgagaacctagctcaattagatggtaattacaatgaggactacgataggaccatcagaagcacagctgactctgatgacaaacacaagaaggagatcaaagcgctgaacgacaagctggaaaggattcttcttagccagtagaagcatgtgcacttccttgttgatgacgagcagtatcaagtccaagatggggagggtaaccagttggaagaggtcagctacatcaacaacaaccagggtggctacaaagggtataacaacttcaaaaccaacaaccccaacctctcctaccggagcaccaacgttgcgaatcctcaggatcaggtgtatcctccacatcaacaacaaggtcagaacaaaccttttgttccttacaatcaaggatttgttcccaacaatttcaggggaactaccagccgcaaccaccacctgggtttgcacctcagcaaaaccaaggtcttgcagctcctgatcccgaaatgaaacagatggtacaacagctgctacagggacaagcatctagctccatgaaaattgctaagaagttatttgaattgcaccataagctggactatagctacaatgacctgaatgccaaagtggagacattgaataccaaagtcagatacttggaaggacaatcaacatctacctctggtcctaaagttacaggacttcctgggaagtcaatacaaaatccaaaggagtatgcaactgctcacgccatcactatctgccaggatcgagagcagccaactcgacctgtccctgacttaatcactggggacagtgatgttcaagaaggggagccttcaaccaagattgaggtctctgttgtagaattcaaccattctgctggttctcaccatctcatttaatccacctcggaagagaaagcagccataatcgagagaatggtaaaacgattcaaacctactccattaccctcacatgctcttccatgaaattcaggaaagcatggatggagagatacaagtctgttgcagcgaaacagctagacgagaatgaaacagtgatgccactgatggaagttctcaacctgattcctgatcctcacaaagatgtgagaaatctgatactggaaaggattaagatgtatcacgattcagatgatgatagtgacgctactccatctcgagttgctgataagaggattgttcaagaaaagttagaagatcctggatattctactctaccatgttcaattggggaattagctttcagcgattgcctgtgcgatctcggagcctctgtcaccttaatgtcactctctgtggcaagaaggttggaatttatttagtacaggccttgtgacctgactttgatccttgcagataggtcttcaagaaaaccctccgacatgttgaaagatctaccagtcatgattaatggagtggaagtgcctacaaacttcgtggtgctggatatggaagaagagcataaggatcccttaatcctgggaagacccttcttagcctcagtgggagcagtgatagatgtcagggaagaaaaaataagtctcaaccttggaaagcacatcaagttgcaatttgacatcaacaaaactccagaagagtcaaaagaatatgaaaaaccctctggagacgatagagtgatcccaagagaagcgtatgagactgaaaaagtaagggagcttaaaaagaggtctgataagcaagatgaaactatagggaagctagcccacactattgaggagcttaagagtaagctgaatcagatgcagaagaaagctcaacctaaaggcggaattgacattatcccgagaaaaaggttcacttcaagatggtctgaagagatagattaccctctagaagagaaagaagcctgttttgaagaaaggggaattgagtgttctgctgcagacctctccagggaggacgctgagtatgatgatgatatccgagaggactatgcagaccctctctatcattcattttcttcttgataagtgtgagcagtcaagctagagactttaaacaagctcacttgggaggaaggtcccatgactatctctgtaaataaatttttcttttgttgttatttttgatttgtcttagttgtgtttgtggttctcaggaacaaaggaacaaggtggagatagagtaaaaattcaaaacttttactttacaaaagacctggagatcgagtgtatagcccgttggagtgcaaaattttgtaaattttctgttgcacatggagaccttgcactcgagtacattggtcgagtatgagtgatgtttaaaaccaaaaaattttaaatcatcatattactcgaccaacagaagctacagagccttacagggagttaatcaagtttactgtagatttcctgcagttttcccaatcaacagagtgtggaccacgcgctgaggataagatggagagagaatctcaaactcaatctccaccactgcttttgaaatttcactcgaccaacctctattcagttttccaccactcgatcgcaagaatcaacttgacctctgaaaccaagccacgctcgacctcgccgaaaccactcgaccgcagctggaaagaattacagccgccgcagtcgagttcaaagtcccactcgaccaccgattacgtttcaccttgaatcactcaaccacttcacttcgccgttaaccgtcacttcccgtctaagtcgagtctccacctcgtttaccgtcgtcgtctcaagagctactcgattacatccactgtactcgatcgtcgatttgaggtttcgtccctgccaattttggctcacctatggtatactcgaccaacctgattcaccatctgcacactacttcctcaacattactcgacctcttatatctgagccactcgattcaacccgtgaaagagaaacttggaaaaagttaagcttacttgagtatttgattgtacttgaccgtttgggtctatattgtctgttgttaacaattttggtttgattgttctctttgagactatcctattgatattggagttttgagttctaaatcttctacaagagaatcatgagtaattacagtggcaattcttcagttgatcctgactacaacatggatgagacatagtcgtcatcttcaaggccagagagagaaaagatagaatttgatagcttcagaagaaaagctgagatagctcgagggaagagagcaatgacagagaggtacgagcttatagatgaggatctagaagacgagtacatgcttgagcatactagtagagccacaaagcttcttcacaaaccagatgtattacctgctgaggagtatatcagactcttcaaactaaatgagttctgtagcacaaggtatccatgctcgaccacacttgcataacttggattgttggaagatgttcaacacctgtaccagagtagtcatgtggacactctgatggcttatccgtatgtagcatatgaagaagagacaattcaattcctctccacacggcaagtggagctttaccaaggtatgacctctgatgagttggattgcgaaggattgggattcttgagattctctgtgtatggtcatgagtataggttatcaatcaaacgcttggaaggactttttggtttccccagtggaacgggtactaagcccaagtatgacagagaagagttgaaagacttatggatcaccattggcagctctgtaccgctaaattcttccaggttaaagagcaatcagatacgcagccctgtcatcaggtacttccagcgttctatagccaatgtcctctactccagagagatcacagggactgttaccaattctgatatggagatgatcgctatatgctctcaaaggcactctctaccaaactaagaacaacatatctgtgaaatcaatgacacacctttctctgtacttcttctaatccacctgtgtggatacaagagctgggctgtcagcaataatcacaagagagcacgaggcgctctttgcatagtcggtgttgtgacaccgattctgattgcttgtggagtcccaatcacatctgatggactcgagccacgggcaattgatatcaagcatctacgtcactgcgaagtcctggagttagcatcctacgtcctgaagttcggaatggttggcgacatgcactgttttaggtttaagcactctacggataagagagctagcatccttctccccagccctaaggttacacggataatagagggagataacattgattttcggcctgagcttggaaacctctactatgagaacgctccgccattggatgaggatgatcttatagaagaagctgcttaggatgggatggatgaagacagagcagtggagttcgacactagcatgtatcattttgatgaacatgtacctctggcgagggagagcaagagcttgagtgaagctcataggaacaacaataagctgcagaagtgttgcaagaagcaggacaagcggctcgccaagtgctttaagactatcaagtttctgatagattaactgagctgttcctcttctactacagctattccacagggacagcctcctctagatatgccattgaggagatttgatgagcctgagcacagacctgagcttagtgagcagagagtctcacatgtccctgctaggcattcgtcattcgagtcccgggagcacaagtgaagaaggaaggctacactcgttcgctctagcagtagatcatgcctaattcactcgaggagatcactcgaccacggtgctggccgcagcagaggaagagaggtcgagtatccacagagctgatgaggtcgagtacccacctgctggagctgatacagaacagggtggctcgtctatggcttgggagcaatcacaggcagccattgacgaccaacttcgttcattctttgattgaggtaagcgcctcacttcaccattgtattatatcatcttttgtgatttgttctttattttgtttctgtgattggatttgtcctgagttactctcttccaagattagtttgggggagtgctcatgaagtgtgtgttgcattgtttatactcttgagtctgcattcatctaaggcataaaaaaaccaaaaaaaaattgaaaaatttcagaaaatgatttcacaaaaaaaaagagtgttcatgtagttgcattacatttaggatcgagtatagagtgtttcatttaggattgttgcatatgcatagggaataatgatgagatagccttgtaagcattttggttcactggataaactcagtgccctcgttgctagttgtcttttgcgtagtcaatgaaattgaagtaaaaccgaaccatgcctagattcctctactcgaccacactgtcatgatctgataccattccctatcaatttgaacctgaatctgatctttaattatcatgtctgcatcaaatttgaactcatggataccctaaaatacttggattttcttattcattttgatcactcttgttaatccaagtagttgactctccttattagagcagttaacccgaaccaaaatctagactttctttcaagccttatatcacttgtgagtgtttctgaggtcttatttcgattaagcttggtagaaagtgttaggtttgtaacgacagagataatgtctcatgtagttctagttcgcatttttcggactagataggactaggtgggtgcttatactttgggttgggatgtgtctaaaagaaaaagaaaaaacaaaagagttgattcattgatgagaaaaggtaaaaggctctaggtgaagtaagctaaagaagtagaaaaagtctagtaaaggttttgggatttgtaaagaaaagaaaagggttcttgtcagctaatgaagaagggcaaaagtcctcggttttaaaaattgaaaagaggatccttagttgttaaagaaatacaaatccgctagatgtatcagagtgttgagaaagcttctcctagagttaagagaaaagaaaagaatgattagaaaaaggggttaaaagattcatgaatgcaaagggtagagttaagttcttatattgggattggagatgggattaccattagagcttcattggttatactcttggtagatgggatcttatctctgtatgcatagcttgggacttacctttagcattctactaaagcttaatcattttttgagagatccccttttgctgaagcctattctgtaaggggccatctttgtcacttgacctttaccttagccaaatgagttcattgatagatgcattgcttgattcacgttccataactaatgaatgttaaagggattggtagatttgaaaacatgtgtaggctgagcataagagtcggattgattgataacaaggcatagctaacgtttttgagtagaattcaatcatatcgcagcttagaactatcaacttggacattgatttcatctgatttatctggtgctttggctcaaagtccccgccttcaactctcacctcctacttgttcttaattgtttgcttgagggcaagcaaagactaagtttgggggagttgataagtgtgcattttgcctgttttgagcatccatttgtcatcactttatcatcatatcatcattgttttatatcatttgtcatcactttgcatgtttaggatagttttgcatgcatgttgcatatttgtgttgttttcaggtgatttggagctgttgacgagctaattggaagaagcgttcctgatcatgtcaaaccactcgacccccaggtcgagtagatgcttcacgacctcaacagaccactcgaccccctggtcgagtagaggacttcaccacttcacctcaccactcgaccccctggtcgagtctcataacctccaccacctgaccatcactcgatcacactactctaccacatggtcgactaccttcatcaccttcactcgatcactctaccacctggtcgagtatcatcacctccacacttgaccatcactcgatcacaccactctacaaggaagtcgagtgataagtggtgaacctatcaagaagattaagaacagaaagagatagaatcggatgaagaagaagaagaagatagagtggataaaggatagaggagagtaataataggaagtttgattaatactttgataccttaaccctaaagtagagttcaacatttatagtagtttccctatggaaaactacacacactctctcagactcttacttaaacaacatacagttaatatgaactatagcatacttatttctttgacacttcaaagcctctggatgcgacagagtgtttccttgcactttcttaaactctctttagccacttgggtcaaagatcttctttgaatcctcttccttgttgctctatctcctttccttgcttctccttccatagtctccaccttatcattactcccccgtaacgaagccaccttgtcctcaaggtgaaatgctgggaactgctgcctgatgactttcattggctcccatgtattctcacactctggcagacctctccatttaatcaataactcagtatctgcgcccgtgctgctttcccttatctctagtacatcttcaggttcaggttcccactccaagttagaagtcataatcgctgggagaggttgagcttgggctgaacttggttgcgcatgcttcagctgtgatatatggaagaccgggtgtatggagatgctgcttggtaactgaagtttgtaggctactgcacctattttttgaagaatctgataaggaccaaaaaatctgggagatagcttctcattgcgacgctgtgccacggttacctgcctgtaaggtcttaactttagataaacccaatcgccaactatgaattccagctcccttctatgcttgttagctgatttttgcattcgggcttgagctgcctgcagattttctctcagcatcgtgaccactctgtccctttcttgtagcatctcctctaccaccgcgttagcttttgggatgtcaccaaatcgtaacagtttcggtggttctcttccgtacaaggcctgaaatggagtcatcttgatggcagaatgaaacgaagtgttagaccagtattctgcccaggaaaacaattgagcccaagattttggctttccattaacaaaacagcgaaggtaagtctctaagcatctgtttaggacctcggtttggccatccgactgtgggtggtatgctgtgctcttagccagatgtgttccttgggacttgaaaagagcagaccaaaagtgactgacaaaaatcttgtcccgatctgaaaccatactctctagaaatccatgaagtctaacaatctctttaataaacacttctactactgatttagctgtgtaaggatgcttaaggggaataaaatgaccatacttgctgagccgatctaccacgacgagtaccgcatcatatccacttgaaactggaagcccttcaatgaaatcaaggctgatattggaccataccttagtcggaatgggtaatggttgcaagaggccggctggagacaatgtagaatacttgttttgttgacaaacttgacaacccttgaggaactccaccacgtccttgcgcatgcctttccagtaaacttcactagataaccttttaaatgtcttaaacgctccttcatgtcctccaatgggactagtatgaaactgttccagcaattttgggataaaaggagagctttctggcataacaattctgccatccttatataaggtgttagctaccagactgtatcctttctccccttcctctcctctaagcagttgttcctgtatgagtttgaggctgggatcattttgtacctgtgcctacagttcttccttgttcactgtcgccgaagctagaaacagcatgttcattatttgctcggttactggacgtctagatagcgcgtctgctactctattttctgagtcatgcttatactcaatctcatagtccaggctaactaatttcgaagcccacctttgttgtatggctgacactgccttctggttgagtaagtgtttcaggcttctctaatcagtcctgataatgacttttctcccgtgaggtagtgcttccacttatccactacaaaaacaatcgccaaaagtttcctctcatatattgatttaactctgcctttactggagaatccttggctaatgaacgcaatgggacgcttatcctgagatagaactgctcctatacccgtgcctaaagcatcagtctctatcacaaatggcttctcaaaatctggtaatgctaacgttggaagacagataaccgcctcttttaaagcctcaaaagtacttgtaccttcaacagaccattcaaatttccctttcttgagtaattctgtcagtggctttgctatcttcccataacctgccacaaaccttctgtagtaaccagtaaggcctaaaaacccgcgcagctctgttatattcttgggctgtggccactttaccatagcttctatctttgtgggatctgtagaatctccttcgctagtgatcatatggcccaaatatgatatccttgtgcaaccaaagtggcatttcttctcattggcgtagaacctgttctgtaaccgaatctgaagaaaaacctctaagtgtttgagatgtgtctctacatcaagattgtataccagaatgtcgtcaaagaacactaaaacaaaccggcgcatatatggtctaaacagctcattcatcactgattggaaggtggctggtgcattagtcagcacaaagggcattgataatagtttttttagtcaattatcctaaaacaccaatcatatcgttgtagtactgaaggttgtcaatccaaatgggtgtgatgctaacaatcaagatgtgatcagaagtcactaagtcaagccaagcaataacaggttttggtgtgttctagcagtcctaagtgaatatgcagaaaacagaaaatgaaacagaaacagtaaaaaacactcgaccaacacagctctttgcagagcactgggtgaggtcgagtaacagacaaaaaatgaaacacagatactcgactgcacagtctgttgccatacaactaggtggtcgagtatgaggtcgagtaacaagaaagaactgcagaaattaagcaacagataacaagatgcagtaaacaacaatatagtaaacaaagaattcaatcagataaagaattcccgaggatggggaaattgagtagtttcgttttctcagtttacaggtgattgacatgctcagtaaattaaccctagacaacaagttcattaaccaaatctaagtgccaccgcaacagagaccctcaagttaacctagttccagattcaatcaccattgacgagagctaacctaacaggcattacgaatcaacaagttaaagccaaaacgctccctgcaaccaataccttggtactgggtcacgaatctcttgaattagtggttcagacatttcatcgaacaccttttgggcgcggaaatgtctgggctcaaattctagttgatcagaaagcaataggcattaagaacaactaatccagaagggatctatcaaccaatactcaatcacctagcatactgagaattctacactactctaacccatcctcagaaacctattcactactcagacatcataatagaaagcagaaacgttgaacaggttgaagacatgacaacaacagtgtaacagtaggatgataacagaatgaacaacagtaaacgaaatcaagaacaaaagctgaatactgaacactgaatagataaagagaaatccggattacaaaaagtctagaacacaaggtctgcagaataaaactagataaaaacttcttgtctgcgaaaatgtgaagtacatgctacttatagccaaatattccgaaaccctaatactcaaaacgacaaagtattgggacggattaagaactgtactcgacccatgtggtcgagtgggaggtcgagtgaatagctggagtcttcttttctttcttgtgctcgagtgtctggttgagtgcggaatgaagaaggctctgaagcttgtcatcgagtatgcaatcgagtggtgtgatggtgatactcgacttccatgtagagtgatgaggtcgagtagaggtctagcaatgggatgaagtcactacatctgggggtcgagtgatgtgatcgagtggtggtcaagagatggagatgaagacactcgacctgggggtcgagtgatgtgatagagtggtggtgtcttctactcgacctgggggtcgagtggtctcttgagatcttgaagctcctactcgacctcttggtcgagtggtttgtcatgatcaggtccgcttcttccagttagatcgtcgacagctccaaatcacctgaaaacaacacaaatatgcaacatgcatgcaaaactatcctaaacatgcaaagtgatgacaaatgatgtgaaatggtataaaacagtgatgatatgatgctaaaatgatgacaaatggatgctcaaaacatgcaaaatacaaacttatcaactcccccaaacttagtctttgcttgcctcaagcaaacaatcaagaacaagctggaggtgaggtttgaaagcggggactcagagccaaagcaccagatagaccagatgaaatcaatgtccaagttgaaagttctaagctgcaagatcgaattctacttaaaaaagttagttatgcctcatcaatcaatcaatccgactcatatgctcgacctacacaagttttcaaatctaccaatccctttaacattcattagttctggaacgtgaatcaagcaatgcatcatcaaagaactcatttggctaaggtaaaaggtcaagagacaaagatggtcccttacagaataggcttcaataacaggggatctctcaaaaaatgattaagctttagtagaatgctaaaggtaagtcccaagctatgcatacagagataagatcccatctacccagagtacatcaaatgaagctctaatggtaatcccatctccaatcccaatacaagaactaaactctaccctttgcattcatgaatcttttaagccctttttctaatcattcttttcttttctcttaactctaggagaagctttctcaacactttgatacatctagcggatttggatttctttaacaactaaggttcctgtttttaacattttaaaaccaagggcttttgcccatcttcaatagctaacaagaactctttcttttctttacaaatcccaaaacctttagtagactttttctgcttctttagcttacttcacctagagtcttttaccttttcttatcaataaatcaaccttttttttttcttttaaacacatcccaacccaaagtataagcgcccacctagtcctatctagtccaaaaaatgcgaactagaactacatgagacactatctctgtcgttacgaacctaacactttctaccaagcttaatcggaataagacctcacaaacactcacaagtgatatagggcttgaaagaaagtctaggtttgggtttgggttaactgctctaataaggagagtcagctacttggattaacaagagtgatcaaaatgaataagaaaatccaagtattttagggtatccatgagttcaaatttgatgcagacatgataattaaagatcagattcaggttcaaattgatagggaatggtatcagatcatgatagtgtggtcgaatagagcaatctaggcatggttcagttttatttcaaattcattgactacgcaacagacaactagcaacgagggcactgagtttatcctgtgaatcaaaatgcttacaaggctatctcatcatcatcccctatgcatatgcaacaatcctaaatgaaacactctagactcgatcctaaatgtaatgcaactacatgaacactctttttttgtcaaatcattttctaaaatttttcaattttttttggtttttctatcccttagatgaatgcagactcaaaaatataacacacacttcctgagccctcccccaaacttaaatcacacagtccactatgcgaataaacttggaagagagtactcaggacaaatccaatcacagaaacgaaatgaagaaacaaatcacaacagatgatataatacaatggtgaagtgaggcgcgtacctcaatcgaagaatgaacgtagttgctcgtcaatggctgcctgtgattgctcccaggccatagacgaaccaccttgttctgtatcagctccagcaggtgggtactcgacctcattagctctgtggcggccagcaccgctctgaggatactcgacctctctccttctgctacggccggcaccgcggtcaagtgatctcctcgagtgaatgaggtgtgatctgctcctagatcaagtgagtgtagccttccttcttctcttgtgctcccgggactcgaatgacaaatgcctaaccggggcatgagagactctctgctcgctaagctcaggcttgtgcgcaggcttatcaaatctcctcgatggcatctccagaggaggcaatacctgtggaatagctgtggtggaggaggaacaactcagcttatctgtcagaagcttgatagccttgaaacacttggcgagcaacttgtcctgcttcttgcaccacttctgcaatttacttttgttcttatgagcttcggtcaagctcttgctctgcctcgctggaggtacatcttcaccaaagtgatacatgctagtgtcgaactccactgcgcaatcgtcatccatcccatccgaaacagcttcttctagaagatcctcctcattgaatggcggagcgttctcatagtagaggcgtccaacctcaggccaaaaatcaatattatctccctctattatccgtgtaacctcagggctagggagaaggatgttagctctcctgtctgtagagtgctcaaacctgaacctgtggaagtcgtcaaccattgcaaactctaggaattcgcagtgacgtaggtgctcgatatccattgctcgcggctcgagtccggcagatatgattgggactccacaagctatcagaatcggtgtcacaacaccacctatgcacagagcgcctcgtgctctcttgcggttattgctgacagcccaactcttgtatccacacagatggatcagaagaagtacagagagaggtgtgtcattgatttcaccttggagagacataccattcttcgtttggcgaagagttcccttgagggccattgcgatcatctccatatcagagttagtaacagtccctgtgatctctcgggagtagagtacattggctatagaacgctggaagtacctgatgacagggctgcgtatctgattgctctttgacctagaagcattcagcggtacagagctgcaaatggtgatccacaagtctttcaactcttctctgtcatacttgggcttagatcccgttccactggggaagccaaacaatccttccaagcgcttgattgataacctatactcatggccatacacagaaaattgcaagaatcccaatccttcacaatccaactcatcagaggtcataccttggtagagctctacttgcagcgtggaaagaaattgtattgtctcatcttcatacgctacatacggataagccatcagagtgtccagatgacaactctggtacaggtgttgaacatcttccaacaatccgagttgtgcaagtgaggtcgagtaaggatacctcgtgctacagaactcgttcagcttgaaaagcctaacatattcctcagcaggcaatacgtcgggcttgtgcagaagtttggtagctctacgagtctgttcaggcatgtactcgtcttcctgatcttcgtctataagctcatacctctcagtgatcgctctcttccctcgggctatctcagctttccttctgaagctttcatattctctttgttctctctctggccttgaagatgttgactctgtctcatccatgttgtagtcaggatcaacagaagaactgccactgtaattgctcatgattctcctgtaaaaatttagaactcaaagctcaaagtcaataggttagtctcaaagatagcaatgaaaccaaaattgttatcaataggcaatgaaataaaccctattggtcgagtacaattctgtactcgagtagactgagctgttcttgagttccctttagacgatttggatcgagtatcgtctccggattcgagtgggtatgcttcaggagatcgagtaagttgtggaggttgagttcagccggtgaagcctagaggtcgagtaaacactctgacagttcttcagggctctgttgctttcaagaacaagaggtcgagttgctgctgcagaggtcgagtgaatactcgaggtcgagtgatagtttgtggtctagtagcttggtcgtaatcaagtggtcacggagacttcgacggtgaacgaggaggagtactcgattacggaagcgcagaggtcgagtggttcccggaggtcgagtgacggaagatatgatctggtgacggcggcgcggatgtcgagtaactctcggaggccgagtgatattgtcaggatcgagtatctctttggacggcgattcgtggtgtagagagattagagtgtcggtggtgaaatgaaaagaggtaggtcgagtggattttgtgaagtcgagtgatgtttttaaatgagtggtctaggttgagttttagattctctctccagcttatcctcagcgcgtggtccacactctgttgactgaaaaaatatgcagaagatctactgtaaactgcaagaaatccttgcaagtctctgtagctcctgttggtcgagtacaatgatgtttttttaaaattttggattttaaacatcacgtatactcgactgatgtactcgaattccgtgtctccagacgcagcagaaaactttataaattttgtactccaccaggttatacactcaatctccaggtcttctgtagagtaaaagttttgaatttttactctatctccacgttgttcccttttctctgaaaaccacaaacacaattaaaacaaatcaaaaataacaagacaagaaattttttatttacagagataatcatgggacttcctcccaagtgagcttgtttaaagtcattagcttgactcctttactcctttaatcatcaagaggttcttggagatgaaccgatgtcacctctggaaggatttggtctgctaagtatttcttgagcctttgaacatttactgtaaaatctctactcttaccagctagagtgactgctccataaggacggacctcagtgatacagaatgggccagaacatctggatttaagttttcttggaaagagtttcaagcgatagttgttgtatcttttgtagccaccctggttgttttatgtagctgacttcttccaactggttaccctccccatcttggacttgaaattgctcgtcatcaacaaggaagtgcacatgcttctgctggctaagaagaatcatgtccagcttgtcattcagcgctttgatctccttcctgtgtttgtcatcagaatcagctgttcctctgacgtatcacagtccacgttgtaattgccatctgattgagcgaggttctcaaccaattcccagccttcttcaacatccttgttctggaaattcccattgctagctgtatccagaagcattctgatgcgtggtaggactcctctgtaaagagtgctgagcagagaggctttagtaaagccatgatgagggcattggttggtgtaccccttgaaacgctcccatgcttcacagaagctttcaccagtcttctgtgagaaaccagaaatctcatttctgagtcttgcagttctggcattggagaagaactttgatagaaaagccttcttgcaatcatcctaggtggtgattgagtcatggggcagattcttctcccagatgtgtgctttgtcgcccaaggagaatgggaacaaacggagcttgaatccgtcttcactgacaccattgatctttgttaggttgcagagcctatcgaattcatcaaggtggtcgagtggatcctccattggcagaccatggaatttgttcccctgaatcatcgagatgagaccactcttaatctcgaagttgttgttctggatcgcaggaggtgcaattcctttcctctggcggtgatcacgtggtgcatctccagcaccaatgttggcagggccattttgttgattctgttcttcagccatttcgagtggttgctgagatacaggggtgactgtggttctcctttttctgagttcgcgagctatgcggttgatgttgtcgtcgaaaaggaggttctgattgcctgttgatcgaattcgcatacagcagaggtgtacctggatcaagaagacaacaagaaaaacacacagttagtaaccgaaaagaaaattgaaaaagaacttgatctaagcaagtctgaaatctcaaatgtaacaaacaaacacccaattggcaacggcgccaaattgataataggttttttagtcaattatcctaaaacaccaatcatatcgttgtagtattttaggttgtcaatccaaatgggtgtgatgctaacaatcaagatgtgatcagaagtcactaagtcaagccaagcaataacaggttttggtgtgttctagcagttctaagtgaacatgcagaaaacagaaaatcaaacagaaacagtaaaacactcgaccaacacagctctttgcagaacactgggtgaggtcaagtgacaggtcgagtaacagacagaaaatgaaacacagatactcgactgtacagtctgttgccaaacaactaggtggtcgagtatgaggtcgagtaacaagaaagaactgaagaaattaagcaacagataacaagatgcagtaaacaacagtagagtaaacaaagaattcaatcagataaagaattcctgaggatggggtaattgagtagtttcgttttctcagtttacaggtgattgacatgctcagtaaattaaccttagataacaagttcattaaccaaatctaagtgccaccgcaactgagaccctcaagttaacctagtcccagactcaatcaccattgacgagagctaacctaacaggcattacgaatcaacaagttaaagccaaaacgctccttgcaaccaataccttggtacagggtcacgaatctctggaattagtggttcaaacatttcatcgaacaccttttgggcacggaaatgtctgggctcaaattccagttgatcagaaagcaataggcattaagaacaactaatccagaagggatctatcaatcaatactcaatcacctagcatactgagaatcctacactactctaagccatcctcaaaaacctattcactactcagacatcataacagaaagcataaacgttgaacaggtggaagacatgataacaacagtgtaacaacatgatgataacagaatgaacaacagtaaacgaaatcaagaacaaaagctgaatactgaatactgaatagataaagagaaatcgggattacaaaaagtctagaattaagatccatttgctgtgggtcataccagccatgtaggaataccatatcttgtttataagagctttgatacatgcaaaatattcgaaaacaatgtccgatcatataattttcgccctgtaatatagcaaatatcacgaaaaggcccgaaaaagtacattaaggtcaaaattaggagtagaataaaaacccaatagaagaattacattttccttcctcattcatcggagagctctctttaggatttccgaaatggtatcacatgcgaagttttgcctcactatctaaaagttatggagtcatacatttttaacaaaaaaaagaagagaaaaaccgaaaaagaaaagagggattcaacacgaggactttccgggaggtcacccatcctagtactattatcgcccaagcacgcttaactgcggagttttaatgggatccggtgcattagtgctggtatgatcgcatccgctactacatgcaatgcaatcgtatctattcttttttgaagactttacgatccatttgccatgggtcccaccagctatgtaggaataccctatcttgtttataagagctttgatacatgcaaaatattcgaaaacactgtccgaacatataattttcgctccgtatatagcaaagatcacgaaaaggcccaaaaaagtacattaacgtcaaaatttggagtagaaaaaaaaaccaatagaagaattccattttccttccttattcatcagagagctctttttgggctttccgaaaaggtatcacatccgaagtttggcctcactgtctaaaagtaatagagtcatacattcttaacaaaaaaaagaggacaaaaaccgaaaaaagaaaagagggatccaacacgaggactttccgggaggtcacccatcctagtactactctcgcccaaacacgcttaactgcacagttttgatgggatctggtgcgttagtgctggtatgatcgcatctgttactacatgcaatgcaatcgtatctattcttttttgaagactttacgatccatttgccgtgggtcccaccagctatgtaggaataccctatcttgtttataagagctttgatacatgcaaattattcgaaaacaatgtccgaatatataacttttgctccgcaatatagcaaagatcacgaaaaggcccaaaaaagtacattaacgtcaaaatttggagttggaaaaaaaaacaatagaagaattcagttttccttcctcattcatcggagagctctctttgggctttccaaaatggtatcacatgcgaagttttgcctcactgtctaaaagttatagagtcatacatttttaacaaaaaaagaaaaagaaaaaccgaaaaaagaaaagagggatgcaacacgaggactttccgggaggtcacccatcctagtactactgtcgccccaagcacgcttaactacggagttttgatgggatcaggtgcattagtgctggtatgatcgcatccgttactacatgcaatgcaatcgtatctattcttttttgaagactttacgatccatttgccatgggtcccaccaactatgtaggaatatcctatcttgtttataagacctttgatacatgcaaaatattcgaaaacaatgtccgaacatataattttcgctccgtaatatagtaaagatcacgaaaaggcccaaaaaagtacattaacgtcaaaatttggagtagaaaaaaaaccaatagaaaaattcaattttccttcctcattcatcggagagctctctttgggctttctgaaaaggtatcacatgcgaagtttggcgtcactgtctaaaccttatagagtcatacatttctaacaaaaaaaaatagagaaacaccgaaaaaagaaaagagggatgcaacaggaggactttccgggaggtcacccatcctagtactactctcgcccaaacacgcttaactgcggagttttgatgagatccggtgcgttagtgctgatatgatcgcatccgttactacatgcaatgcaatagtatctattcttttatgaagactttactatccatttgtcgtgggtcccaccagctatgtaggaataccctatcttgtttatgagagctttgatacatgcaaaatattcgaaaacaatgtccaaacatataattttcgctccgtaatatagcaaagatcacgaaaaggccttaaaaagtaccttaacgtcaaaatttggagtagaaaaaaaaagaatagaagaattcaattttccttcctcattcatcagagagctctttttgggctttccgaaaaggtatcacatgcgaagtttggcctcactgtctaaaagtaatagagtcatacattcttaacaaaaaaaagaggacaaaaatcgaaaaaagaaaagagggatccaacacgaggactttccgtgaggtcacccatcctagtactagtctcgcccaaacacgcttaactgcacagttttgatgggatccggtgcgttagtgctggtatgatcgcatccgttactacatgcaatgcaatcgtatctattctttttcgaagactttacgatccatttgccgtgggtcccaccagctatgtaggaataccctatcttgtttatcagagctttgatacatgcaaaatattcgaaaacaatgtccaaacatataattttcgctccgtaatatagcaaagatcacgaaaaggccccaaaaagtacattaacgtcaaaatttggagtagaaaaaaaaaccaatagaaaaattcaattttccttcctcattcaccggagagctctctttgggctttctgaaaaggtatcacatgcgaagtttggcctcacggtctaaaagttaaagagtcatacaattttaacaaaaaaacatagagaaaaaccgaaaaaagaaaagagggatgcaacacgaggactttcttggaggtcacccatcctagtactactctctcccaagcacgcttaagtgtagagttttgatgggatccggtgcattagtgctggtatgatcgcatccgtttactacatgcaatgcaatcgtatctattcttttttgaaaactttatgatccatttgtcgtgggtcacaccagccatgtaggaatacgatatcttgtttataagagctttgatacatgaaaaatattcgaaaacaatgtccgaacatagcaaagatcacgaaaaggcccgaaaaactacattaaggtcaaaatttggaatagaaaaaaaaacaatagaagaatttcattttgcttcctcattcatcggagagctctctttgggctttccgaaaaggtatcacatgccaagtttggcctgacggtctaaacgttatagagtcatacatttttaacaaaacaaaatagagaaaaaccgaaagaaaaagtgggatgcaccacgaggactttttggtaggtcccccatcctagtactactctcgcccaaacacgcttaactgtggagttttgatgggatccggtgcgttagtgctgatatgatcgcatccattactacatgcaatgcaatagtatctattcttttttgaagattttactatccatttgccgtgggtcccaccaggtatgtaggaataccctatcttgtttatctgagctttgatacatgcaaaatattcgaaaacaatgtccaaacatataattttcgccccgtaatatagcaaagatcacgaaaaggcccgaaaaagtacattaagctcaaaatttggaatagaaaaaaaaaacaatagaagaattccattttgcttcctcattcatcggagagctctctttgggcttccgaaaaggtatcacatgccaagtttggcctgacggtctaaacgttatagaatcatacatttttagcaaaacaaaatagagaaaaaccgaaagaaaaagtcggatgcaccacggggactttctggtaggtcccccatcctagtactactctcgcccaagcacgcttaactgcggagttttgatgggatccgttgcattagtgctggtatgatcgcatccgttaactacatgcaatgcaatcgtatctattcttttttggaagactttaagatccatttgccgtggctcccaccagctatgtaggaataccctatcttgtttataagagctttgatacatgcaacatattcgaaaacaatgtccgatcatataattttcgccctgtcatatagcaaagatcacgaaaaagaccaaaaaagtacattaaggtcaaaatttggagtagaataaaaaaccaatagaagaattccattttctttcctcattcataggagagctctctttgggctttccgaaaaggtatcacattccaagtttggcctcatggtctaaaagttataaagtcgtacatttttaacaaaaaaaagaaaagagggatgcaacacgaggactttccgggaggtcacccatcctagtactactctcgcccaagtatgctcaactgcggagttttaattggatctggtgcattagtgctggtgtgatcgcatccgttactacatgcaatgcaatcgtatatattctttttttgaagactttatgatccatttgctgtgggtcacgccagccatgtaggaataccatatcttgtttataagagctttgatacatacaaaatattcaaaaccaatgtccgaacatataatttcgccccgtaatatggcaaagatcacgaaaaagcccgaaaaagtacattaaggtcaaaatttggaatagaaaaaacaaacaatagaagaattccattttccttcctcattcatcggagagctctctttgggctttccgaaaaggtatcacatgcaaagtttggcctcacggtctaaaagttatagagtcatacaattttaacaaaacaaaatagagaaaaaccgaaaaagaaaagagggatgcaacacgaggactatccgggaggtcacccagcctagtactactctcgcccaagcacgcttaactgcgtagttttgatgggatccggtgcattagtgctggtatgatcgcatccgtttactacatgcaatgcaatcgtatctatctttttttttaagactttatgatccatttgtcgtgggtcacaccagccatgtaggaataccatatcttgtttataagagctttgatacatgcaaaatattcgaaaacaatgtccgatcatataatttttgccctgtaatatagcaaatatcacgaaaaggaccaaaaaagtacattaaggtcaaaatttggaatagcaaaaaaaccaatagaagaattc

SEQ ID NO: 196 - DNA, 96988 bp, Arabidopsis thaliana
gaattcagattccatagttgatttcgctgccacaatttttttgctagatttcgaggatactgctgcacctccaagtgtaaagatatatccaattgtggatttaaagtttttggaatctgcgatccagttggcatcactataaccttctaaaactgcgggttctttaccatagtgcaagccatgatctttggtataacgtagttagttcaaaactctagttatagccttccaatgcttatgtcctggattgcttgtgtagcgactaagtacatttactgagtgcgctaaatccggtcttgtactgtttgtcaagtacattaagctgtcaattactcttgcatattccatctgttgcacatgttcacaagagtttttggtcaagtgaagttgaggatctactggaatttttgtagtcccattagagtaatgcttgaaacgatcaagtatcttttcaacatagtgggtttgagacaaattaaggccttcattagtactgatgattttaaacccaacataacatctgctagatccatgtctgtcatttaaaaatatcttttgagcatgtttttagtttgatttatgatatctgtgttgctctccaagatgagcatatcgtctacatataaacataacaaaatgtatcctcttggagtaatattgaaatatatgtatttgtcacattcattaatggtaaaaccattagacatcataacactgtcaaacttctcatgccgctgcttaggagccagtttgagtccctataatgacttcacaagtttacacactttgtgttcttgtcctgggataacaaacccttcaggttgtttcatgtagatttcctcttccaaatctccattttaaaaagctgtttttacatccatttgatgtatttcacgatctcgtaaggctgcaatgcctatgagcatcctgattgaagttattctcgttaccggagaataggtatcaaagaaatctaaaccttctctttgtcaaaatccttgtaccacaagcctagctttgtaccacaagcctagctttgtacctatcaatatcaccattcgtttttccttttaatagtgaaaatccatttactccccaatggtttagaaccttgtggtagatctgatatctcgtaagtatgatgttgcaagatagagtctatttcagtattgactgcttccttccaacaaggtgcatcaggggtagacatggcttctaaataagttcttggtacgttttcagctaaaaacatcatcaagaaaccatcaccgaaagatctctctttgcgagctcttttgctccgcctaggttgttcttcaggttcctgttctgtttttttcaacagtaatagtatccaaagaattgtcctcagttcgattctttcgttcagcaactccgttagattctggtgattagggagtagttatttggtgtataatgcctttttctctgcaaaatgaattgaatggctcattatattctcctcctctatcacttcgaactatttttatagttctttgaagctgattttctacttcgagtgtaaattctttgaattttaccagagcttcatctttgctatgtaatagatatacataacaatatcttgtgcaatcatctatgaatgtaacaaagtatttctaaccacctctagtttgcacatattttaaatcacaaaagtctgtgtgaattaaacctagaggtccagttgttctttcaactcgtggtgagggagttttagtgagttttttcgtgtacgcatacttcacatttttcttggttagttttgaattttggaattaaattcatgttttgcattttttgcattgttttataattgacatgtcctaaacgtttatgccaagtagtaaacgactcaaccaagtaagcaataggattttcattcatttcaacaacagaagcagaagctacatttttcggaaagactgtcatttaagacattttgactagtctacctttaacaaaactctttcccagatacactccatgtttcttaagaactaacttatcagactcaaagttaacggcaaagccattgttgcttagcaccattccagagatgagtctttttaagcatgtcaggtacatgcttcacgttttgcagagtaagctcacgtccccaagtcagcttcagaaccactttgcccttaccttccatcttagacatcaccgttttaaaaaattcaaaaaattctcaatccgtctaaagcgataaggtaaaagtggatttattgaattaagattgtaggagcacaaacactgaattgagaaacaagtacgaattttattaaataacgataatgataaattacaataacagtaattaagcacataaagtaaatcacggaggtaagatatgatatattttttcttaattcaataaatcggccgtaaatgctttttggacatcacgatttatgaatcccaggatacaaccgatcacaaactaatacccgagcacaaaagtattagactcaagcgaacttgatctacgatatactctgacaactactaaactaagaacttacttttaagtagcaagagagaagagagactttagaatttagagtgttttgtgtttgggagcttgagaaataattagaggctgggtctctttataacaccccaaaccgtacatcaatagcccatcctattgttttgtcaaaaaaaaaagcccatggagcccacttaaattcaagtgaagcaaatcaataatgttaaagggttttgttacgtgtattgttggttgcacatatatattggtatatctatctccctcttctccaagccgccaaataagaatcttaagaaagcaaatccaaagcatcaacacttgagttctagagtgtggtcgttaccagatcggagagagaagagagttcaaaggtgaaggaaaccgaaaagattcatgccaccgttcctaatctgagagtcaccgcgtcatcttaatcttaaccttaattaaaggtctgccactaccgttgttgttgagtatgttagtcactgtggaacgcttgaaaagaagaagaaaaaggaagagaaagagaagagatgaaggataatcgtgaggaagatgagagaaagcggagacgaaggacgatacgttgcggaggagaagagatcatcaccaccgcaaaggaaaggcattaacagatggagatttcttttgtgacagtaaggagaagtgagatgaagcagatcctaataaatcagaaaaggcggctaggctaaactagaagcatataaggaagaagataaagagaaaagagtagtttcaagttgaggttatacaaggatgtttcccgtcatactagaaagaatcagttgctaaataagacatctctacaaagatcacgtgccatgaagccatagcaactgacagagtttcaatcgggtttatattcgagaagttatacacgtttttttctggacaagtaactgccaaagctgtccaaatctatgctaagtagaaatccagaacagtgtgtgactactagttttgtgatacgttttccagatgtactagaaggaattatatcgatatcaagacgtttatggaaagatatttctttaaggaactcatagtagctgacaacttgtccatcggatttaagctctctctggaattgaccttagaagtttgcccataatcatctcaagttgcagaaacctagatatcagttctgaggcagcatcttcagaagaatgtgggagattcatgtgaaatctgatagagataaaactttgtgtagacgttcatgttgctactgtctaactattcaacggtgggattacattttgcacggttagttattgatgtatgtatatgtttccgagactgataattatggggtaaattgtgatggtttgtgttgttgttttgttaaacgagcttggtttgaagccaaaccttacaggagcttttaagactcagtgttttacttcatggttgatggagagccaagatggtgttcaatagtatgagcttggaagcaaactagtaacttgtctaaaggataaaggagaagagagttgttcttcatcttcaattaggctaaggtgagggtggtatttgcggatatgtagtaaactctttccttatatactttttgatagttgctgggtataggctcgagaattgtccttgttgatttatgtgaatttgtgtgaagctacgttgttagtaacataatatttgaaatgcattggtgacatgatttgatatatttaatatatattaaattacaaaacttcttatgtatatgagattataaaactaaaaagtatgaaaaatatatttaaggatgttggactgtaattgggctgacaggcccattacagatcattaaccgctgacaagcaatgagaggaaggatcgagctacggccgtggtcttccaaaaaatatgcttgagtagccaaggttaataggcttgagtagccaaatttaatataggcttgtgaagccataaagttaaatactaaaactaaaaacgaaaataaaatataatgttgtgagcaagacgcatgtttgtttgtttaattgttagacattctgaatctttgctaagtaatggttgttgattatatttggaacgtttttactgtatgtccagtaggcagagttgatcccctaactaagtaaacttgttttactcacccctttttcccattttctccaggttagtaagtatcaaaagttgcggttgaaatttgttcgttggtgaattttaaataaagaaaagttttggcaagaccggatgaataacacgctatcttagcctgtatggcgggacatgtgttatactctttatatagtagagggagataggattttgtgagaatattctcaggatatgcatgacatattttgagactatcctgagaatatagcatattctgagaatataaaatattttgataatatggaatattttgagaatatttccataagatttaactcaacaagcccaagaactcacaagcatgacggtccacaagcctgacagccctcgagctgacgacgggacgacacgacaacccgcaggccggttcggttcggtctggtttggtccaagtgtcccactttacacccttatttctcattcaatacaactccgtttttgacgcatgagtatactattttgtagtactctttaacagctttccaatacactaatgacccgataattccgttcaaccctttggtcggagtttgaccagaaagtcaccggaaaagttttgtgtcaaaaaagttataacatatttcactagaatccaagtgagctttggcttcacccctaaatatctagttatttaggtaagtaacaccttgttaattatatccagtataattcttggttgtggatgacatctaatgtcttatccaaccctatatctttaagctcaaaaccgttttaatagtttagtcaaataaaccaattttatttcacatggtaactgttaccatatgcctcactctcaaacaattgcagaccactgctttggcagacccgctaaacaacaatttaaattttaagagttgataaaattgggaagacatcaaatacttggtattagctgaggaattaattttataactcaattttatatttaaaatttatatccaatataaataaaatatataatacatatctgatatgtaattcattaaagtataaaatttttaattaatcttaatcaaattaaattattagttttaaaaaaaattgatcttaattaatttttaataattctaatcatattaaaatatattataatcgagttaatcctaatcaaattaggatttatcaaattattattatcacaagaatgattatgatcaaatcaaaatctttacacaaatattacggtaattaatttccctcttctcaagaaagtaaatcacaaaccaaaaatattctataatatttatggtaagaatcttttaaataaggaacaatttcaaatcaacaaaaaatctcattattactcgtaacatgatatatatattatattaaatatttgattataattactttaatccggataaatatggaaacacatatacgatatatacattgaatcctgacattatatttaaatatctatgtataatgattaatggaaatttcacgtgatcaaggtaaatgtctaatcaaacttcataaacacgtatatctttatatattatacctttattaatacttaacattaaagcatatctaatttatattatataaaagttgaagctatttgtttttaaagccatccacataggatttaaaacgaacaatcggaagctaacacatcaataattaacatatttaatatctaattaattaacatttttgaaaataaccaattaggagctgccacatcaataattaacatatttagcatctagttaattaatatttttaaaaatagtaattattttttattttaaaattcaaaataagaaaggaaaataacaaatattaaatttaaacatataaataaagcaagttatataattataattatataatattaaacccaaccttataggattttatacaactaatccaacattttaatataatttaaagaaatgtaacaaggacgtggtttgatggtggtgtttttaatcgtatcaattttaatcaagttctcgaagatataaattgaggtctttcagtctgggaagcttgaaggtgaagaggatctaaactacatcaaaagagagaagtgatatagttaagtactaatttagaagctaaaacattttcttagaataatagaaaacaaaacagagtacatcttgacgagattaaaaaatgcttatactaacaaaaaaaaaagagattttcgaagaaaaaatatggataatgtgaaaagtttagaaggtatgacacatattgattagacaaaatcataagaggatggaaagagacaatgtaagaaaaaattgaaacaaataaaacgagttcttgcaaaaagataggaatactattagctctctgtaaaaaagttgtgaagacagaaattcatatacatattgaaaaaaatatgtgaaaaatatgagttgttaaaaaaaagtatagataagcttaggattatacttctacataatatcttatttttagaagagctatactaactaatgcagcgaagataaacgaaaagatagtaaatttgcgggtaccaaaattagaatcgtcgaatctattttccatacaacaatttatttcatacgtaaaaaacgtcgttaacctaaatatctaaagctaaagagagagtcatgaaccaaaaaaatgttcttttgataaatgttgtaaagaatttttctagttatgggggaaatcaaatctcaaagagagaaaaatatatctttaaaaacagtctccttttttataattttacaactttttttttgtagattactaattaattgtataattttcttaattataaaagtatatatagataacaatgtaaaacccaaaactttattttctgctttctgaatcaaatcagatttcaaagagagaaacgacgataatgtccaatcttccgtcagatttgttagaggaacgatggctcatgcaaggttcttgatgaaagcggcaatatcgacaatgacttgcttggtaaaagtgtgtctttgaagggtaatacttaatggtgtgctttggatatagaacacataggctataaattgttactcagttttgtttttacagcaagaaagatttagacgtgtcttctgccaaatcgaatgacggtcgcgtggttctatcagttcttagagaaaacaaactctcacttctagatatgagttttgttacattaaagattgatatatgggtgaccaataagttttatactgtagttgcaacgttgcagtggaccaaatactttacaatggatacacccattgacattaagcttcctctgtattttgtcagttttgcattcgacgaggaacaaaaaaggctttgtattgtgatcgaattcttaaggaaatggtatacattcttggagatatcgagaggatgataagtatatcaaattctttaattatgttccaagtttgattcatatccagcaagatacaagctagaaagaaaactacgaaactagagtcagagaaaaataaggaagtgatttcttgtggttccacattcttttcttttttgggtatacaatacaatttctttaatctttataacattaaatatattaattaattgattgactgttacaatgaattgatatattatattactttgattcctttcttctttgcattacattcaatttttatttttatttttggttttaacattttttgttaaattttgtcaactctaagactgcaagtcttacgtaaataacgcaacatctttataggtaatttacgtaaataatttatgaaagagtaatttatagtataatatccgaagactgttaaggctcacgttgaaatggccaaagatgttgattcatttcttgcttatccatgaggccgttacaccttcgagatgatgatgaagtagataaaggagagggaaaatgaacaattagctacaacgtgttttgtcgttcaggggttgttgtacgttttgcaattggttgtcttacaagcagctccgtcaattcaagaaggctcagtaatagacgagactatcgagtctgattctgaagaagcggaagacgatgttgaagagggtcctcgagagtccgtcgctttcaagcttgggaatgctaaggacttggatgcaaattgttcggtaaaacatttatcaattatctttgatatctgttaatacaataatagtggataagtatcttgttaattgctaacatttttgccatgtagttatccgtggctgatttgattatcttcgttttctgggacatgttcgtgttgctacgattatttgtcctgatatgttgatggatccgttggaagatttgtcatagtctgatgatgaggaagatgagggtgtcgataatattcttatgctggctggtcagggtctaattttcaagaatgatatgtttggtggtggatgcttcccttcttagatgcaattgccatcttaaaaacaaaagcggggtggtaagtctaatattagtcggaataggaaatctggcaaacctataaagaacaccggtgggatcaggagcaaacctcaaagacccatacctgaggaaggcagtacttcagagtttttgtcgatcgacgctatttcccgtttgttggacgagaagcttgatgctcagaaaaattaatcatcgctggtttgattgattggtttcgcaaaaacactgttattgaaagtgatcgagcgaaagctcctgctagtgggattagtcggcccgagaagtctaccccggttggtaatgttcgagtatccaattctgaagatattggttgtaatgatggcaatgatgagtttggttttgattctctccgccgtccttgtcccaatgttcggtttaacagtcgtgatgcgaatgctaatgtcgattataatgttgatgagattttatcgttttacactgacaaggtttcaagtggtgttggtggctccgagtcggaggtaaatttattgtttttattagcagttaactttgttgtagttgtgaaaatttttgtctcatgttttttacctttacagcgggacggagttgttccaatggaggaaggtaatctcactgagggtgacgtcgttaataaccaacaggtgggttgcttgttagtcgaacaaatttatattttagtaagtatattatttagaatgcaaatcttgtgttagcgtggcagctgaaactataagggttttgtacctttttcatcaatatacattgtgttatattgtttctaggccggtaacgatgctggcgttgacgttgccccgactacagaagctgccactgaagataactcctgggttagttgttaagttctcctctagttaacagtgatttaaacctctaatcttttgtctgtgggtttaatcctctcttcgtggaccccgcatgcgcaattaatattgtttcttggttctagcgcgaggacaacacccccattgatgtggatcctatagatcatgcgggtatgatccatgattcgcaggtgggttgcttgttattagaactaatttataatttagtaagtatattatttagcatgcaaatcttgtgttagcgtggcagctgaaacgataaggggtttgtacctttttcatcaatatccattgtgttatattgtttgtaggcctgtaacgatgctgacgttaacgttgccccgactacagaagccgccactggagataacttcggggttagttgttaagttctcatctatttaacagtgatttaaacctctaatcttttgttcgtgggtttaatcctctctttgtggcccccgcatacgcaattaatattgtttcttggttttagcgcgaggacaacgcccccattaatgaggatcctatagttcatgcgggtatgatccatgattcgcaggtgatgtgcaataaaataaatctgttaattattacaatagctgacatttaattattttgttaacttctacataaaaccattaccctaacttatttgtgatttggtactgtagggcccgaactctgtagatgtagatgccgccccacttctgggcgatgaagaaaacacagaggttgatgtagatgccgaaacccctatgggtgatgaaggaaacgcagaggttagtagttatgtgtgtagtgcactaatttatgttgtaaccaccttttcaattccctcattattcccccttggaatatttaaatttgtaaagtagttggggtaggatcctaaaaatgactcagcaaaagaatagcgccctcccattggtgttggtgaccaggtttggttttaccatactcctacattttattatcttaccaaagataactcttaggttagatgttaagttttttagcgaactatcttttgtcttaacgaccagtttgaacacttactctattttgatctgttaactaactgtttttattggttcagcgtgaggacatgcgctcattgatcaagattctccatctcaatccggcctgttacatgattcgcaggtgaggtagtaggtaacatttgggattttatttcgataagtgttataatagctgttaagttgttagtgagtttacacttatattacccacctaacgcaataatgaattatcgagatgaaagttggttagtaaatgtaacgtcgctgtatgtgtcttgtagggaccggtcaatgttcctgcacgaactgacagcactctggatggtgaagatatttcagaggttagtagtgaggttggatattgcgctaactattgttccaccttttcatatccattcaatctgtaatctttcatatcgaggagaccgtggatattcattaatgcgggtttgtgtctgtagtgctgctgaaaaaggcaattccgaggttagaagtttatgtacttaatgatctaagtattctgttacagtataatattcgcctgtagtaatcgagtcaacttgttgcatagcagagtaactatgcttccgtcaaagtcactcacacccctgcatctcttgttaatgaggttagttaataatcttttctgtatatcttattacctttaatttacccttgattactctatgctttaagatttagaatcgaatgtttgattaatttgaggattttcacttttgtctaggttggcgagattgtttcagtgaatgaatccatactatctccaaaggaatccaccattaacgaagaggttagcaattatcccagtaacgaagtcattatcatcttactgtagttatttgtgttttttttacagcgtcttaccatatgttaatttgcttatagagtcagattcaatgtgctcagccgacaagtggagatggggtccatctttccaatgttgttgaggaacgccaggtaatatggctatattatattagctcgaaaggacatcgtctttcttttgtattataaattatccgttaactctttcatctcttcgctgcgaaggtgtgtcctgtgtcggatgatggcaaggcgtctgcggagaatctggataacgtggttagcagctaaattatcccccatatgatatagtttctcaggcttttatttagatccgattcttgactccttgtaaagattaagtatgggacgataacgattttaggtgctcaacgaaactctctcaaaactgttgcggttgtttgaaatacttttttttaatcattatgagttagttattctactctattgatttttccatattagccaacgctaattttatttctaaaggttaacatttattttaaactgatatattaaactgtatgggcgataacattatacgttgttgttatcttaaaacttgtgttcatttaaaaaactttgcaataggctgccttaccctctgatggcggggttgtattacccccgagggtgattctattgatttattaggaacaaatgaactggttactaagtcaacaagtacctgttgattattcccttacttctttcactgttattagatactacgacatttcaacaggctgtcgccggtaatgaggattctcccagggaaggggttgaaaccccctacaagtttaatatgcaggttaacgaataacctcgtttttaattgataaattatatcttttattatttgctaacgactttgtatacctgtataaataggatgttggcagaggcgctccttctgtggtttcaacagtttgcgaggtatgattttttataagttagtgttctagttcctaataatttatttatcctataaacgtcggattacctaataattttggcgtttttgttgcacatgttaattggtgatcataggattctgacgaggtagtcactaacctgttatccatttaatgttggtgttatgttttacaatttatttaacaatgtttacccattttcaggattttacgaccccccccctcccccttcaaaagctgcaaagggctccctccaggtaaatttgtttgtttatttggaacttaaaataggtgtttgccctctttatttgttaacctattgcgattcaggatgatgtcaatgctactatcccgaacgggatatgtgggagaagaagtaaacggctatgaaccctttctagcaagttagatggtcgtttccagtatgacaagaaaaccaaggtttagttggtcatccatcccttgttctcaaccaagcaaacatttttgtggatcccgaggaacgttttcaaaactctatgaagaaactcaaagcgataaggtttgtgttatctgttataaataattgtagctactaactgatttccattttctctaggtgatttataattgcttatgtatttgtatatggtaacagttctattagcatttgtggcggtgttgcactgtctaacaaagatatcttggatttaattgaccggaaaaaaactcttacaagcaaggtagctgatctctctaaaaatcctaatagttatttagttatagtcgttgccttaattttttatttttttcaatccctaaggtaatggatgccctcatcaaatttagccgtcatttgttgagtaccgatgatgctgatggagagaaacttcgggttgaagtccttgattccaagtttgtttccttattctgctggtagcacctaaattttctcgctgcaactccaaaccggacttccaattcccaccagcttaagccggacttccgactcaaacatccaacgtcgcagagattctgttattcaggcagagcttaagccactagcagtaatggtgccattccttttaaacgatgttctttcaactctaatatgagtaactttctgctggctccattttttgtagatggccaattgacatcccccaggtagcttcacttgatactagaattttttctatattccttatccatactcatgctacaggcggtataactgaatgtattgaatttgatattggcggtcttcaaagtgaagtgaagaagttggtatcggccttaattctcgctggtggttactaactaacttttatgttaccctaatactttaccatttgtgttttgtttccttaccctcttcttttcacctcctctaataacgttgaccttcgttgtgttctcattgttgcttgtagtatccgtgtttattctgggatatctatgccaaccgtcatttaacgttttccagttgtttgatattatctcgttagcgataagggtttagaagtaagcatattgtctcgaatagttattaccattactaataatagatatgggattaattaaaattatattgtattacgaatccacgaaattaccttggtatcgggtataaagctacaacaattctgttgactaacaaaaattaacttatccgaaatctattattaatggataagagattatctctgtatatttgttatccaggtatcttttttgtattcattgtctatcactacctgttagttaatcactggttttaagcctattattttttgtccctaacatgtctaatatatactattgtatcgcgataatatgattcttgtcaaaacataattacacaacgatatcgttatatgtatagttacccgttaacagattattatgataattggttactttttccaagatatttgtttttgtttaagatgtgttaatttactacttctagttggtaagaccaacatcacgatgtcaaattatctggaaacaatgaaacccaacgttttgttaactcgcgatagtaatggtataaccgtgaatatcgtctgtgttatcgcattttcgaacccaatggcgcggtagccgttaatattatactgtccatctggtagccgttaatattatagtgttttgagcatttagtacatatgtgtcagataactgacactaccttctcgcgttagagttatcgtgtttcgatgtgttatagtattactgaatgcatcgtttttatcttaataaagcgatattaatgttattataaacaagtgaatccctttagtaagataaaaacgggataatcattcatttgataacccgatatctgattgtcttcaaatatcgggatatgagcctaactgatatcgcgatgtcgcgatatttgattgtcttcgagccatcgttccttcatttagggacataaacccgaagtagataatgaacccgtctcactctcactccttcatttagctattcttcgacccccccccaaattgaaatctaaagaaccttcaaatcggatccaacgatcttcgatcttcttgttaagtatgagtaatcaatcatctagttcttctggatctacgggacctcagggtagaggaaaagttgttggggtgccaaaaagatgttggtgccgggaaggagtcatggcactcatttcaaaatcggatctgaatccttgccagagatactatcgctgtgggtttgctgcaaaacatagggtaatgttactcatcaagttcacctatatcatagatttattcaatcttcatgtttagcttgttcttaattatgtagattaatgttcatatgtagctaaggaacgatgaacacacttttaaatgggttgataaagctttgctcaatgagatcgaaacattgacagacaaaacacgtgaatttgagcaagagttgaaagagcatagaacagagaggatggtgtttgaaagaatggtttcggagaaactcgaaatcaagatcgagaatgaggttcttgagaaagttgaagaagctttgtctgaagcgaaagcaagcagtattgaataaatgcgatacttttgtaactactaactcgaataatgttcgtttcttaattaaatgttttttggtctaaataaaaatgaagattgtcattggtattagaataaatccgaagtcggctaaaaaaactatgattattatactctaattactaagcaggaccatgagatacaaaatataacaacgtgctcaatatagctgctaacaatggcaatatcgaaacgttaccagataacaagacgaggaatcggtaatataatatcacagcaaaacacgttaacgctaacacgagaaggtagtgtcatttatctgacacacatggataaaatggtcaaaacactataatattaacgactaacacgtcgttatattctcactgtaccattaacgactaacacgaccttgaattttgtaatgcgataacatagacgatgtacacagttattaaaatatcgttattaacattatctttatcaacattaccacttccaggatgttgtgtatgtgatttgctaagctcggctaagtagtttatcaccacgtcaagtttgacaaacgataagaaaatttttagggtgacacactttttaacgagtaataaacaagtaggttgacacacttactaaacaggaccgtgagatacaaaatgtaacaacgtgcttaatatagctgctaccaatgacaatatcgatatgttaccggataataagacgatagattcggtaatataaatcacgatggaaacacgaaaacgttaacgcgagaaggtattgtcagttatctgacacatattaacgactaacacgctttttggattcggtaatgcgataacacagacaatatacagagttataaaaatatcgttactaacattatctttatcaacattaacacttccagggtgttgtttatgtggtttgcttagatcggtaagtagtttatcacgacgtcgagtttggcaaatgacaagataatttgtaggttgacatactaattaacgagtaataaacaaggcataatatttgaaataacgaaagttggatgggttccgatatatatacatttgggaacagatgtcgtacgtatgtacattgaaaattttcttatctcattggttccttatttatttcacatggccaggtcagttcctgttaatcctggcaacctccatccttcaactttgctcgccaaaaaagttcttatcttcttcgttatggttcctgcattcaggatatgtattttaatatcaagtaattgatatgataatccgtaactcttttattaccgtgattggtccattgcaggttgccctgttatgacctaacgacttgcatcgtgagcatctttttcttgatgttctctacaaatgtgtcagaagtttataacctaataagtttagcatataagaattatattagcggttacaagctttagttaagctagttaccttgaactcgcctctggagaatagtcttcgtttcctcgggtgacctggtggtctccaagcatacggtggagctagtttaccccctcccacatcatttggtgaaggagtccgcgtctccgtgtctggaaccggcagcgcttgatatgacaatctagttgaggggtggtgtgatggattccaaccatcgtgtccactaagagtccttcctgtattgccgcggctatggcatgagtgcaaggaatcgttagcagctgaaactccctacaagtacatgttcgttcccacagattaacagcaaatgctgcacctcttctctctggaacttcatagagcccatccccaatttttattacagcacatcctgctcccttctttgtaattttcgatcaccatgtcgtgtacctttggcggtaggatattctcctcaaactgggctgcttgcctccggagtgcaaaccatgtgactagagtagttcgaatggactctaatatcaagattaccggataatctcgtgccataattaacacattgtttagtcatgtagttatacctgtttccaacaaaatgtaccagataatgtttaagttacctttcgcataaatagaggagtgtctgtcggacataaacactaactccggatcatctggtattgctgccgtcagctttgtcatgaaccaggtccaagcttcgtcattctctctgtttacaatcccaaatgcaatgggaaacacttgaaaatttgcgtcttgcgcactagctgctattaagcatcctccagagcgtcctcgtaggtggttccatctattactatcaccttcctcatgtaaggataccccacaacacatgcatgaagcacaaaaaacaagtacttgaacctctccactccagtattatccttttctatctccatggcgacaaaggagttgggatttgtctctaaaagcttcttgaagtagggttggattagtgtgtaactccccatagctgacctcattgcattgtccatagctatttctcttgccctccacgccttccaataatagacgttgaggctgaactcttgccgtaacatccttctcagcacattaggtctaggtccccggcctactccaatatatttcgttctcatcaacttccctataacagccgttgaagcttgcttatggaagtctcctctagcatctacgctacatgtgtgggttgaagttgtgctcctaacctcgaaacgatcgctatccggtaactcgccaaggacatgtatcgctgacacagacagccgccaccacattagatgaaatggaacttccgatgaatcgcatgaattgctagtttcgttgcacaatcttctttgtttttaccttcctcccctgggtcgtcgaaataagatggggcatctctgtcatacaagactgttgcaaccggtgtatccttcacgatcattgcatttctctgtaactccgtaacccttggattatttgaacttgatccaatctccttagagggtaacacgtcttctatcattattgttttccctttatataccattgtgatgggttgaggctccataacgagtgggccgtcattatcagaataaacgtgtgccagtgtttcctcacttgtgagtaaatattggaaggatggttatcgactaacataacactaggttgattagcagataatattgtatgtattaggtaacccacctacgatcgataaggtcatgttgttcgacgattcagtatcatccataaggtcttcgctactgaaagaagcgctcgtggaaattgtggttggagtcccaaatgtcgaatcactcgaagagactgcaactatatgtggtccaacagattgttccactgatcttgcaaggaacaaactcaaactttcacttggtcgtacgtttggctgttcgccacttccgaaatgaagggctctcgctgttttctctttctcggaaacgttttttttctattgtttgagttcctcctagggtcatttgtgttgcacacatttcacgccgcatctcatcttgttgattttttcaccacagctcgaataaccgatctctttcaatatctccgtcatcaataaccttctcttttcctttcaagcttgcaattgcctctgattgtatcaccgtacttggtgtcccggttgttccagctgaaatatccatggtgtctcgtattataacccctgcattcgtgttgtgttggtccttgcctttgcgtatatccagctcggtgtcactccccatgttttgcatatcgtctctgttacctataatacataatattctctaataagctggtatcagctaacctttctgaacacaaggtattatattctcggaaaaaggaaaaatattcaatatatgttttgctgataacataactaaaatcgtttaagtttagagttatcaggctcacctgaaaggttccaaagcagcattcttgttaaagcggtcccccacacagctcttccagtatttatccgctatttccttagaactcaatccgcttagatcaaagttactccgataactattaacgtttcgaacatttccaccccgatttatccttacgcgtagatgcacttcatctagatccgcccttatagccatgaacagagtcatgtcttcgtcgtctagtatgtcgattgggttgcacgtttccaatcaggccccatcatccactgcggccactggtacgtcagctcgatatcgtcgtcaggccccagagctaaccttcttttaccgccataaccactttgacaaacccgtctttctcgctcagtcgcactcccagtgcaaagccatccacatgcgaaacatgttcgaaatatccgttttcatccctcttccattccccaggaactaatctcaccacgaatgccattgttatctgcaggttttccgtaaataacaattttgttagcgttctcataattataacaatagtctgacaaaccctaaagtaaagaactttccaaatgataactttaaagtacaaaatactcagatctttaacttttacctttcagatttcaattctctgtgtttagctccttcttgcatttaagatgtcggaagctaaagaatttagtatgatagtttttcggttgctaacagagtgaaaatatcaccctaataaatagcatagcatgtgtaagtgatatttccgcaagcccgtaaatatcagtaataatttcccatttctttgatgtttccaatgccggcacatagtatcttccaatataacctcgatatcttgagcattaaatggtgaggcagatagactactaactgttatcgttttttcggttttgtaggggtattaacgggataaataaaagcgccgaagagagagggctaaatatgattttattatgcatggtttcttaatttttggatcgtccgagcatagactttaatatcacctttaaaataaagtctatcgttacacatacttataaaatatatgaatataatatcatcaagtctcaataaatttattaatatgtcatcttagtcacaatattaggagtgcacattttagtttcatgttaaaaatgattcgttctaacaatctaactagagtttagcttattatttataatattttaagaagtgacaacaaatatatatatatataatttataatgtatataatttatacattgagaaacgaaaatacaaaaataaatggaagaaatataataaaataatatcggtgtatgggatgtttaagggatataagagatctattaagatttaaaatactattaatttgatcttattatcctacaataagacaaaatttctaataataatacataacgaaagataaagataatttttcttctcagagaatggataacatatattgacttgaactaacatgtgaaacctacaacaatgatttttttataatgttaagaaaagcatatcaatggttgtagtctagatctttaaaaaaaacatttagttttagcgagctgtgaggaaactaggtatttgcagttgtttaatcaaaatggttatctaaatcctaaactatattaaaacaattaataaaaataaaccttcgcgtagcggaggttaataacctagtatataccaaaacatgttgccgtgtcattgtaaaaatttactcaataccataatcaaaatatgacccttaacaaaccgtatatccaataaacataaacgaatttcctctaagtgaattatataattttattttaccatgtttaacgaattaaatttcacaaatttcaacatgataaaccataaaaattatttatctatatcataatatagattaaattagattcatattcagtattaaacaagtaggctctgctacaattgaagaaatttgtaccggtttataacgatttataaaaactaataacgaattctatagccagaaaccgtgtaaataaataattaaatctagatcttagggtttaaatattcctggatattctgcagcgaaaagatgaaccatattaattcgaggttgttttagcactccaagtgttgtgtctttaccggtatccacacgcacaaaatgtgaatcagatctgtaatgctaattcctttgagatcttatctcaaaactttagacaaacttttgtctcttgtattttagggttcttgtgatcaaaagtatatctcactaacgttgctaatatatcatatatatagctaaacgtttaaccctaactaattatgtatcatatataacatatatagtataataaacattttattatatatgcacaaatacaaatatattatatattatattattattaatccaacattaatccaatttgcttaggtgtgtgatcatgtaggtttgtataatattagcaattagttctgactcatatattataagcggtctctagcaaaacattataaccacctaatattatacaaatgtccaacctcgacattacaactttaactaaagtaaaattcaactgatgtcaggacattaccaacattcttatctcgggttctcgcctgagcaagcatggcttcgctatcgagatcgatgcagataagcttgtaatctccaaaaatggggtgcttttgggatatagttttgtttgtgatgttcaattcaaaatttctattgaagcggtgatctgcaacaatgttgtaaccgaggcttccacctcgaagaagaatgataaaccagttgcttatgtttcagagtctttcaatacttagcatgaacacataggacgtgttaatatcaagtctatgagtagattgatgaacatgaatttgattccaaaacataaaataagcaaagataaatgttagattagcgtccaagccaaactcactaaaataccatcacccaacgtggagagaacaacacaacctctctctacaggaaaattgagtattcttagtgtccaaaatcctctatctaacgagacaatagtgaagtagaaagtgttatgtctgcgcccatgataataggtcgacggcttatgatagtggtttggagtggtgctattgtttgtcgatatagtatagcgatcaatatgatgcaattgttatatgtttttatagcgtgtattgtttgccattaattatctaataacaacatttacttcttgaaattgttacttatataatagcatttgtagagtgctattaatttataataacatagcgtcaaaactatgcaattaattgttttgaaatagcatttacattatgcaattgtagtaataaacatagcaaatagaaaatgtcatttaatcaatttgaatagtaattgtaacctgcaattaatccaattattatagcatttattagtacgcaaaaacgaatttgtgaaaaaacaaacaaaaacaagctaaacacaagtaaatattagagaaaagaaaacgcaccttattttagtgtactattattctgcaactatgatcccttcacaatcatttctattacaaaaatcttcatcatcagaagattgctcctccaaatcattagaatcctgaattaatactgattcagcaacaaacttctcttctgtctctaactcgtgataccctctaggtggcgtcctcataactacagaccaaggtaaagagtcatcttcgacggagtaaaatacttgttttgcttgagatgccaaaatatatggatctttcagaaatgcagattggttaagatggagattaacaagagtgaatccgtcttcttcttttactccatttcctttgttggcccagttacatctgaataacagaatctgaaacatgtgataatccagtaatatgatctccgttattactccatattatgtaacaatgttagccatgtggttagtatcacgagcactagatctacacatactaaaagcttcatagacaacaccactattctatgtcttccgcttcacatcatcagttaaaaatcgctaaccattgatgatatatcccttatgtgacagagcaatatttcttggtctgaatgctaaccatctcaattgcgtgcaatgctcttttgagtttgtaggaatctgttcataataaataaatgaagagttattcaatacaaatattcggtatatctatcactgtatggaaataattcatacatgtactttaacccactatgggaatttttccaaatgagttttccataataaagtacgattccttctcaatctgacatcattctcttgcatttcttcaaaatgcaacctagtttcacaatttcataaattagtttgcattgaggtacatgtaacattaatgaattatgatatagtagtgattacttactcaatatatggattcataactgccatgttcattaagacataccggtgagctatgtctgtctctttattaaaaagcataacttttgtacctttctgcaatgggcggccttgacggattagtggatcaacctcaacatcttcattgcggttgattggttcttcaagtggtacatattcttttagaaactccaaacaaaaagccatgcattctccagccaagtatccttctgccatgcaagcttctggtcttgcaaattgttttaatacatgcatttagtgttttcatgtacctatatgtaaataaaatataacatttatcaaatattttaatataaaaaaaaatttgttattaaaaatttaagatagtacctttaaatggatacatccacctcaagtgaactggtccacgtaaacgaacctccctacatagatgtattggaagatagaacatgatgtcaaaaagcgatggaggaaagtacctctccaatcgacataatgtctccacaagctaagactctaaggttatcagcttctcagcttcaataacatgctgacacaatcggttgaagtaactacataatctacttattgcaaacgtaggtcctttttgcagcatacctcttaaagcaacaggtaatagattctgaagaagcacgtgatggtcatgggactttaagccactaataacagtcgagttaaccaaaacacagttatttatattcgaacaatagtcatcaggtccattaaacttagataatctagtgcaaaatatatttttttcttccttagacaaccaaaacgatgctggaggcaaataagtttttttaccacgtattttgagtgtgctatttggttcggatccccatatcttccaagtctttccgtgcttttatcctatcctttgatttcgcagtatgcagcaaaatggacaaaatggcatcagacgcattcttttcaacatgcattacatcaatattgtgacggacatgcatagtctatacatttagaaaataaatattgttaaaaaatgcacgaatttattagactatttattatgttaagagcgaaccatccaataagctaactcgaataaaatagaacgcttcttccatctccattgatcagtgccttcctcatattcatcatgtaaactaacctcatcttcaaacaactcttttcgatttcttttcttatttttagccagtggtttcctgaaatcatttttaaagtccttaagactatcaagaatttcttctcctgtgtgaattctatttgcagttccttcttcaaaggatgcccaagtctgagtcgcttcctattacctaaatacacatacttacgactgaactttaaccacctatgtggtgtatcttttccacatacattacatgttttttttcctttaactttacatccagccaatgtccctaaggctggatagtcactaatagtctataacaacatcgcccgcaatgtgaaattctccttcataaatgagtcataaatctcaataccgtcactccacaaatcctttaaatcgtctatcaatggagctaaataaacgtcaatgttattactcggtgcagtaggccctgggattaataaagacaacatgatgtttttctctttcatacacatagtaggtgacatgttatagttaactagcaaaacaggccaaatactgtaactgatgttttgaatagagaatgggttcatgccatctattgaaagacctagcctaaggtttcttggttcaagagcaaattctggccaattttcattcacttgagccaaggtgagtgggtcaacgggatgtcgaatcgtaccatcatcactacgattactgaagtgtcaacgtaaattctcagcagtcttttttgatctaaacatcctctttaatttgtcctttatgggaaaatacctaagtaccttagctggaatcccttgtttaacatcgttactatacttatccttttcccatcttgaagttttacatcttggatagcttaccatgtcctcatactctttctggtaaaggatacagtcgttcttgcaagcgtgaatgacatcatagccaaatccaaaaatcttcaggaatttttttacctcgcttattaatgttggaagaacattatctccagggagcatatcatgaactagctttataagttgatcaaaatagttctccaacatcccactcttcactttgatgcgataaagtcccataattgcagagattttattatatttcaaacatccattgtatagaggagtttcagcatcctgcatatttttttttcctaaaatcagattcttctttattatcttcattagaagctgcctcaccattattgtccgaataatgtttgtcgtcttcactttcaaaaaatgcagttatgagcagctcataagcttcacctggacaagttggatcatcatcactacgattaacattccttttatccccatcattaatccaaaaactatttctcttgtacttttcatccattcctctaatcactagatgctccaaaactacatcaacttgttggtggcacaaattgcgacaatcactgcaaggacaaaacattgccgaaggatttcctaaagtctttgctgattcaattaaaaaatatcttgcaccctcctcataatcattgctaagccttggaaaccagacccaagacttgtccatttgaacacaattttccatctccatgattgaataaatcaaaatttatagtgaataataaacacaaaatttcaatacacagccgggtatactatcaattttttcaaacacaatcagtatgctatcaaaataccagtttatctgatttagactacaaattcagtcattattcctatcaaaaaaacggcaactaagggttcatattcgaatcgacaaattttgttaagaattgacaaaccttgtaatgcaagctctattccaaaaagaacagtggattatgatgtcctcggctacaagaggattgtgatgtcctctacaataggattttgatctcctcggcttgaattagaggagacaaagattgttatggatatgggagactggagatttgataaccttagaagggagattggagattcaataactggagatgagttcaagaatttttctctggagattgaagatcgaatcttggagattgtaggtgatgacagtggttaagagattaaaaagctataaggttagggaaaaaataaatcgacgacttatgtaacaaagttttttagggaaaatttcaatttaattaaagcatcgatcgattgttaatgaagaatttcctaatttgttatattttctcgtaatattcaatagtaacaaaatggtttggttttcatcataagtccacactttgacattatatttgtatgcaaaaactaatcatgatattcaacatcaatgtttccaataaatgttttatttgtatgcaaaagctaatcataagtccaaacatgaaccatatatatcaggtttcacaaacattagaactctagagtacttcaaccaaaagcaaaaccacaatagcataacttgttttaagagtacttcaaccaaaagcaaaaccacaatagcataagtacttgttttcagagtacttcaaccaaaaccacaatagcaataactttaaacagactagaaatttcaagcgattctaacaatcaccacttttagacaaacatgatcttctcattcggccaggcaacagtagaacctactgcatctgcaatgcaaacaatttctgaatttggtttccagactttagcttctccaatcttcgcgacttctatcattatcttgcttgcattgtgacctaagggaacgaagttgactctctcagttggattggttgacataactctaccttctgcaacttcttctccagaatcatcgcaatctaacaaaatgcatttcttctttctaatagagtcggtgctacatgagctgttgcttaagctctgctagcaggaactcatagaatgtcagatgtatccattactaatgtatagatcacatagataaacaatgtaccttagattttggagtcttctttgatgctgactcatttgccttaggactgagcactcgaatatgtttaagaggcaatgcgatgttctgattgactgccttaccaattgttaagatttttgtgcttagtggtctccacagggaggcatttgaagctgttggataaaatttatcaactgtcacaattgatgctccctgaccaatttggaagttgttgactgaagctgttgggtccagacagaagcgtcttcgtttgttacagacctcacaataacagcagccgcatgatgatctatttttatacggccaatcttgtacaatggatccattgaataatattctgcctctgcgacaaccagatccttaggtgcagaccaatcaagtagccgataccttacaccattctcttcagaattagaaccatcatcactttcatgctcacaataaaaacatgaacataagataaatttgcattcaatatagtatgttgagaagaataacatgaacaattatatgttataaacaaaactcacattttcccagttaaatcacagactactttccgcaagtcttcaatccgggtttgcatgatcagcttgggtagctttaagtgtatcaacttgtgagtcacttacctgtaggagtgccagcttagcggcagtaacacctctggcgagtcctctaattctgccaggtttgtctctccgcaatacttgactaacaacatcttctttaatactcgttgttgctgaggagcccatgtcactatcaatagtccttattttttcctaacaaaccaaatatttgaaaattattaggaatattaaagtccaccaaacactagatataaaatggatgatttcttacaatagtctcggcaaattctgaattcacatatcttccatctgaatgtgtgtgtccagctacccaaacttttgcttctggtcacctgtttatgatcagaactattctgtttctacaattgacaacacaaaacattcatagaataagtacaaaaactatcataaattccatcaaataaatccagtagggtagctataccaccttatgagctaggcatgtcatgcctcgacggatggttgtgtgaggaatttgagccttccccaagcttctgtacctatcacttcgtacctaaattaaagtttcagtttagttagatgaaactcacaaataaccattaacattaactgaagtattagatcctaatcaaccttaaattcattgttggttttacacttcacccaattattccaagctatgacagattggatgttgcttggctttaacttaagtctttcagtcttgtctttgcagctcggacttcagagacgagtcttgacttagaagacctccacaaacaacccatttgcttgaaaacagtctctttttgccaaacttctttcaaactgaaccttgcctagaatatataagttcaagtcatttaaatttcaactaaaaataagatgactactatgaaaatacctggatttcttcacatagggtgtcactagtctcatcagaaaacttcctccaatcatctaatagtacagacacatgttccctcacaagaggaccaaggaaagaggagcgtgtaactgaaccagggccaacgtgttcacctgtagatgtaaatttaacatctatcttatcgtgaatctgttttgcaactttgctcatcctagtttgtcctcttgttttccttttctttgtctctatctcctgggtccgagtttcctctgtggaaggttggacatcaccctctgttgctgcctcttcttctctttcaccatccacttctgtagttgcaggctgctcaccatcttcctcttcttcagccaagtcagaaacaagtacactagccacactcccttgattttgtagttcatcaatctcattcacaagtatttcatcaataacatcatttctagatgtgacattactctttactcgtctatggatttagagtcctacaacgaaaggcaaatccacgccttgttgacgaagactacgccggggatggtgcttaagtgacatctttgaccacctgatggaatgataaaaccaatgaacaaatatcagaagcaaaacaacacaacaaaacagattataaacaaaagaggaaatatgactatctaacttactctctctcgcatctgacatatcaacacattaacacatcaagaacaaatctgacaatctaactcaatctctctcgcatcagacaatctactataacgaagacccattaacaaacaaatcgggtaaacaagagtttaaatctgtcaatttgagattttgattgtgaaaaaacaaacatgcatgaccctaaatctatcaattgtcaaagctgatttaaaacgaaatagatagttatttgggtgagagtgagttgtagggttactgtgagaggcgacggtgagaggtgagagacgacggcgacagtgagaggcgacaatgagaggtgagagacgacgacgacattggaaggcgacggtgagatgcgaacgagtgtgagagtcgacggcaacattgagagcggcgacgtcgactgattttcgtgagagtcgacggaaagagtcgtgagccagatgcgagagaaggtgagctagctaggtttgagagtttagagaggaagaggaaactacagttcgaaaaacgaggcagctagaagacaagtttttggagatgaaatagaaatagtaataagcgaactcgtgatcaacgagacaacacttgcatctccggaaatgaggcaagtagcttgggcacgactatcaatgacaaagaagaatatgaacttagacggattaaaacatctcgaaaagaaaaaactttcggttcagagttcatagtagcctttcttgcaaaaaatgaacctaaaaactttagggaagcaatgtctataccagacgctccttttttgaaggaagccgtgaatagtgagatagattcaattctttaaaataatacttattagataatcgacctaccgcaagggtttaaggttcttgggaataaatggattttcaaacaaaagttgaaaactgatgggtcaatcgataagtacaaggctagacttgtggtgcaaggtttccgggagaaagaagggctggtttctttgacacatattctttgttacgagaataacttcaattagagtgctagtaggaatatatcagcattaagagatttagagatccatcaaatggatgtaaaaacagttcttctaaatggtgatttagaagaagaaattttcatgaaacaacctgaagggtttatagttccaagacaagaacaaaaattttgtcgtgtagtgaaatcattgtacggacttaaacaagcttctaaataatggcatgaaaaatttgacaatgtaatgatgtcaaatggcttcatcataaatgaatgtgataaatgcaatatgtcaaaagtacccctcatagataaattttgctatgtttatatgttgatgacatgctcattattggtagcaataaagatgtgatcactcaaacaaagaatatgctaagccgtaagtttgatatgaaatttatgagactagccaacgtaatttcaggaataaaaattattaggcacatcgatggtctaatcttatcacaagaacattacacataaaagattcttgatcggtttaagaactattcaagcagaactacaaaaactccagctgactctcatattcacttgacgaaaaattaaggtgaaccggtgtcacaagtggaatatgaaagagtgatcggaagtcttatgtacttaacaaattgtactagacccgctcttgcgcactgagtaaatgtactaagtcgctacacaagtaatccaggtcatactcactggaaggcactaacaagaatattgaattatattcgatgtaccaaaagttatgggttgcactataatagagaactgtcagtcctagaaggctatagtgatgccaattggatttctgactcaaagaactcaaagtcgacttgtggatatgtcttcacattaggtggtgcaacagtatcttggaaatcttccaagaaaactatccaagctagatcaaccatgagttcatagctttagataaagcctccaaagaagcagaatggcttcggaatttttcggaagatatcccgatgtgggaaaaaccattgctagcattgcgtatacattgtgatagtcaatcggctatagctagggcacaaaataaattaaacaatggtaaatctcgccatagtagaaggcgacacaagaccattagacgattgatctcgacaagtgtaattttgttagaatacatcaagtcagccgataacttagcggatcctttcactaaaagcttagcgagagatcaagttgttaaatgataacactgtattttactcattttaggtatatgtttatcatcatttagctttgcctttgctcattgtatcatgtcattttgcaccattttagcttattttgcatacttaggcatataggatcatcttgcattcgcattgcatgttttggtgtgttttcaggtgcagaaggagctaaaaagggctctactcgatccattcactcgatccaggcagctacagaagaggcatcaattcactcgacctctttactcgatccaggatgctacagaggaggctgcagtttactcaaccctcttactcgatcaaggcaatctcagatgaagcagaagattgatctactcgcccctcctactcgatcctctactcgacccatttactcgaccaagggtgaccaactctacaagacttgttgggctatcaaagcgtcttcggatcctcttcattccccactcaaccagacatctgagcataaagatagaagaggaagaagcatctactcgaccaattgatcactcggagcatagacacaaaggcacaaactttgcatcaccctctttactcgatccccaagatcgagtattcgcccaaaccgcctcaagtctcttgtcttctagtgaatcttgggtttcaacattttactataaatagatcactttggggtttgtccaaaggatctatgctttatctttcagtttttctttttgtttatgaatcttaaaaccttaattaccgttagtctatttcggttttgcatttgattgtttaagtaaagttgtttagcttgtttagatctacattttggtatgatttcagtaatttctggttttgtgttcttgagaatgttgcttgagtagtgattagggttcttgaggatggattagattagggtaatctctatgttagttaggtggttagtgtttaggttaatacccttctggattcgcttggcccctatgcggttttcgttggctaatgtggagattcgattatagacgtccagcgtccaaaagacgttcaaatggatgtctaacctacaaattttagagatttgtagactcgacccagagattggcttgtctggctattggctttggtagattgtttcttaaaccttgatctgctatgtttaatcaacgagagttgagattaggaagtggtagagttatgggggtctctgtcacgagagtggattgacccggtttttgaatctatcgtaatgggtatctaccttttgcctattagccatctgatgaaccctagagttgcccttatcaatgaatccatccttagaacttctattagatttatttgtatcccctgttgattgcacttttatttacctgttatttgtatcccctgttgattgcatttaggttacttaattttgttgcatgttggttctactcgacccaatgatcgagtagggctcttaagttttcttttttacttgtttgaatcctgacctaggattattactagaaacccaccatcattataatctagcttgacttacttgtttctgtgcacatcttgattgctagcaatatagtggactggattgacaccccctatagctgcattgacatgtttgtgtgtttaggggaattaaactgaatcacacacacattcaacataagtaggccgaaaaaacctgcttatcactttggcgtcgttgccaattcattgttgcatgttacattcaagatatcataaacttttaagatcaagttcttttacatttatcaagttactaactcatattttcgtctgcttgtttttggtggtataggtactaatatttgtgcatgcaaactcgatccaaaggttttgcacacctactactattcagagacaaaatagatagaatagctcctgagttacaagaaaccaaagcaaaggtagcctatgatcagcaaagacaagttgctatggatcaacagaacaaacgagttgatgttcaagacccacctaatgttgatcaaccaagaaacattggtgttggtgatgccccaaggaatcatcaccaaagacaagggatagtgccatcaccagttcagaacaacaactttgagatcaagagtggtttcatctcaattatcctaggaaacaagtttcatggtctacctatggaagatcccctggaccatcttgacagctttgataggctctgtggccttaccaagatcaatggtgtcactaaagatatatttaagctcagactatttcccttctctttgtgagacaaggcacaccactgggtgaagactctacccctagactccatcacctcatgggacgattgtaagaaagcttttcttgccaagttcttctctaacgcttgcaccgctagattgaggaacgagatctcaggtttcaaccagaaaaacaatgaaactttctgtgaagcttggaagaggtttaaaagctacaccactcagtgcccccatcacggtttcaagaaggcttcattattgagcacactctacagaggagctttaccaaagatcagaatgctactcgacaccgcctccaatggaaacttcctgaacaaggatgtagcagaaggatgggagttggtcaaaaatctagcacaatctgatgggtgctacaatgaagactatgatcgctcagtgagaggaaatggaggcaatgaggataaacagagcaaggatatcaaggctctgaatgaaaagataggcaagctgttgctggctcagcagaagcagatacactacatcactgatgaagagcacttccaaatgcaagaaggggggaatgataaaactaaagagctgtgctacattcagagggttgaacaaggggtacaataactacaagcccaacccaaacctctcttatagaagcactaatttagctaacccccaagatcaagtgtatccaccacaacagaatcagtacaagccttttgttcaatacaaccaaggttatgtccctaaacaacagtttaatggaggctaccaacagccgaatccaccaccagggttcactcaacaaccacaacaagccccaacagctcaagatcctgaaattaagcaactcattcaacagatcatccaaggacaagctactggagccatggcttttgacaagaagatagctgaattataacaacaagatcgattgttcttacaacgatttgaatgtcaagtttgaagctctgaattcaaaaatcaagtatgtggagagtcaatttgcatcaacctctgctccgaagcatcctcgacaacttccagggaaagcagtccagaatcctaaggactacgctactgcaaatgctatcaccatcctccaagaaaatgagtctccaccaagtcatcaaactcccaatactgaggacagtatgattcaagaagggggggaattcaactcaaattgctgcacctgccacccagcaattcatctggactatagaagacacacctttgctgaatactcaccattctggaaaaaagttcaaacttgaaaaactcaagaataatcagaatcaagagatgattagcagtgccaacactcaagaaacttacaagaaggaagtcatccaagaaaagcttgatgataccggttcattcactctgccatgctctctaggaccattgacattcaaaaggtgcctttgtgatttgggagcatttgttagccttatgcctctctctacagctaaaaggctagggatcatggaatacaagttctgcaacctagctctacttttagctgatggttctgttacacatcctcatggtctaatagagaatctgcctgtcaagattggaaatgttgagatacctacagattttgtggtattggacgtagatgaagaaggcaaggatcccctgatcctaggcagaccattcttagattcagctggagcagtcatagatatcaggaatggaaaaattaatcggaaccttgaaaaaggcatcaagatgaagtttgacatcaaagaagcttaagggaaatcaacaacaggaggcaagagttttgggattgaggacatggatgctgatgaagaaacataagctgaaacctcaccaaaagtcaactatacttctcaactcagcaagctgaagagaacttttgaccacaaaaagagagcaacagaaaggctagctcagactgaaaatcctacagaagatgactggtatgagatgagaaaaaaatctaaatggcaaagtagagtcatagaaggattgtcttcaagggtgatgaagctgaaagatcaactttggatgttcgaaaaaagagtttaaaagttttcaaatggtattgatccagagaagaaggaaactgcactagctatcaaggaggacaaagatttcacaacagaatggtttgcaccagaagatcagaaaggagttcacttagaggaaggaagcctagagagcaagttgttgagtgaggaggaaactcctattctgacttattctccaggagtgcataaaagcccacatacccctctgctgaagaagaacacttgattcatgattctgttgctgtagaactcctggagctctgaattggatataaagctcaagaggatacaataggaaagttaactcataagatggaagaactaaatagcaccattctggaacttcaagaaatggtcaaggactaccccagttttgaatttgaggattggtcaaaggaacctggttcagaagaagaaggctactctgctgatcagaaagaagcttactttgaagaaaaatcaaatgagtactcatcctaccatatctcaagagaggatgcagagtatgattcaagcactgaaaattcaaccactgaagatgaggatttctctgttcctctcttcaacctttttctgactaagctctgtaagagtcaagcttagtgacttaaaacaagctcacttgggaggaagtcccatgtctatctatgtaaataactttctattttcttattatttttttatgtttttatttaagtgtttcaggtttatttcattgatcatgaaggagtcaacggtcgagtaaattcaaaccaagtcaagaaccatctcaaccgttgatcgagtagaatgagtaggagtatttttagccattgatttggatgaccaaaagagaagagcatcaccaccgtttgatcgagtgacttcttgaaggttattttggtccgtttgatcgagtaaacaagaatgagaagctctccatcattggatcaaattttgcacaactcaagaagatgctcgattctttactcgaacttgaattatttggagaccaagaagtgatgtcgcatgtcccacttgttccccttcacttcattattcaacgaacaaatcatttactcatgcccctcaccatttccaatcaacttttctatctcttccaaagcaaaccaaagaccaatctcctccacccattgatttcgacaaaccctccttgaaactctctctttcatcatctcgttttcgcaaccccctcacaaagctttgaagtcttcattccaaacccttccccaaaacgctccctatcactccttaagaatctgttccccttcaccattacttcaacaaagttactcgatcacctccaaagtctatcctcaagcattcaatcggtttcaagctcaaaatttcatcaccaaagaaaccgattcctttctcctttgatacctcttagagaagtgttcttgtttgccctgtcaaagcttaccaccaatctccatggatcaagaacgaagagttcatctcgggcaaaaagatcctctgttgataatgaggaagttgaggcatttgacatgagtggaatgactgaacgccaaattcaccaagctcgccgtgctcaaagattaagcttgattcaaggttgaagctcaagctgcccagccatgcaaagagaagaagtagctcagggaaagagggtcattgaagctgaagaagaacaccatgaagaggcaccctttgaagaagcggtttctgagataagatttaaagggcttcaaaagatttacaaaagttttaaaaagatttttaaaggtttaaaattgtttgaaaaggattttaaaatatttacaaggaattttaaaagggttttaaaatatttacaagggattttaaaagggttttaaaatatttacaagggatgttaaagggctttaaaagatttacaaaggttttttaaagatttttaaagggtttaaaagtgttttgaaagatttacaagggattttaaaagatttacaagagatttttaaagggtttaaatggagtttaaaggatgtacaagggtttttaaaagatttttgaaaaatttacaggaagaccctttaaaaactcttgtaaatcttttttaaaccttttaaaatcccttgtaaatcttttaaaatccttttaaaatcccttgtaaatattttaaaacccttttaaaatcccttgtaaatcttttaaaacccttttaaaatcccttgtaaatctatttcccgccaaaaaatatttacaaggatttttaaaagccctttaacagttttaaaagtttggcggaaatttttaaaggatttttaaaggatttttgggcaggcagaaagtttggcggaaattttttttttggcgggaaaaaaaagttttgcgggaaaatttcagtttccaattacatgtttctattagatgatggtaatttggtcattttgttcaagggaaaatgtattttttaaaatggacaacataaaacggtattgttgtaaaatggtagtaaaaaaagggtagttttgcaaatttcccaattgtatatcctatttttttggtgccgacaaaaaaagaaaacaaaaggctgattttagtttaaaatataaatgttttaaattattagtaaattttaataaggatatttttttaattttatatttttttctatttaaaaaatatattttaaaatacaaaaatggggtaggttatttttcaaacaaaaatttagaaaataggcattttcccaaattttctcttaaaatattctaaactcttcctaccatctaatctggttcggtgaaattaaacattattttttcgtgttgtttttaataatacttttattaagaaattataattcaaatcaatttaaaacttttctttcaaatgttttttttaatatttataaatattctaaaacatttttttgttaaatattctaaatgtttaataaacttgaaataactataatatttacctttaataaagtataatattaataattacctaatatttttctaataaccgatagagatatattagataatgaaatgctagttgtaacgccccgaccgcccttaccagttggccccacgttctcttttgggcccatgggctcacttctgtccaatggtggggtgcgtaacgtgagagaggctttaaagacttgttaccatccctacaaatcaccacatgatcattctccatgctttgtcctcacacgcattggtccgacaatcacttcccgggaggtcacccatcctgaactattcgagcccaagcatgcttaactgtggcgttctctcaggatgtttgaccgaaaagataagtgcactttgatgacataggtggccaaaccaattcctgaaaccggggtattacaattcaccgcattaacagattgttacgtgttcgttgtgcagtaagaacgtaacccccgatggtgcgagccttcttgactccacactcatttaggttcggctctgataccacttctaatgctctgaccaccactatttgtgggccccacgtaatctctggggccaatggatccacccctatccgacggtcggtgcaccatgcttgggaggctttaattacttgttactgaccctacaaatcaccaaatgagcttttcccatgctttgttctcactcgcatggttccgacaatcacttctcggaaggtcaccaatcttgaaactattccagtccaagcatgcttaactgtggaattctctcaagacctttgaccgaaaagataagtacattttggtgacataggtggccaaataaattatgttaaaacctctccgcatgcaccacaatattcctgaaatcggggtgttacaattcatccccactaacagatcgcaatgacctcgttgcgcaccaaggctataccccgatggtgcgagccttcttgactctacactcttatgggtttggctcagataccacttgtaacgtcccgactgcccctatcagtgggccctacgtcctctctcgggccaatgggcccacctctgtccaacagtcagtgcgtcacgtccaggaggctttaaagattattaccatctattcaagttatcacattttcttttcccattctttgtcctcactcacatggttccgacaatcacttctccgaaggtcacccatcctgaaactactcaaacccaagcacacttaactgtggagttctctcggagtgttacactagtaattaggaatattaattaattgataataattaatgcgaatgacattccttgtaaacaaaatccaacttgaggatttattttataaaagtgttgcaaaaatgtatatatagacgattaggtctttcttggtggctaaagaaaaattatttgcaactaattaaggataaaatcttttaaaaattgcacgatattagagagaaaagatttgaaatcattaagttttaagcaatatccgagtattttgttgttttatgagttataaataagtttctttaaattgtttcttttttggcaaatagtggagggaggaaatatcagattcaatgcggtgagttgttagtgaaaaataaatctcggaatctttaatataaaaagaaaataattgatttggatggaaaagagtcattaatttgtggcttaaaataattttgctagtgtagaattatcaaaatggtagtttggtagcaagtaaaggagataggagatctcagttgaaatatttgagaaattgttggttgtagttattatagagagatttatggaaatgttttgagttgttaatattatcaacaataaatttgtttttttgtaaaattgaattattaagagatttctagagtattaaatattaatagagagttttgtggaaagttttgttaaatgctaaatctttttttttctatttttaaacaaaatatgtaatgtcaatggcattgggttgtataagttcaaactttaggatttatttcataagagtgtttgaaaaatgtatatgtagatatttgctcaatgtattattattgttgtataaatttgtttttaaatgttatatttttttatatttgaatgtatttgaatttatatgaataaatttgtaataattaaatgtaatggaattatttgtaagatatattaagtttaaggaataaaatgaaatttagaaaagttttttagggtgtgaatagtgtactctcaaatttggatgtgcactaattaggatttgaaggtttgttggaattcaaaaaatcttcaaatttaaaaatctgaggccttgttggagatgttctaacacatgtttttttcaaacacacaaataaatttatacgtgttttttaaatgtcatgtgattttgtccacatttttaaatgtcatgtgatttctattataatatcaaatatgtaatgtatcatacaaaaaaacacatagcttaactataattttactaacactatttttttttgttatttgcctgtttggagtttacaatttgttaactactatcaattatactctcaaaaatattttaatgccccaatatacacggtgcattaacttatactttggataactctcacatgcgttctggacaagactaaataaaataataataatattaagataatttatacacggacaattttgttttttaaaagttagtttatattaaaatttgcaaattttctctattgaaaaaaaaattcttttaataattgacaattgttattaagtaacagtatacaatatgtctcgtaataattattaataaactgaagatttaagctgtattaaaacgaaatgttaataatatttcaaagttttataaacattgatccaaacccactgaccacatagtcccgtaccgaaatataacatgtcccataatttcttaatctatcccatgatttattttctaaaagtagtgatttttaaaatttaataattatttattatatataaaaatttacaaattttattattatatgagaaagttgtattttatagtttacaattggtattaagtaacatttcttttctaatctgattaatttgatatgtctaatattggtggtgttaaaaaaaaaaaaattaaagatttaatatgtattgaagcaacaaattaataatattttattaatgttgattcaaaaacccgacccgtcaaatccgtcccgccaaaaaaacatttattttattaatgttgatttatgatatgattctaaatcattgtctaaacattttagcccatatgggacattgaaccaacacattttggcaattgggtaatatatgtttgtttttaaaatttttaatcacaagatatgcaggaaataaaattgagatttgttttaactttatatattatacaatgatttaacagaaaaagtcaaataaagatgataggagattcatagtcttaaatcattaatcaaatcttctatatatctatattgttaatatgaaaacatccggtgtaagagatttaaaaacggatttagaatcaacttttattaaaaccgatccaactaaaaattaatgtacaaaattgctaaatagactggtaccaaattgactcacgaatgtatttttcccactcaaataaatccttacgttctcttttcctaatcaacagactcgactaatactccttaatgtatttttgtaagaatcaattatcgggttgaattttttccaaccagaaattacaaaagtctgaactgttatcctaccttattcttttaggcatttcccaaagaaacaaaatgttatttagcctcaattttcttttcctatgtttgtgagagatggtagtatagattaagatccagtgatgtcgatcaagagatgaatattgagatataaaccggttatctttggttacattggttaagtagaatccggtttaatgtacagactatatataagcttatgtgtatgattaagtttaattaagtttttgtaaactacagtttaagctgttaataaagagtttgttatcttttctgttctccgactatctgcgatcatcggacttcaacaatgaagatcacgaaacgaagatgaaggcactggaaacgagatggtggtgacgatgatgagatcgagtgataggatgaggggataatgagatccgatgacaaattttgtttagaatcatatatatgaaaggcagtgccgacttttgaagaagatgagtcggatccaacaggagaggagccatcaagtgaagagcctactacaccaccaacttcaccaacaagttctcaaatagaagaaagttcgagtgaaaggactccacattttagaagtatacaagagctctatgaggtaaccaaaaatcaagaaaaccttaccttattttgtttattaacggagtgcgaacccatggatttccaagaagccattgaaaagaagacttggaagaaatgccatggatgaagagatcagatcaatataaaagaatgacacatgtgagttaacttcacttccaaatgggcacaaggcaattggcgtgaagtgggtgtataaagcaaagaaaaactctaaaggagaagtggaaagatacaaagcaagattagttgcaaaaggttatagtcaaagaaccgaatcaactatgacaacgttagactaatcaatggatgtaatggttagactaatcatttcactagcggtgcaaaacaagtggaagatacatcaaatggatgtaaagtcggccttcttaaatggagatcttgaacaagaagtttatattgagctaccacaaggccacatagtcaaagttgaagaagacaaagtcttgaggctaaaaaaggcgctttatggattaaaacaagctccaagagcttggaatactcaaattaacaaatatttcaaggagaaagacttcatcaagtgtccataagagcatgcactctatatcaaattcaaaaagaagatatattgattgcatgcttatatgtagatgagttgatattcacaggtaacaatccaagcatgttcgaagaattcaagaaagagatgacggaggagttcgagatgacggacatcagattgatgtcttactaccttggaattgaagtaaaacaagaagagaatggaattttcattactcaagaaggcgatgctaaggaagcacttaaaaagtttaagatgaattactcaaacccggtgagcacaccaatggaatgcggaatcaaattatcaaaaaaagaaaaaggggaaggagtggatccaacaacctttaagagtttggttgggagcttgcgatacttaaaatgcacaaggccagatattttatatgcagtcggagatgttagtcgatacatgaaacattcaacaacaactcatttaacggcggcaaagaggattcttcgctatatcaaaggtaccataaagtttggcttacattattcaactactagtgattacaagctagttggatatagcaatagcgattggggtggcgacgtagatgaccgaatgagcacaagtggttttgtgttttacattaatgcagacacgactttcacatggatgtcgaagaagctattgtggaagatatggacctgttatgtaattagtgaattatcttggtatagttagataatttacatactttgtaattaggttaatgacttgtataaaaggcacagcctctgtatctaatcgaataagaaaaccttttacaccaatctagttttcttgacagaagcaaccaattgtcactttatccacttgtgaaacagagtaaggagcggcaacttcatgtgtgtgccatgctatttggttaagaaacttcatgaaggagttaagcttaccacaagaagatccaacgaagatatttgtggataataagtctgcaatagttttggcaaataatccgatctttcatgatcgaaataaacacattgacacacgctatcactacattagagagtgtgttagcaagaaggacgtgcaattggagtatggtaagacacatgatcaagtagccaatatttttaccaagcctctcaagcgtgaagactttatcaagatgaagagtttgcttggagtagcaaaatcatgtttaagagggggtgttgaaagttaaacttgattttgaatcaagtttaattattggatcaattatccaataatcaattatggccaaatccaagttctagagttttcactagaaatatcatcatctccacctccttaaaaggttttagaaattttctagtatcatcttccaccttcttaaacataaaaatctagatactcttatagagtaatctagataattagaataatgtaatctagatattatgtaagcactctctagacttaggattaaaatattttagatattttgttgtttggaggctataaattcctcctccccctctcaaatattgtaatgttgtgaagttgtcttcaagtttaaagcaaagtaataaaagttctatttcctaaaactctctctcaaaacagttaaacactttctccattacctctaaaagaattttactctaacaaagtggtatcagagcttaaagatcctaaagatggcgagtaacaatgttcccttccaagttctggtgctcacaaagagcaatttgagtctacaaatgaaggccatcctaggagcacatgacgtgtgggagataatcgagaaaggtttcattgaactagaaaatgaaggtagtctttctcaaactcaaaaggatggtttgagagactcaagaaagagagacaagaaagctctctgtctagtctatcaaggattagatagagatacgttcgagaaggtcgttgaagctacgtcggccaaagaagcatgggagaaatttctaagaataatcaaatagtgtggtctccttaatcaattcaaatggttaataatttccaatgaagctatccctagacaacatgttgaacaacagatcaattcactcccgtgattgaaatcctaagagaagactagacccatgacctaattcccattagcgtaatcaacctatgctggcaatatgaaccgactgttaaagtcaatcactagtcgaaatggccaatcccttgggattgagacgattattacttgaattagtagatcaaacattccattaaacaccacatgagtcctggaacgtttgggattggattccagttgatcagaaaggaatatacagtaaacacaactaatccggaagggattcaatcaacctacacttaaccatcagaatcgaccaggggtttcacaactactctatcccatccttagaaatcctaatcactactcagacaacatgctcaaagacaataacatagaaacgattgaagattgcataacttgaaagattaaaggaaataaaacagaaataaaaaaggaaatgaaagcaaatctgaataacttagaagcaaatcgagttacaaagttgcagaaataaaagtgtttaggcggctactaactagcaaagagtatatcgtgaatagtctgaatgggtgaatgtctcaggggaaacccttagagacttatttataacaaaaatgacaaagataagaaagcgggcttcaagtccacttaacatgtccatcgactatgtgatcgagtatgtgggctcaaagtgggcatcatggtcgagcgtgaatcccttctctcctcttttcttttctatgttcaggttgtctggttgattgcagaatgatcagagggttgaggtagtgattgagtaggttggttaatggcataatctgggctgcttcttctcttctgtgatcaggcctgactcacataggtatggcggaggtgcgaccgccaccagcccaaaaaaatgaaaggcccaaattgttttttttttgttaaattttctttacagctttatgtgtgataattttttttaggcttagttttatcttcttttctggtgaaaatgataactgaaaagataaataatactttttgctttactaatctctttcctctaacggtcacacgaaatcaattcctgaatatatatttatttatttttgctttctcgataaattcttaacataaaaaaaaaaagagaaccagaatcgtagctcaatcatcttgattcttgtgtctataaccgttaattgtaacttcgtaagttttgagtcaagccaaaaaacagaagttgaagtagatctaaatttggtctttcttcaaacacttagtatatatcttaatttattgtttaatcattttctttgattttggtgacatcaatttttgttaattgcaattgccaccgttcactgccacgaatttgttaatctaggtgctatctattaattattttgacttttgatcatggttttgtgtggaaataacaaactaaagaaaagaaaaagagatgcattatttattcaatctcaaagaggggttatggataaatttgttaaaaaacaaggtgataatgctagtgtttctcaacaaaccaaaaacgtgaatgatttaaatgatggttccagtaataatgttccaaatgcatttgaaagttttaatgttcatgagcaagaaaatatttccttataatgatcctaatagattgagtgagcatgataatgtgtcaaatgcatctttacatgaaagtttgaatggtcatgaacaacaaagatttcattttgatacttttggtcctagacattgggaaaatcttgataataaaacaagagatgagttagttgcatgtggacttaaaagagaattaaatttgactttcctcttgataaatattatagacatttctcatatcaatattattctagaaaattgagtaatggagaaacttgtgatagaaagtggttagtttgttcgaaacatgtgaataagtttattgtttttgttgcaagttgattaaatctcatggttactgataagtgtgtattttgcatgttttgagcatccatttgtcatcactttagcatcatatcatcactgttatataccatttctcatcatttgtcatcactttgcatgtttagaatagatttgcatgcatgttgcatatttgcgttgatttaaggtgatttggagctgttgacgagctatatggaagaagcggtcctgatcatgtcaaaccactcgaccccgaagtctagtagaagcttcaagatctcaacagatcactcaaccccctggtcgagtagaggacatcactacttgatcacatcactcgaccccgaggtcgagtgtcttcatcccatcacctgacaatcactcgatcacatcactcgaccccgaggccgagtgtcttcaccttcattgccagaacactactcgacctcttcactctacctggaagtcgagtatcaccatcaccaccactcgactgcatactcgatgacacgctttagagcctttttcattccgcactcaaccagacactcgagcacaagaaagaaaagaagactccagctattcactcgaccacccactcgaccacatgggtcgagtacatttcttaatccgtcccaatactgtgtcgttttaagtattagggtttcggaatatttggctataagtagcatgtacttcacattttcgcagacaagtttttttttgagcatgtcaatcaccggtaaactgaggaaacgaaactactcaattaccccatccgtgggaattctttatctgattgaattctttgtttactctactgttgtttactgcatcttgtcttctgttgcttagtttctgcaattctttactgttactcgacctgatactcgatcacccagttgtttggcaacaaacagtgcagtcgagtatccctgttatattttctgtctgttactcaacctgtcactcgacctcacccagtgctctgcaaagagctgtgttggtcaagtgttttattgtttctgtttgaatttctgttttctgcatgttcacttagaactgctagaacacaccaaaacctgttattgcttggcttgacttagtgacttctgatcacatcttgattgttagcatcacacccatttggattgacaacctaaaatactacaacgatataattggtgttttaggataattgactaaaaacctattatcaatttggcgccgttgccaattgggtgtttgtttgttacatttgagatttcagacttgcttagatcaagttctttttcaattttcttttcggttactaactgtgtgtttttcttgttgtcttcttgatcccggtacacctcgactgtatgcgaacttgatctgctgataagaggattgttcaagagaagttagaagatccgggatctttctctctaccatgttccattggggaatttgctttcagcgattgtctgtgcaatctcggagcctctgtcagcttgatgccactctctgtggcaagaaggttagagttcattcagtataaaccttgtgacctgactttgatccttgcggataggtcttctagaaaaccctttggcatgctgaaagatctaccagtcatgattaatggagtagaagtgcctacagacttcgtggtgctggatatggaagtagagcataaggatcccttaatactgggaagaccattcttagcttcagtgggagcagtgatagatgtcatggaagggaaaataagtctcaaccttggaaagcatatcaagttgcagtttggcatcaacaaaactccacaagggtcaacagaagatggaaaaaacctctggaaatgatagagtgatctcaggagaaggatatgagacttacagagtgaaagaacttaaaaagaggtctgataagcaagatgaaactatagagcaggtagcccacactgttgaggaacttagaagtaagctgaatcagtagcagaaggtagctcaacctaaaggcgggatcgacaatatcccgagaaagaagttcacttcaagatggtctgaagcgatagattaccctccagaagagaaagaagcatattttgaagagaggggaattgagtattctgctgcagacctctccagggaggacgctgactatgatgatggtatcagagaggattatgcagactctctatacagttcattttcttcttgataagtgtgaggagtcaagctagagacttaaaacaagttcactatggaggaagtcccatgattatccttgtaaataatttttactttcttgttaattttgatttgttgtgtttgtggttctcagaaaaaaaaaaaaatgagtaacgtgaagttagagtaataattttaaacttttactctattgatggcctagagatcgagtacattggtcgagtatgagtgatgtttaaaacccaaaaaattttaaatcatcgttttactcgaccaacagaagctacagggtcttccaaggagtttatcaagtttacagaagattgtgggatttcctggaggttttctagtgaaaagagaagagacaagaagacattgtgggatccgccgctgacgcccatgtcctccatgcaacagaccaacggacaaggaatcccccctcatctcttctcctccactcgacgtctaccacatcactcgacctccatccctctctactcgaccttatcacctcgtcatctcctccatcactcgacttcagcgccatcatcatccgtccaaagcaccactcgacctcaccatctcttttcctcaggcactcaaccgcttctctctcgcctttcacagccaccgctcccatcgcctcttcaccaccgtctcgagctaccactcgaccattcctcaccaccaccacctctcaatcgtcttaaagcactcgacctcttcaccacttgaccaagcagtcgtttctcctcttcaaggaagacactcgaccaccgcttctctcatctctccaatcacaacatcattcaccactcgaccttgcctcccgcttcaccatctccacatcagctcttgttctacgtttactcgaccactacacagccttctctagctcacaactccactagtcttcaccgaaaccactcgacttcacgcgaagagcacctccgcttctcccccgccttcatttcaaagttcactcgaccgctcctctatttccacggtcaaaccgcagctgttctcctcctcttcaagctcaccactcgaccgccgcctcactctaaccacgaaacaagcttcactcgaccaaacaaaatcactcgatcaaccgaaagaaaagaaaaaaaaaattcaaaaccaaaggtttactcgactacgtcactcgaccggttcacttgattggtttgtgtttttggtttgttgttactaacgtattaacgtttatttttgagtttcttctgttttcaggtttcatcatgagtaactacagtggagaatcctctaaggaccctgattacaatgtggatgaagctgagtcctggtccgctagaccgagagagcaacatgtttaccaaagcttcagggatgaattcgaacgctctgcagcccgacgtaatcagagaagagctgaaatcgccagaggaaagagggcgatgtcgagtagatatgagctgattgatgaggactgatatgtctataatttgcatgttttcagtgtccattcatcatcgttttgagtccagtttcgtatcattcatcactgttttatatcatttctcatcattcttgcatactttgcatgattaggatagctttgcatacatattgcatttctgagttgttttcaggtgatttggagctgtttgcgagcaaattggaagaaacgagccagaaccagaagacatactcgaccactaggtcgtgtgcatctagcaccatactcgacccccaagtcgagtaactttggagccattcttcccacctactcgaccccctggtcgagtatccccagctcaggccactcgatgacgccactcgaccccctggtcgagtatcacttcgccacaccacctgaccacactcgacaattcactctaccaagttactcgaccccctggtcgagtatcatcactcaccaccatcaccatcactcgaccggacactcgatcacgtcttcacagtctactcaaatccgcactcaaccaaacaagctgagcacaaggaagagaagaggagaagacaaagtgtttggaagcggcttggacctccatctgatcacgaagcccatctcggcccaatatcattctatgggccgggcgattaggttattggcccgtctactatactgagacatctagtcgacattgagtttttgcttcagttttattttcagttttactctgctacgccgcttttgcttctgcaacctgtaattcgagatttttctaagttatttagattccgcatttgatttcatatgtcatcttgtttctctactctttatctctttacttatgcaatattatcatttatctgcgtttatgtctttgagcatgttgtatgagtagtgacttagaattcttagggttgggatagagtaattgtggaatccgtagtctgtagaatggttaagttttagaattgattgaatcccttcaggactagttgcgtttactgcttatttctttctgatcaactggaattcgatctcaagcattcccgcacccagaaggtgttcgatggaatgcttgatccactagttcctgagatattcgtctctatcccaagggattggcggtttagagcggttattgactttatcagtctgttcttattgcctgcatagttagattccgttaatgggaattagtctgggctagctttgcttgaggatttctatcacgggagtgaattgatctgttgttgaacctgttgtctagggatagcttgattgcgcttgttaaccattccgataggctaggataccactctattcgattgccccatccttaggaatttctcgtctatctgatttctctgttttatcgttatcgcttattcgttctcattgcctgtttcttcgtttttgcaattactcgaccaacttactcgaccacacccagtgtctggcaacagactgtgcagtcgagtacagttgtctcgtttcctgtctgttactcgaccacacccagtgtctggcaacagactgtgcaatcgagtatatctgtttcatatcctgtctgttactcgacctgttactcgaccatatcctacttctggcatcagcctgttgtggtcgagtgattttagtaattctgttattgtttctgttttctgcatgttcgcttaggactgttagaaaccccaaaactgttattgcttggcttgacttagtgacttctgatcacatctcatctgtttgcatcacacccatttggattgacacctaaaatactacaacgacatgattggtgttttaggataattgactaaaaacctattatcaaggacatagaaactgagtatgagccagagtcatggcttaaggagacaaagctgatgaacaaacccgacgaggttacagtggaggagtatatcagattctttgagatgaatgacttctggggaacgaggtatccgtgctatgagaatttagcccagttggggttactggaggacgtgcagcatctgttcgagaagtgtcatctggagacactcatgtcttacccttaccttgcctatagggaagagacaatcgagtttcttttcacgctgcaagtggagatgtataaggcactcacaaacttttagctggataccatggggttaggcttcttgacgttctcagtgaatgaacagcggtatcagctttcgatcaacaagttggaagaactgtttggtttccctagtggaaagggaaccaaacccagatttgacagagaaaagcttaaggatttgtgggccattatagggaacatctaccgctaaactcggtgtggtccaagagcaaccaaatccggagtcctgtgatctgctactttcagagattggttgccaacgtcttttactccagggagtctacaggcaccgtgtctaacacggacatggagatgatagattatgcgcttacagggattctccgccggacgaagggaaagaatgtcttgagaggcgatctcaacaacgcaccaccagtaatgcctctgttgatccatctgtgtggatacaggaagtgggcgttgacgaacggaaagaagaaggtgagaggagcacaatgcgtgggtggcgttgtgacgccaattctcgaagcttgtggagtaccgctcaaggaaccagggttagcaccgaggatgatggacttggatcatttgcgcagatgtgagttcttggagtttgacatggctggcaactttcaccgctacaggttcgagcattcatcgattagaatcgccatcattcttctcccctgcattaacgctactaggattctcgagggcaggaacattgacttcaagcctgcgcttgaagatctttatttcgagggtagttcaccaactgaggagatcagtcataccgaaggagctacaacagaagatgttgataagacggatgatatagatgaggcggagtttgacacgagcatgtatcatttcagtgagcatatacctcctgcgaggaaaagcaagagtttgagcgaagctcacaggaacacagcaagctgcagaagtggtgcaagaaacatgataagttactcgccaagtgcctcagggctatcaagtttctgaaggacaagatcagctgctcctcttccactacagctatcccgcagggacatcttcctcaggacatgccttcgaggagatatgatgcgcccgagccaagtcagcgcaggcctgagcctagagagcaggagattccgcatgtccctgcgaggcattcatcattcgagcctcgtgaatctgggaggaagaggaggaccacactcactcgatctagaagtaggagcagacgacttctgcagtctcgtagtttacgcgaccgcgatgctggccgcagccgaaggagagaggtcgagtatcctcagagcggtactggcggccacaaagctgatgaggtcgagtacccacctgctggagctgatacggaacaaggcggttcgtccatggcctgggagcaaacacagacagccattgacgagcaactacgttcattcttcgactgaggtaagcgcctcacttcaccattgtattatatcatctgttgtgatttgtttcttcattttttgttacggtgattggatttgtcctgagtactctcttccaagtttattcacatagtggactgtgtgatttaagtttggggaagggctcaggaagtgtgtgttgcattgtatatatttttgagtctgcattcatctaaggcataggaaaaccaaaaattttgaaaaatttcagaaaatgatttcacaaaaaaaaagagtgttcatgtagttgcattacatgtaggatcgagtctagagtgtttcgtttaggattgttgcatatgcataggggataatgatgagatagccttgtaagcattttggttcaccaaataagctcagtgccctcgttgtcagttgtttgatgcgtagtcattgaaattgcagtaaaactgcaccatgcctagattgctctgctcgaccacactgtcatgatgtgataccattccctatcaatttgaacctgaatctgatctttaattatcatgtctgcatcaaatttgaactcatggataccctaaaatacttggattttcttattcattttgatcactcttgttaatacaagtagctgactctccttattagagcagttaacccgaacccaaacctagactttctttcaagccctatatcacttgtgagtgtttgtgaggtcttattccgattaagcttggtagaaagtgttaggttcgtaatgatagagatagtgtctcatgtagttctagttcgcatttttcggactagataggactaggtgggcgcttatactttgggttgggatgtgttaaaaagaaaaaaggggttgattcattgatgagaaaaggcaaaggactctaggtgagtaagctaaagaagcagaaaaagtctagtaaaggttttgagatttgtaaagaaaagaaagagttcttgttagctatttgagatgggcaaaagcccttggttttaaaatgttaaaaacaggaaccttagtagttaaagaaatccaaatccgctagatgtaacaaattgttgagaaagcttctcctagagttaagagaaaagaaaagaatgattagaacaagggtttaaaagattcatgaatgcaaagggtagagttaagttcttatgttgggattggagatgggattaccattagagcttcatttgatatactctgggtagatgggatcttatctctgtatgcatagcttgggacttacctttagcattctactaaagcttaatcatttttcttgagagatcccctgttactgaagcctattctgtaagggaccatctttgtttcttgaccttttaccttagccaaatgagttcattgatgatgcatttcttgattcacgttccagaactaataaatgttatagggattggtagatttgaaaatatgtgtaggtcgagcatatgagtcagattgattgataatgaggcatggctaacgtttttaagtagaattcgatcttgcagcttagaactttcaacttggacattgatttcatctggtctatctggtgctttggctctaagtccccgctttcaaacctcacctccagcttgttcttgattgtttgcttgagggcaagcaaagactaagtttgggggagttgataagtgtgtattttgcatgttttgagcatccatttgtcatcactgttttataccatttctcatcatttgtcatcactttacatgtttaggatagatttgcatgcatgttgcatatttgcgttgatttcatgtgatttggagctgttgacgagctatctggaagaagcgggcctgatcatgtcaaaccactcgaccccgaggtcgagtagaagcttcaagatctcaatagatcactcgaccccctggtcgagtagaggacatcactacttgatcacatcactcgaccccgaggtcgagtgtcttcatcccatcacctgacaataactcgatcacatcactccaccccgaggccgagtgtcttcaccttcattgccagaacactactcgacctcttcactctacctggaagtcgagtatcaccatcaccaccactcgactgcatactcgatgacaagcttcagagccttcttcattccggactcaaccagacactcgagcacaaggaagaaaagaagactccagttattcactcgaccacccactcaaccacatgggtcgagtacagttcttaatccgtcctaatactgcgtcgttttaagtattagggtttcagaatatttggctataagtagcatgtacttcacattttcgcagacaagtttttatctagttttatttccgcagaccttatgttctagaccttttgtaatccagatttctctttatctattcagtattcagtattcagcttttgttcttgatttcgtttactgttgttcattctgttatcatcctgctgttacactgttgttatcatgttttcatcttgttcaacgtttttgttctccgcaatgatgtctgagtagtgaataggtttctgaggatgggttagagtagtgtagaattctcagtatgctaggtgattgagtattgattgatagatcccttctggattagttattcttaatgcctattgctttctgatcaaccagaatttgagcccagacatttccgcgcccaaaaggtgttcgatgaaatgtctgaaccaataattccagagattcgtgaccatgtaccaaggtattggttgcagggagcgttttggctttaacttgttgattcgtaatgcctgttaggttagctctcgtcaatggtgattgagtctgggactaggttaacttgagagtctctgttgcggtggcacttagatttggttaatgaacttgttgtctagggttaatttattgagcatgtcaatcacctgtaaactgaggaaacgaaactactcaattaaaccatcctcgggaattctttatctgattgaattctttgtttactctactgttgtttactgcatcttgtcatctgttgcttagtttctgcaattctttactgttactcgacctgatactcgaccacccagttgtctggcaacagactgtgcagtcgagtatccctgttatattttctgtctattactcgacctgtcactcgacctcacccagtgctttgcaaagagctgtgttggtcgagtgttttattgtttctgcttgaatttttgtttactacatgttcacttagaactgctagaacacaccaaaacctgttattgcttggcttgacttagtgacttctgatcacatcttgattgttagcatcacacccatttggattgacaacctaaaatattacaacgatatgattggtgttttaggataattgactaaaaacctattatcagttatttaagtgtgctagcaaatgatggttaaatgattggaaacatcttagcgagagacttcaaaagcatgagagaagtgtagaacatatggcttacatgaaaacttggaatgaaatgctagttagattagagacaagtcaaactattgataaagaattacaaagagaagttagagaagggaaagaaaggtggagacttgttttgattagaattattacggttctgaagtatcttgctaaacaaaatttagctttttgtgggtcaaatgagaaactttaccaagatagtaatggtaatttcttaggtatgattgaatccatagccgaatatgatgtaacaatgcaagatcacattaggcacattcatactcgtgaaatacatcatcattatcttggtcataatattcaaaatgaattgatatctttttttgctcataaagttcaattttctattaagaatatcataagagaggccaaatatttctctatcaatcttgattgtaccccggatgtaagccatcaagaacagatgactttaatagtacgatgcgtaagaatggtagatagaaaagtgaaagtagaagagtactttttcgagtttcttatcgtagatgatacatccagattaggtttttttgaaagaataattgatgcgctaaaatctttagatcttgatgttagaaatgtgagacgtcacacaaggttatgataatgggtctgatatgaaaaaaaagcatcaagggtttcaaaagagattgtttgacattaactcaaaagcattatatatgccttgtgcttgtcatagtttaaatcttgtagtaagtgatatggttcattcctgtgtgaaagctatttttttttttttgtagcattacaacgaatatatgtattatattctaactctacaaaaaggtggaaaattttgcttgatcatgttccttacttaattatgaaatcattttctaatactcgatgggaaagtcgaagaaaaagtgtgaaagttattagattataagctcctcaagtgagattagctttaattaatctatatgaatcatgtggtgataacaaaaagtcaaacggaaagttgagtgaattcacttgagaattatgagtttttacttggtatgactacaatccaactctatgtatatatgcaagagcttacaatccaaatcatcaaagtcataaacaaggtaagcaagagcttacaatccaaatctatatgcattgatagtgctgtaaaacaattagaaggtataatcttatattttgaagattatagagatgaagggtttagtgcttctttgaaagtagctcaaggtctcgcccatgatatgaatgttaatcctatatttccatgtaggggtcgtgtctttagaaaaaatcactttgatgagaatattcatgatgaaaaaacattatcggttgaagatggttttagagtcaattatttccttgttgttgcggatatggcaatttcttcggtaaaggatagatttgaacaaatgatgacttttaaaagtgtatttggatttttgtttgattcattgaaattaaaattacttgatgaaagtgaattaaaaagggggattgacacaaatagcactaaaaaactttattattccaaaaatagcacattcttttgaaacttccaaaaatagcatataaagtttttaatcctctataaaataattaaataataaagttttttattatcatttgtatcaatctcccaaataaaaatgagagcaaacactaatctaatattaaattgaatcaaaaaacttttaaatagtgaaaatatataccctacattggaaaaaaaaaacaaatataatactacaaactaattttaaaatgaaaaatctcttctaaatggtgaaaatatataccctaaattggaaataggaaaccccaataaaatatcataaactaatattaaaatgaatcaaaatttcttttaaatagttgaaatatatgccctaaattggaaatagagaacccaaatataacattttaaatttatttctcatttcttttggttgaatagatttaatataaaattgtggttttattattgtcacttttaaaatttctcaaataattatttgagtgctatttatgtctaaaaaactttgtaatgctatttttgtccaaaaaacttaaaagtgtgctatttgtgggaatttctcttcttttaaatagttgaaatatataccctaaattggaaacagagaacccaaatataatattttaaatttatttctaatttattttggtcgatatgattttatataaaaaaattgtgctattattattgtccataaaaatttttttagtgttacttttaggaatttctcaaataattattaaagtgctatttatgtcttaaaaaaattttaatgcttttttgtccaaaaaacttaaaagtgtgctatttgtgggaatttctcgattaaaaaagcattgcattatttttcacaaaacattttctcatgagaatgtctcggatgttgatttaaatgatctcttttggaattaaaagttttgcaaaggactttatctcaagtgtcaatgacacctagtgaagtgcttgagtttgtagaaaatgtaggttgttatgccagtgtttcaatcgcttatcgaatcctattaacaacacccatgacggtggctttggccgagagaagcttcttaaaattgaagttattaaacaattaaataaggtcctctatgtctcaacaaaggttgaatggtctagctattctgtgtattgaaaaagttggttagaaagcatagactttgacactgtcattcatgactttgcgtcggctagagctcgtcaaaagcgtttctttatttcgaaataactattgtgttttgttttgttgttttagatccaacggaagatgaatgcttgagatatgaagcaatttaaagtaatgtggtattgctagatgaagacatgaagctaaagacatgattatatgtaatggtttttgttttaacatgcttgaaaagactcctttttgtaagtcgccctaatgcttctcgattgtttgagtcggggctgcttgtgatctagtatgttggagaagtgtaacgatggactgcttcttggccttcgtgattgagtagaactcgtctggatgacctgttgagctgatcacttctctctatgctactagtgatcgagtagattggccaaaatgtgactttcagctctgcttttcctcttttgaacaccaataactccaaaagacctgaaacaactcgagaatggaaaatgcatgcaagactagtgctagactcacctaaacatggaaattgtacaaaatgatgatgaatgctatgaaagattaatgatactagactcaaaatggtgataaaatgatgtgtaaatcatgaatattttagacatatcaactcccgcaaacttagtctatgggcttaaaagattaatgaatgcaaagggtagagttaagttgtagtattttaggttgtcaatccaaatgggtgtgatgctaacaatcaagatgtgatatgaagtcaataagtcaagccaagcaataggtctttagtcaattaacgtaaaacaccaatcatatcgttgtagtattttaggttgtcaatccaaatgggtgtaatgctaacaatcaagatgtgatcagaagtcactaagtcaagccaagcaataacaggttttggtgtgttctagcagtcctaagtgaacatgtagaaagcagaaaatcaagcagaaacaaataaacactcgaccaacacagctctttgcagagcactgggtgtggtcgagtgacaggtcgagtgacaggttgagtaacagacagtaagtataacacagatactcgactgcacagtctgttgtcagataactgggtggtcgagtatcagtaaagaattgcagaaactaagcaacaggtaacaagatgcattaaacaacaacaaagtaaacaataaaatcaatcagataaagaattcccgaggatggggtaattgagtagtttcgtttcctcagtttacaggtgattgacatgctcaataaattatccttagacaacaagttcattaaccaaatctaagtgccaccgcaaaagagaccctcaagttaacctagtcccagactcaatcaccattgacgagagctaacctaacaggcattacgaatcaacaagttaaagccaaaacgctccctgcaagcaataccttggtatagggccacaaatctctagaattagtggttcagacatttcatcgaacaccttttgggcgcggaaatgtctgggctcaaattcaagttgatcagaaagcaataggcattaagaacaactaatccaaaagggatctatcaatcaatactcaaccacctagcatactgagaattctacactagtctaacccatcctcagaaatctattcactactcagacatcattgtagagaacaaaaacgttgaacaggttgaaaacataataacaacagtgtaacagcaggatgatagcaagatgaacaacagtaaacaaaaatcaagaacaaatactgaatacaaaatagataaagagatatccggattaaaaaaggtctagaacatagtgtctacggaataaaactagataaaaacttgtcctcgaaaatgtaaagtacatgctacttatagcaaaatattctgaaaccctaatactcaaaacgactcagtattgggacggattaagaactgtactcgacccaggtggtcgagtgtgtggtcgagtgaatagctggagtcttcttttcttccttgtgcttgagtgtctggttgagtgcggaatggagaagactctgaagctcgccatcgagtatgtagtcgagtggtggtgatggtgatactcgacttccaggtagagtggtgtgatcgagtgatgatcaggtaatggaggtgaagacactcgacctcggggtcgagtgaagtgaacgagtgattgttaggtggtagaggtgaagacactcgaccagggggacgagtgatgagatgaaatcgagaagtcccctactcgacctgggggtcgagtggtctttgaaggtcttgaagcttctactcgaccttggggtcgagtggtttgacatgatcaagtctgcttggtttgacatgatcaagtccgcttcttccaattagctcgtcaacaactccaaatcacctgaaatcaacacaaatatgcaacatgaatgcaaaactatcctaaacatacaaagtgatgacaaatgatgagaaatgatataaaacagtgatgatatgaggctaaagtgatgacaaatggatgctcaaaacatgcaaaatacacacttatcaactcccccaaacttagtctttgcttgccttcaagcaaacaattaagaacaagctggaggtgaggtttgaaagcggggactcagagccaaagcaccagataaaccagatgaaatcaatgtccaagttgaaagttctaagctgcaatatgatcgaattctactcaaaaacgttagccatgccttattatcaatcaatccgactcatatgctcgacctacacatgttttcaaatctaccaatccccttaacattcatttgttctagaacgtgaatcaagcaatgcatcatcaatgaactcatttggctaaggtaaaaggtcaagagacaaagatggtcccttatagaataggcttcagtaacaggggatctctcaaaaaatgattaagctttagtagaatgctataggtaagtcccaacctatgcatacagagataaggtcccatctacccagagtatatcaaatgaagctctaacggtaatcccatctccaatcccaatataagaacttaactctaccatttgcattcatgaatcttataacccctttttctaatcattcttttattttctcttaactctaggagaagctttctaaacactttgatacatctagcggatttggatttctttaacaactaaggttcctgtttttaacattttaaaaccgagggcttttgcccatcttcaatagctaacaagaactctttcttttctttacaaatcgcaaaccttttactagactttttctgtttctttagcttacttcacctggagtctttaaccttttcttatcaatgaatcaaccccttttcttcttttaaacacatcccaacccaaagtacaagcgcccacctagtcctatctagtccggaaaatgagaactagaactacatgagacactatctctgtcgttacgaacctaacactttctaccaagcttaatctgaataagacctcacaaacactcacaagtgatataaggcttgaaaaaaagtctaggtttgggttcgggttaattgctctaataaggagagtcaactcttggattaacaagagtgatcaaaatgaataagaaaatccaagtattttggggtatccatgagttcaaatttgatgcagacatgataattaaagatcagattcaggttcaaattgatagggaatagtatcagatcatgatagtgtggttgagtagagtaatctaggcatggttcagttttatttcaaattcattgactatgcaacagacaactagcaacgagggcactgagtttatctggtgaaccaaaatgcttacaagactatctcatcattatcccctatgcatatgtaacaatcctaaatgaaacaatctagactcgatcctaattgtaatgcaactacatgaacactctttttttgtgaaatcattttctgaaaattttcaatttttttttttggtttttctatgcctgagatgaatgcagactcaaaaatatacccaatgcaacacaaacttcctgagccctcccccaaacttaaatcacacagtccactgtgtgaataaacttggaagaaagtactcaggacaaatccaatcacagaaacaaaatgaagaacaactcacaagagatgatataatacaatgatgaagtgaggcgcttacctcagtcgaagaatgaacgaagttgtttgtcaatggctgcctgtgattgctcccaggccatagactaaccgccttgttccgtatcagcaccaccaggagggtactcgacctcatcagctctgtggcggcaagcactgccctgaggatactcgaactcccttcatttgctgtggccagcaccgcgttcgagtgatctacgagactgcagaagtcgtctgctcctgctgctagattgagtgagtgtggtcctcctcttccttccagattcacgaggctcgaatgatgaatgcctcgcagggacatgcggaatctcctgctctctaggcttaggcctgcgccgacttggctcgggcgcgtcatatctcctcgaaggcatgtcctgagggagctgtccctgcggaatagctgtagtggaggaggaacaactcagcttatctgtcagaaacttgatagtcttgaaacacttggcgagcagcttgtcctgctttttgcaccacttctgcagtttactattgttcctatgagcttcactcaagctcttgctttccctcgatggaggtatatgctcgctgaaatgatacatgctcgtgtcaaactccgcctcatctatatcatctgtctcatcaacatcttctattgtagctccttcggtgtgactaacctcctcagttggcggactgccctcgaaataaagatcttcaagcgcaagcttgaagtcaatgttccttccctcgagaatcccagtagcgtcaatgcaggggagaagaatgttggcgattctaaacgatgaatgctcgaaccatgtcaaactccaagaattcacatcggcgcaaatgatccaagtccatcatcctcggtgctaaccctggttccttgagcggtactcctctctatcaaatctgggtttggttctctttccactagggaaaccaaacagttcttccaacttcttgatcgaaagctgataccgctgttcatccactgcgaacgccaagaaccctaaccccatggtatccagctcaaagtctgtgagtccctcatacatctccacttgcagcgtggaaagaaactcgattgtctcctccttatagacagcgtaagggtaagacatgagtgtctccagatgacacttctcgaacagatgctgcacgtcctccagtaacccgagctgggctaaagtctcataataaagatacctcgttccctagaagtcattcatctcaaagaatctgatatactcctccactgtaacctcatcgggtttgttcaacagcctcgtttccttgcgccatgactctggctcatactcagtttcgatatccttatcagtcagctcatatctactcgacatcgccctcttttctctggcgatttcagctcttctctgattacgtcgagctgcggagcgttcaaattcatccctaaagctctcgtaaacatgttgctccctcggtctagcggaacaggactcagcttcatccacattataatcagggtccatagaagattctccactgtagttactcatgatgaaacctgaaaacagatgaaactcaaagataaacgttaatgcgttagtaacagcaaaaccaaaagcacaaccaaaaccactgtaccggtcgagtgttgaatgtgtagaaggaaacaaggtcgagtggcgttgatggagcttcactcctcttctctttgactcggcaatcgagtgagattttaaatggcgatggtggagcgagacgcacggtggtcgagtatggtaggtgatgaagatggtgaagagagatcgagtgattgtgagaggcgagggagacgaggtcaagtgagtgaaatggagagctggagttgttcctttggagagagtgagcaggcggtgacgatggagaggcggtgagaagcggcgaggtcgagtgttatctttggagatagagtgggtaaggttaagatggagtggcgacgaagaagatggttatgaggagtcgagtgaagttgttgtggtcgagtataagaagaagatggcgaggagctcgagtgtttgagagtgatgagagatgagtggtcgagtttatatgtgtggggagtaatgggaatttcttggttgcatgtgaagtgttggtgagagggatggggtcaagtttattgggttatggaggagaaaacgagatcgagtgatggaggagaagtcgagtgaagatggggttgcgtggagatcgtgtggatgtgaagagattccatgtctcttggtctgctgcatggaggacatgggcgtcagtggtgggttccactgtgtcttcttgtctttcttctgtgctctctgtttactgtacaaacccgaggaaatctcgcaatcttctgtaaacttgataaactctctataagactctgtagcttctattggtcgtgtaaaatgatgatttaaatttttttaggtttttaaacatcactcatactcgaccactgtactcgatctctacgccatttgtagagtaaaagttttgaattttcactctagcttcacgttattcctctattcctgagaaccacaaacacaactaaaacatatcaaaaataacaagaaagtaaaaattatttacaaggataatcatgggacttcctcccaagtgagcttgtttaaagtctccagcttgactcctcacacttataaagaagaaaatgaatgatagagagggtctgcatagtcctctctagtatcatcatcatactcagcgttctccctggagaggtctgctgcagaatactcaattcccctctcttcaaaatatgcttctttctcttctggagggtaatctatctcttcagaccatcttgaagtgaacttctttctcgggataatgtcaatcccgcctttaggttgagcttccttctgcaactgattcagcttacttctaagttcctcaacagtgtgggctagcttctctatagtttcatcttgcttatcagacctctttttaagttctttcactctttcagtctcatttccttctcctcagatcgctttattatttccagaggttctgtgagaccccgtcccaggacgcggtcgttacaggttctttcatcttctgttgacccttgtagagttttattgatgccaaactgcaacttgatatgctttccaaagttgagacttattttcccttccctgacatctatcactgctcccactgaagctaagaagggtcttcccagtattaagggatccttatgctctacttccatatctagcaccacgaagtctgtaggcacttctactccattaatcatgactagtagatctttcagcatgccaaagggttttctggaagacctatccacaaggatcaaagtcaggtcgcaaggtttatactgaataaactctaaccttctcgccacagagagtggcattaagcttatagaggctccgagattgcacagacaatcgctgaaagctaatttcccaatggaacatggtagaatgaaagatccaggatcttctaactttccttgaacaatcctcttatcaggagctcgagatggagtcgcatcactttcatcatccacgctttcctgaatgtccactgaagagcacgtgagggtagtggagtaggtttgaatcgtttcaccattctctcgattatggcgtccttctcttccgaggtggattgaatgagatggcgagaaccagcagaatggttgaattcaacaatagagacttcaatctgagtagaagcctctccttcttgaacatcaatgtccccagtgattaaatcaaggacaggtcgagttggcagctctcgatcatgacagatggtgatggcgtgagtagttgcatactcctttggattctgtcttgactttaggtgcagaggtagatgttgattgtccttccaaatatctgactttggtattcaatgcctccactttggcattcaggtcattgtagctgcactccagcttatggtgcaattcagataatttcttaacaattttcattgagctatatgcttatccctgtagcagctgttgtaccatctgtttcatttcagcatcatgagcaacaggaccttggttttgctgaggtgcaaacccaggtggtggtggctactggtagttcctctagaattgctgcttgggaacgaaaccttggttgtagggaacaaaattctgaccttgttgttgctgtggaggatacatctgatcctgaggattagcaacgttggtgctgcggtaggagaagttggggttgttggttttgaagttgttatatcctttgtagccaccctggttgttaccctccccatcttggacttgaaactgctcgtcatcaataaggaagtgcacatgcttctgctggctaagaagaatcttgtccagcttgtcattcagcgctttgatctccttcatgtgtttgtcatcagagtcaggtgtgcctctgacggtcctatcgcagtcctcgttgtaattaccatctcattgagcaaggttcttaaccaatttccagccttcttcaacatctttgttctggaaatttccattgctgacggtatctagaagcattcagatgcgtggtaggattcctctgtaaagattgctgagcatagaggctttagtgaagccatgatgagggcattggttggtgtaacccttgaaatgctcccatgcttcacaatagctttcaccagccttctgtaaaaaaacagagatctcatttctgagtcttgcagttctggcgttggagaagaactttgatagaaaagccttcttgcaatcatcgcaggtggtgattgagtcatggggcagattcttctcccagatgtgtgctttttcgcccaaggagaatggaaacaaacggagcttgaatccatcttcactgacaccattgatctttgttaggttgcagagcctatcgaattcatcaaggtggtcgagtggatcctccattggcagaccatggaatttgttcccctgaatcatcgagatgagaccactcttaatctcgaagttattgttctggatagcatgaggtacaatctagacggatctcatcaaagatcattcagttgtatcaatctcttctccttagcaatcttgatgtcgaaattcaaaagtttaaccgcccacatagctttgtactcaagtttaacaggcaggtgacataaggaagatagaacggagttgtgccaatgggggttttataagctattttgtaagcctatactacattattgagttttgttgaccaatctttccttatgatcccacagtctgctttagaattgattttatctccctgttggtgattttcacatgcccatgtgtctgtgggtggtaaggggtggcgaccttgtgcttcactccctgcattctcagtaggttttaaaaaaccttattgatgaagtgcgtccctccatcagtaatgaccactctaggaactccaaatctagggaagatgatggtctagaacagcttcaggacgactcttgcatcattcgtgggactggctatcgcttccacccactttgacacatagtctactgctaccagtacgtacttgtttccataggaagatggaaacggtcccataaaatctattccccacacatcaaagatctcaacatccaagattgggttctaaggcatctcatttcttctgttgatgttaccccttctctaacacgaatcacactttgatatgaactcctaagcatccttaaaattgttggccaccaaaaaaacctgcttgcaagattttagacactgtcttaaaggtagcaaagtgacatccatagttggaaccatgtagtgtagcaagattccctcttcttcatcatctgagacacatctcatgtagatcttatccttgcaaagagtatagacgtaagactcatcctagtagaagtgatttatgtctctgaataacttcttcttttcatagcttgtcaagttcggaggctcttcaccacataccatataattgacataatcgacgtaccacataaatgtttcctctactaccagtacttcctctagagactgcatggttttggtatccttgttcgcatatatatgcctcagagcggcatgatcgatgtagactatcacctttaagcctgccaggtagcttctaaatttttcgaatgcgaatactacaaccagtagttcctttctcagtagtggcatacctcccttgtgcatcgccaataattctgctagcatagtagatgaaatgtagattcttatcaatcttctacccacgaactgctcctatagcgtagtctgaagcatcacacagtatctcaaatggatagtcctagttaagaacttgaactattggagtagagacaaaagcttccttgatcaacttaaaggttgttagacattcttcatcaaataagaactctgcttatttgcacagcagcgtagtgagctgtctagccagcttggagaaggctttgatgaatctcctgtaaaatctcgcatgctcgagaaaactcatgatgtccttcacaatctttagtggctgcaactctatcataacatctaccttagccttatcaacttctactcccttttctgagattttgtgccccaagacaattccttccctgaccatgaagtgacatttcttccagttcaataccaaattagtttcctcacatctcttgagtaccctgcacaagtttaacaaacatgaggagaaggaagagccatgcaaggaaaaatcatccatgaagacctcaactgtctcctctatcaaatcggagaaaataatagtcatacactgctgaaaagtagcaggtgcgttgcaaagcccaaaaggcatttgcttgtaagcaaagatcccataaggacatgtaaaggtggctttctcttgatcgtttgggtggatagggatttgaaagaatctgttggaaccatctagaaaacaatagtaggggtggtttgttgatctctttagcatttggtcaatgatgggtaatgggaagtggtctttcttagaggctgcatcaaacttcctataggtgatacacatcctatgtcttgttatggtcctagttggtatcagctcatctttataattttttatgactatcatacctccctttttgggaacagaatggacaggagataccaaagtgctatcaaatatagggtaaattatacccgtgtctaatagtttaagtatctccttctttaccacttctttcaggttcaggtttaatctcctctgaggttcaatgctagagtaagattcgttttctaaatgaattttatgggtacatagaatgggtgagatccctttgatatcatctactgaatatcctataactcttctatattttttcaattttgttaacagtagattaacttgatcagtgttcagtccagcattgacaatcacaggataagtagagttatgtccaaggaaaacatactttagtctttttggcagcggtttcaagtccaccttgggtgctttgagttctgatcagtcgttggatgctaagtcagctttagtgggaaggttgtaatcgcggagcttgatcaagtagactgaatggactgtcaatcgagtgacgtgatcgagtatatccccctcctttgcctttccaaccaagtcttcatactcctctggattctcagcttctttaagcatatctaacagcttctggtaccccaaagtttccaagtgtaaatctccttccttgctatcttttgttagagcactctctagatggtcctcttatgctagctcttctagcaattcgtcagctaacatatccatctctacaatccagaagacgtttccttctattgtaggcttcttcatggtgttggtgctatcgaaggtcatcttgagatctctccagaggttaagattggtcttccccttcttgacatcgatgatggctccagctgtagcaaaaaaacggtcttcctaagatcaaagggtccctaggttcttccattgagcaacaccctgctcagtgttttggttaagatgtttcttggtgggtgctcttccgcttcttagagtgatagcgttaatatactcctttggggtttggacggctttcccagggagatgtccttggttgtttgaagccgatgttgaagccaaattgccttcttgatatctcatcctagtgctcagcgattcgaacttgttgttaaggtcattgaaggtgacatcgactttgttgtttaactcagccatcttcttagcaatctccattgctcatgtagattgtccttgaattatctgcaggagcatgttcttcatgtcagaatcttgaggtgcaggtgcgtgatgttgctgcggtgggaaaccaggtggtggttgctgccgttgatatcctccctagaaccgctgcttgggaacaaacccctgaccttagttatatggaacaaacggtttgggttgcatttgctgcttctgctgtagagggtaaacttggtcatgagggttggctaagttggtgattctgtatgacagattctggttgtttggccggtagttgatgtaccgtttattgtagccacatcggttctgaatataactgatttcaggtggctggtcattctccccctcttgaacttgaaatggttcttcttcagagataaagtgaacatgcttctgctgcacttggaggagtttatcaagtttctcgttgagagctttaatctctctacggtagtgcttatcatcagagtcagagctgctgtggatgcttctatcgtcgtctccattgtagttgccatctgactgagccaagttttcaactaactctcatccttcatcaaagtcgtgatgaggacatttggtctaataacctttgaagcgctcccatgcttcatagaaggtttcagcatgctgctgtgtgtatccgaatatctcattccgaagtcttgcagttctggagttgaagaaatatttagcgaagataaagtcttatccatcccaagtcgtgataaagtcttgaggaggtgcttttcgccacagatggcctttatcttgatatgtctataatttgcatgatttaggcattcattcttcaccattttatcattgtttcatcgacatttcatctcattaggagtcgttttagtgtgttttacatacttaggacgattttgcattaggattgcatgtgcattgcatatttggttgttttcaggtactttggatgcttttggagttcaaacagagaaaaaacagaacatgaagtcagaatgcccaatgacgccttcagcaaaagtactctatcgcagcctcggatccctgccagggcaaatcactctatcgcaaccccggagaagcaagcagctcagattcactcaatcgcgaaaccggaggaatcaccccatcagaaccactcgatcacgaggaagcctatctgctcattctgcactcaaccagacaagctgagaacaaagaagagaagagaagccgaagaaaccactcgatcaccacctcatgacatccactcgatgaggtggtgatccgttatttatctcgcttttacattttcgcaactttgatagccacagtgtttctcctgcgactttgtattttcactttcaagtatttgatattcagttttcgtttaagtctttcatcatttttgttatcatgagtagtgaactgtatttctgaggatgggatagaataattgtggtttacttggtcgttttaggtggttgagtttagaattctagaatcccttctggattagttgcgcttattgcttgtttcactggctaatgtggagtatgagtccagacgtccaacgctcagaaggcgtttaatgggcgttggatcctattaattccagagatatctgactcaaccccaagggattggctgtagagagggtattgactttcacatgttgattcgataatgcctgcttagttagagatcgctaaagggatttaggtcagtgtctagctttgcttgaggatttctatcacgggagtgaattaatctgttgttgaacttgttgtctagggatagcttctgtgaagttttgtcaaccgcctgaatagattaaagagaccacactattcgattaccccatccttaggaatcgtttatccatttgattgtctgttatcatttctgctttgtcattcacttgcctgctattgccattccttcttttagtttcatttcatttctgttattgcatactaggactgttagaaccaaccaactttctgcttggcttgacttagagctttctaatcatatctcatatgtttgcatcacaccggattggattaacatcctaaaatactacaacgacaagatagtgttttagggattaattgagtaaaatcctactatcaatttggcgtcgttgccaatttggttgtttgctatatttgagatcattagaaacgttaagaccaagttcgtttttgttacaatagttactaacattgtgccttttctgtctttgtgtttcaggtaccttgcaacccgctttgcagatgcatctctgattcgtctgttatagcttgcctgctatctgttgcatgcatacacggtcacaaagaaatcagaatctcctattcaacgataacatcgaccgtattgcttgccaactaagagaacaaacagaaaccgacacaatggctgacgttgtagatgagcaagagcaacctaccaacattggtgctggtgacttccctcacaaccacaaccagcgtcatggaattgttccacctccagtacagaacaacaactttgagatcaaaagcggtctgattgctatggttcagaggaacaagtttcatggcctaccaatggaggatccgctagatcatcttgacgagtttgaaaggctctgtggccttactaaaatcaatggagttagtgaagatggtttcaagcttcgcttgtttccattctcacttggagataaagcccatctgtgggaaaagacgctactccagaattcaatcacgacctgggatgactgcaaaaaggccttcttggcaaaattcttctctaactccaggactacaagactccggaatgagatatccggattcactcagaagcaaaatgaaagcttctgtgaagcttgagagcgctttaagggttatcaaaccaaatgccctcatcacggatttacccaagcttctcttctcaacacactttacagaggcgtcttgcctaagatacgtatgctccttgacaccgcttcaaatgagaattttctgaagaaggatgttgaagaaggatgggagctagttgaaaactttggtcaatcggatggcaattacaatgaagactatgacagaagcatcttcaccagttctgactctgatgagaagcaccacagagagatgaaagctctcaatgacaaactagacaaaatcatccaaatgcaaacagaaacatgttcacttcatctctgaagatgaaccattccaagtacaagagggggacaccgatcagtgtgctgaaatcagatatgttcataatcaaggtggctacaacaaggggtacaataactacagacccaacccaaatctgtcataccgaagcaccaatgtcgccaaccctcaggaccaagtctaccctcagcagcagcagcaacagaaccaaaccaaaccgtttgttccttacaaccaaagccaagggttcgttccaaagtagcagtttcaaggaagatatcaacaacagcaaccaccacctggtttcacaccacatcaacaacaagcacctgcgcctcagaattcagacataatgactgtgctccagcagctcattcaaggacaagccacaagagcaatggaaatcactaagaagctgtctgaagtaaaaaacaaattcgaccgacaaggcgtcgaacttaacaacaagttcgaatcaatgagcattaggatgagatatgtggaaggcatcctcgcttcaccatctgttaacaacaacccatgccagcttccagggaaagcaatccagaatccaaaggagtatgccactgcccatgccatcactatcccacatgatcaagagctgccaactcgatatgtccctacatcaaacactgaggacagtgtaattctagagggggaggatttttatcaagattatgtgttggctgacaacccaatcgaagagcccatactcaccagtcaacccactcgaccacaagctccccagctactccctttgtattttcactttcaagtatttgatattcagttttcgtttaagtctttcatcatttttgttatcatgttttcaatcgttgttttgctattgtctttgattatgtttgagtagtgaactgtatttctgaggatgggatagaatagttctggtttacttggtcgttttaggtggttgagtttagaattctagaatcccttctggattagttgcgcttattgcttgttttactggctaatgtggagtatgagtccagacgtccagcgctcagaaggcgtttaatgggcgttggatcctattaattccagagatatctgactctaccccaagggattggctgtagagagggtattgactttaacatgttgattcgataatgcgtgcttagttagagatcgctaaagggatttaggtcagtgtctagctttgcttgaggatttctatcactggagtgaattaatctgttgttgaacttgttgtctagggatagcttctgtgaagttttgtcaaccgcctgaatagattaaggagaccacactattcgattaccccatccttaggaatcgtttatccatttgattgcctgttatcatttctgctttgtcattcacttgcctgctattgccatttcttcttttagtttcatttcatttctgttattgcatactaggactgttagaaccaaccaactttctgcttggcttgacttagagctttctgatcatatctcatctgtttgcatcacaccggattggattgacatcctaaaatactacaacgacaagatagtgttttagggattaattcagtaaaatcctactatcatatctccaagcgaaaatggaaacaagtgaagcttgaaaccatcttcactaactccattgattcttgttaggctacagagcctttcaaactcgtctaggtgatcgagtggatcttcaattggaaggccgtgagatttgttgccctgaaccatagcaatgagaccactcttgatcttaaaattgttgttctgaaccggcagaggtacaatgccatgacgcaagttgtcgccagcgccaatattgttggggagttcctgatcatctacaacatcagccatcgtatcaatatctatctgttctcttagtgagcgagcaatacggtcgatgttgtcgttgaagaggaggttttgatgtccttctgaccgtgtcatagtcttcattgtagcacccatcagattgtgctagatttttgaccaactcccatccttctgctacatctttgttcaagaatttttcatttgaggcagtgtcgagtagcattctgatcttcggtaaagttcccctgtagagtgtgctcactaatgaagctttcttaaaaccgtgatgggggcactaagtggtgtatcttttaaacctcttgatatagctcaaattgccttaagcttactccctcaaataagagatcgtcgttagcacttaagggtcgaattccactaagctctcgatgttcacacaatagacttatgatgttatttaataagctaaatgaagtaattgaatattaaagacaaataagcaagtaaatgagttgtagattcaagtgattaaagcgttaggtctaaggaattatctcgggagatagataaattgtagatctagctaatattaagattgttatcgcaccgttctgaaactcaaactataattctagagtaaccggtagcgttccgcgaaactttctatacttacaactaagataaacagagaagccgagaaatcctatgctaaagcatgcattgttaataagcttgattagttcacctagtatctaaaccagagcccttctatgagcttacatgttctttcttaaatgcctaggctcatctatgatggttcaaataacaaatacctatggcgggaatacctattatctaatatcaagttctaggtgatcaatctaaaactagcattaagaataatcaagatgaagaactctaagaataatcctaagggggttttcgatctactaatccatctaaatccctattgagactctctaaacccaacaaggtgattactcagacatgaccatagaaacacaaatcataatctgaatagttttcattgatgaattaagaataataccaaaggagttcagaatccgctgcgtagtgtaactacattgatagaagttgatgtaggtgagagattagagaattgagagcgtagattgtcaaaccctgtggatagagaatcatatttggtatggagatcagtggagagagaatcatattggcttttaagctccattctgggttctgatgagggtggagggtgggctaggataggaggagagattgctgaaacatgagtctctttgcacttggtagctttctcagctgaaattcttcgttctttgtcaaattactacgtcgaatgaccagttaaagcattggtgattaggattaatgcttcactagtggttcttgtcatgaagttacaggagcttgctgcatcaagttgaatctggtatggcttgtctattcctttgtagaagatgttgatgagttagctctcttggaaaccatgttggggacattcacgttgataggtcctgaatcggagccaagatgctttaagggattctgctggagcttgggtgaacgaagaaatttgcaaacgaatttcctctatcacgaactcatcgaagaaatgattcatgaatgcattctttgtatcattccaattggttagggaacctggttccagttgacgcaaccatgatgttcctctgctcgcgagagagtgggggaagagtttgcaaagaaggtaatcagctggtacaccttctgctttaatagaggaaacaatgtcttcgaagacttccaaatgatccaatggtgattcatcgggagctcctctaaactttaatctagatacaagatcatagtaggcaaggtgtatagcaaagtcatctctttcaaaaggaggtagcttgaatgttgatcggtttgtgtagaagagatcagttctgttaaaatcccctattgtagctgtatggttctgtagagggtatcgatcgacaccatagttatatcggtcgacaccatcgtaaaaatctgccatgaaaatgtgagtctcaatctgaaggtacctgaaacacaagagaccaatagacaaagaaacacatgaataggtggtagaaaagtaatatttagacttaaaagaacacctagtctaatggtgaactaaaagagaacttcggcaacgacgccaaatttgatatagctcaaattgccttaagcttactccctcaaataagagatcgttgttagcacttaagggtcaaattccactgagctcttgatgttcacacaatagacttatgatgttgtttaataagctatatgaagtaattcaatattaaagacaaataagcaagtaaatgagttgtagattcaagtgattaaagcgtcaggtctaaggaattgtcttgggagatagataaattgtagatctagctaatatcaggattgtgcgttcccaaactcaaactataattctagagtaaccggtggcgttccgcaaaactctctatacttacaagtaagataaccggagaagccaaaaaatcctatgctaaagcatgcattgttaataagcttgattagttcacctagtatctaaaccagagcccttctatgagccaacctgttatttcttaaatgcctaggctcatctatgatggttcaaataacaaatacctatggcgggaatacctattatctaatatcaagttctacgtgatcaatcgaaaactagcaaaaagaataatcaagatgaagaactctaagaataatcctaaaggggttttcgatctactaatccaactaaatccctattgagactccctagacccaacaaggtgattactcagacatgacaatagaaacacaactcataatctggatagttttcattgatgaattaagaataataccaaaggagttcagaatcctctctttagggattggattctttttctctaaagtgtaacaaaagctcaagaacaaaaactaggtctaacaatgaccaaacaattaggtatatatctctaataacgtgcagggactaatttgcaaataagaaaaacttcagggcttcttaaagacttggtataaaacaaatattcttctggcagcgataagagtgtcaatcgacacaggtgtggtgtcgatcgacaccagcttttgaaaaacgtccttcaagatctttattgctgaaaaagcatccaaaattccttattgtgctccatagttcccagatgtgtgagtgtacctggaatgactcaaaacgtacgaaaaagactagaaagactctaaagaccattctgaaactgtgttagaaatcagtataaaccgggacatatcacctctcgcaaacttcactgaagtttcatagtttttctgtgtgaagcctgagatctcgttcctaaatctagtggtgcgagcattagagaagaacttagcaagaaaagttttcttacaatcaccccaagagttgatggattttgggggtagagtcttctcccagtggtgtgccttgtctcccaaagagaagggaaatagtctaagcttaaacatatcttcagtgacaccattgatcttagtaaagccacagagcctatcaaagctgtcaagatggtccaagggatcttccataggcaaaccatgaaatttgtttccttggatcgtggagatgagaccactcttgatctcaaagttgttgttctgaactggtggaggtactaccccttgtctttggtgatgattccttgggcatcacaagcaccaatgtttcttggttgatcaacattaggtggatcttgaacatcaaccagtctattctgttgatccatagcagctggtctttgctgatcaaaggctgcctttgctttggtttcttgtaaatcacgagctattctgtcaattctgtctctgaatggttgtaggtgtgcagaacctttggaccgagtttgcatgcacgaagattaatacctataccacaaaaacaagcagacgaaaagatgagttagtaacttgaaaactataaaagaacttgatcttaactttttctgatatcttgaatgtaacaatgcaaccctagattcactagaagacaagagacttgtggcggtttggacgattgctcgatcttgaggatcgagtaaacagggtgctacaaagtctgcgcctttgcctccatgctccgagtgatcaattggtcgagtagatgcttctacctctcctatctgtatgctcagatgtctggttgagtggggaatgaggaggatccgaagacgctttgatcggtcaacgaggcttgtagagttggtctcccttgatcgagtaaaggggtcgagtagaggatcgagtaagagaggcgggtagaccgatctgctgctttctctgtggctgcctggatcgagtgaactggtcgagtagattgctctgttgcttctctcctggttggatagagtagagggtcgagtagagtccttgaagctccttctacacctgaaaacacaccaaaacatgcaatatgtatgcaagatgatcttaaatgcctaaatgtgcaaaataagctaaatgtgatgcaaatgatatgaaacaatgagtgataactaagcgaaatgatgattaatacatgtctagaatgagtaaaatatcgtgttatcacgctttcaagtttactaaagaggaaatttgcctcataggacttccctatttgcattattagtctctgaacattttatagggtttttatacattgtttagacctaagttttcttttatcaagctttttgtaaaacctaattttgagagacataagctattcatcccttgttcttcagatattcattcagttttcaatacgatgaacagatcctttctttcctttttctctattgctgtgtttatgctttctatctgatcaacttgtctgttctggacttgggaaaacttgagcgcaccaaccgaaaaacccagatataagcaatgggtgacagagtcatcagaggtgatgcagaaggagttttgagagatgaggatgggcaagcctacaatgaagctggtcagagattggatgatcatgggctcatcctacctaaggatgccaatgagaattaggtgcgcctcaatgaacaattagctgccagagacgcagaagggcttggtgtcgaccgacacatcagaggtgtagatcgacaccttcgggattagaatgaagacacgattggtgtcgaacgacacaacagaggtgtcgatcgacaccaacctaagattccagcagttattcctcctgcaacagaggtgtttaccactctactgcggaaccacgtcgtacccttggggatttcaacagacctgacctattctatgctaatcgatcagcgatcgtacccccacccttcctgaggaacgattatgagctaaatcctggctactttgctttagttggccagcatcctttccaaggcttatctcatgagcagcttattgaccatatcgagcgctttgaggaccttgttctgagcatcaacgctaatggagtctcagaggactacctattgtgcaagctcttccttattcacttgttggggaagccgcttcttggctaaaacaacttaaagccggttccctcaagaattggagaagcatcaagatagctttcttaaacagtttctacgatgatgctaagtctgaggagttgagaatcaagttttctaccttcacccaaggtccagctgaagctttcaaggctaattgggtttgcttcaaggaatatcaacgggactgcccgtatcatggcttcagtgaggtacaaattcttggcacctttttcagaggagtcgattggagatactagatagatctagatgcagcgagcaatggtaatttcaacacgagatatccagctgatgttacagctctaatagagaaccttgcttgtagtaaaggcaccaagaatgctgattttgagaggaaaaagattgctggagctgtttcaggcaatcagatggcagaggtgaatgctaagttggattcggttcataacttgcttacaaggaagaagcatgtccattttgcagctgaggatgagactattgagcctgagactaagtctgaagaagttgagctctcacttgaagaaggtcaatgtacaggtagctcaaactgcacaatccatcaagagacaagagggctttcttcctggtaatcctgatgctaacctaaggaagaactgtaatgcaatcttgatcagagaaggagatgatgtgtgggaagaattagacactgaggacgagttggagctcgcagtcgtagagatggtttcgaccgacaccttcttgtgtcaatcgacaccctatggaacgctcttctctaagacaattccttacgaaggtgtcgatcgatatccctctcgtgttgatcgacactgtatccggactacaccttgtgaggtgcgaatcccaaatgcagcccgagtctatttacactcgtcatgtccattatccgaggaagcgtcgttctaagcaggagattcatgctgctaagtgcacagccataatggtgaagatcctccattctcttcctaaggatgcatctgagacatcttctgccccactcaacaagtatgtcaagcaacttgttgacattggtattagctcagatgaagccttattgctgatacgggacataagtgcaataatgctgcctaaggtcaggaaagagaaggcacagagagtggacattgctgagtacatctgcaccatcactcctgctcagaccactaagaagcttccagatccaagtagcttcattcttgattgctctatctccacaggcaggttaagccgctctttgtgtgatctgggatcaattatcaacctcatgcctaagtctgttgctgagagactaggcatgactaactacgggccgactcgcatcactctcctcttcgcggatcgttcaaatcgaatccctgaaggaatccttgaagatgttcctattaaggttggtaactcttttatccttgctgattttgtggtcctcgactatgagaaggaacccaaggatcctcttatccttggaagagcgttcctagctacagctggtgctcagaatcccataatagagccgcacacaacgctcccatcagcacacaatgatagttgtagagcaacagtgtcgatcgacaccaccactcctgtcgatcgacaccctcgggattctcaaacagaggattctgcacaatcttttcagcccacaccacttgagtacctatgtgataagttctcttctaatttaccttcgattaattctttagattctttgaagtctgcttcacaagataacaaacctagagttcttcgaaagcttgtttctccttttgttcttgcaggtgacgagaagagtgttgatcgacacaccactaagtgtcgatcgacaccttcagctgcctcgaccagatcagtttactcaccgccttggaaggcaaggaggcaggaataatcctccaccactcaacccacatcctgaactctgccaagtcaagctattgactaaaaacatgggcttagcgggaggcaacccactagtttgatttttttcccctttcttttattttcttttatttttgatttatttttcccgctttctctatatttgaatgtcactggggacaatgtcgtttaagtctgggggaggttcttactaattatgcttttatttttgtttcttattatttttcgtttctaagtttattaagtcaatataaaaaattaaaaaaaaaacaaaataaacaaaataaaaaaaacataaataaaaaataaaaaacgttttctttagactagttcggaatcatgatctatatttctcttgattattgccttattgatgagtgttgcaggttcgagtcaatccgactattggaaaatctatatggcaaaccaacagacttgaggatatcctagtttccaacacaaccactaaggctggagctaatctcactgctcttgcttttacctcttcaaacggttagtattcatagatcttgactcgttgttcatacctgatattgagaccaatttgataaaaaaagaatgagttcctctccccttataaaaataaaaatataatgagagattgataggattttcagatagtgtataggggtaggaatgtttcctatgaccccacaattatacattatttggaatgatcaattacaaaggttggaaaaatgccgagggtgtcgatccagtatgcgagttctcctttgtttactctctaaaaagaataagtctaggggagagaaagaacaccaaagaaaaaaaagaatggtcaatttatcatggtatagtacaggaatgagtctacaaagatcttgaatgttagcttgtttgatgagacccagccatgaaagcctggtggatatagttgtggaacttaggtatggaatatagaatgttgtgtaagcttgtagagaagtacatgttggttaggatttgattagacttgttaggcatatggacttagtttggatgatcatggcaataagctagaaaatgttgggagttccttagttttcaaaacctcttccacgggttcggcttttgtgttttgcttgagggctaacaaaagctaagtctgggggagttgatataacccaattttcactgattttatctatgttttaggtataggattttgagtctttatgttatttctcgagtctttttagtgtcttttcaggtattctatgtagtgtgacaacaatggagataaggagacattttagagcaaaagctaaggaaaaggaagttaaggacgattttggattcaagaatcagagagagtgtcgatcgacacactccttgtgtcgatcaccaccagtttcagccaagcaaagtccatgacgctttcaagtttatagaagaggaaatttgccccagaagacttccctatttgcatcattagtacttggacgttttatagggttcttatacattgtttagacctaagttttcttttatcaagctttttgcaaaaccctattttgagagacataagctattcatcccctattcttcagagattcattcagcttttaatacggtgaagagatcctttctttccctaatctttattgatgtgtttatgctttctatctcaattatgttgtttgttcattcaatatgtctgagtagtttgattgttaggaatagggtttctcattaggaattcatatggtttagtagattgccccctttgctaggttatctgtataattcttcatatttgattatgcttaatgttagatctagagtaattaactagatcttgaatccagacaatagatatgcccaccataggtatctgtagttagacctattatttgatgagcctggtttataggtgtgtattaagaatcggcctatctactaaggtgaacaatcgaactcgttaagaatgcatgtttaggttaataatctttcggcttgtccagttttcttagccataggcatacggagtttcgcggaacaccaccggttattccataattagagttttgagtttaagaatggttcgataataacctagctttcattagatctactaaccaatatttttctgagaataccctgttcctagctctttatttaatcgttacaaccaatcaatctgctgtcttcttactttgttttcatattatttcaatcataccctactagcttaatcttaacattgaattcattgtgtgaataaaagaactttgtggaaatcgatccttaaattctgcaattgatctcttatttgagagagtagttcttagggaatttcagccatatcaattatctttattaaaaatgttcttattttaatcgttacgctaaaaagtaaacgattaaatacattaatactaaattccactaaatcgcaaaaccatgctttcacctaaaccgtaaacgcgcattttccgctagaatcgcaaaaccctcttttcagccaaaatttgctatttgatttcccgattttgcagtttacgcttttgcaaacaacaataaattttttaagtaagagtatcagttcagatcaaaaattattattattttattcttatcttgtttattttgttttaaaatcgtttttattttgatttgggacctactacaggaaattaattttattgatacataatatttcgtcactatgccaacaaatctgtaacaatcaaaatataatgatgaatttgagactaattgtcaacggttgcaatacattcgtcatttcttactagtgatgactaaaaaactgtcacaattatgttatttcttacgacggaactatagtcattaaatcgtcagaatcatactgttcctagtcagtctctagttataactgaaaatatgttatcactcggttctcatttccaactattttaccatcccaaatttgtcacattttagtaccacaattctatcaaaatatttcataattaagaaactatttgacacctatattagtcactatctttactacattattttcagaatttgtgatattttttcctctaaattttactaaacaaaattagaaaaataaataaactgaaagtaaattaccaaagcaacatccaatttaaaattgtctaaaaagaaataaatgtgatatggtataaaatgaaagcaaacaaaagtaaagaaaccaaatcaaagtaaaaccaaataaaaaccaaagtcaagccatattacctggtctaaaatgaaagcaaaaaaaagcaaaataaacccacttaaagtaaaaccaaatagaaaccaaattcaaaccatattacgtagcacgagaaaatgaagaaaaccctatgggaacttgtggagaagaagaacttcctacaggtggaggaggtggagctgatgcatttaactcactctaacgggcaaaagtttgaattagttgctccacatcttcgagtcgaacaagcacattatctttacgactcttttgcagttcaacttctagttatttcactcagagaattaatgctcccacttcttcagtagcttgagggggaactaggtaactatctgacatggaaaccctactttgaagtgattttagtccagatacatgaccttgttttgatattccagcaatctagaaaaaaagcataaattcatgaataatgagagattttaaaatacaaactccttcaaagctccaagaaaacaagtagattcaagtgaaaacaagtgaaagttaccttaacatagttttcattttttttcttctatggtaagagaatccattgtcaaaacctctccattggaagaatccgtttgtgtcaagctttcaagaagacattcatcatattgttgagcaattagtgttgctctttcatcaacatatgttccatcagatttttggtgtattgctctcattacagcaatgaaggaagagtcttcattatttgcttcctgagaacaaaacaataaaaaggtaaataactcttatcaaacgttttgaaagaaaacataactgttaccaaaattaaaaattaataattaccaagccatcttgaactttagcatacaaacatgaaccagttctgtgataatgtggacttaaatcatcacgactaaatagtcgtgaataacgagcattttcacttttttctttggctttaagtgtcttccagtaagctaccattactttccaacattcagccagaatccagtcaagttgtttttctttgaactttgcaagactaaccattcctttgaggagagcagctacaagggcatcaaagttggctttaactagattctcaatcgaggcatcccactcaaaccttgtctaaaatatatctatgtaagacatgtattaaacaaaaaattatttttgaaaaatagtttatatataactaacacacaccttaaacgttctaaaccatgcatctttataaaattacgacacttttctccagcaataccaaggtttcttaaaacaccgttcaatgatatttctaactcgcgttgatacttcggtgttgtttttaaacctgatacatatgtatttaaattatatttataatttattttgttacattaaacaatgaatgaaacaaaaaaggaagaacaataccatttaactccatttcttcgagaggggtgaagcactctctgaatatcatactataaaggtgcaattttgtaacgttcctgaaccaaaaaatcggttagggtttgtgtttaaatctcccggttaaataagtttggttaatggataccatagagtgtgcctataaaaaaaggaaactcaaaattagggctttagttaaccactttgtattctgtaaaggagaaaaagagagagaagaagaaggactagaatcgttagggtttggcaagaaacagtttcgacatatcaaatctttgtcaaaggtaacgaaatttggtagatttatttccaagtctttcatcgtcattctatagtttacagaaacggatttggatttaaacttcttgagttaatcgcagtttcgtaagacatgttttctcaaacgtgagttaggaccagcggagattgtaactgagatcgtggtcttgtctcgtttttgatcggcacgagagttcgtgatcgtggaatcatggcaaggaagagaggatgatctaggaactcttttgagctcatttaaaagtgatgcttacagtgccacaattgagcagagtgtgggttcgcagcctgagtttgtggaggccggagctgggaacggtcttggtgccgatatagctggtgcagcccgagtggcgctagtggagctagtgtcggtgcatgtgtgcatgccgttggtgctcaggtcccaggagtgatgggtaccgcagccggaggagcccaagttccagagattggcttggcgggagtactaaggcagttgttggagcgtttaccaagtgtagtaccagtgcaggctccagttgtgccacaagtggtggaggtgcagcaaagggctgcggttgctgagaaagttccatcttatttgaggataatggagcagttgtaaaggattggcaccgggtatttctctggtggtgctagtcctgaagaggccgacagttggcggtcgcgagttaagcggaacttcagttcgagcagatgcctgatggagtatcgggtggacctggcagtgcattttctagaggaggatgcacatttgtggtggaagagtgtgactgccaggaggaggcaggcggatatgtcttgggcagattttgtggttgagtttaatgcaaagtactttctgcaggacgagctcgaccgtatggaggtgcgttttcttgagctaacactggttgagcggtcggtttgggagtatgaccgggagtttaaccgagtcttggtgtatgcgggttggggcatgaaggatggtcaagccgagttaaggaggttcatgaggggacttcgaccggatctgagagtgcggtgtagaatgtcacagtatgccctgaaggcagcattggtggagacggctgctgaggtataggaggatcttcagaggtaggttgtggcagtgagtccagcggtacagccgaagaagactcagcagtaggtggcacctagaaaaggcggcaagcctatgcaggggaagaagaggagctggaatcatctttctagagctggacagggtggtcgtgcgggatgtttttcttgtgggaaccttgcccacaaggtggcagattgcaagtagcgagttgagacgagagagtgctaccattgttgggggaggggacatctcatgccgaattgtcctaagctccagtggatggcaatggcagtagtatagccaccggtgtagcggggagtgcaacagaatgtgcagcagttggcacatattccagcggcaccacaatgctacaatacgtttgaggcaggcggtaccagcaccggagtgatcactggtatgatttctgagactcaaactttgtgaatgatttcttttgttttggatatcattgcttaatgatgaatgttagggttcttagcacatgagatatgtgtaggtaccttattggtgggcggtgtagaggctcatgtgttgtttcactcaggaacatcgcattgctccattaccctggagagtgcctcgcacagcaacatccgtggagatcctggtgagcagtttggagccgttaagggtaccaaaggacattttctagcggttctaggagagttaagggtgtggaaattcatattgcggtggagtcgatgccagcaaatctgattatcagccatgtagaactatattatgttattttggggatggattggttggatcattacagagtacatcttgactgcccccgtgggagagtttcttttgagcggcgagagggaggttggtttatcagggagtgagacctacctcagggagtctagtcatctcaatagtgcaggtagacaagatgatcgagaagggctatgaggcttacctgctgacaatatttatgcaggtagcagtgagcaacattcgggttgtttaggagttcgaggatgtatttcagtcggcgccaaatttgatatagctccaattggcttaagcttactccctcaaataagagatcgtcgttagcacttaagggtcgaattccacaaagctgtcgatgttcacgcaataaacttatgaagattttagttaagctatacaaactataataatttaaaaatcatcaaagcaagtaaataagttgtagattcaagtgattaaagcgtcgggtctaaggaattgtcttgggagatagataaattgtagatctagctaatattaggactattatcgcaccgctcttgaactcaaactatgattttagagtaaccggtgatgctccacgaaactctctttacttagagcttaagatatccgaagaagccgagaaatcctatactaaagcatgcatttttatcaagtttgattagttcaccgagtatctaaaccagagcccttctatgagcctacctgttctttcttaaatacctagactcatgtatgatagttcaaataacaagtacttatggtgggcatacctattatctaatatcaagttctaggtgatcaatctaagaataatcaagatgaagaactctaagaataattctaaggggttttcgatctactaatccatctaaatccctattaagacaccttaaacccaacaaggtgattactgagacatgataacagaaacacaaatcataatctgaatagattgcattgatgaattaagaataagagtaaaaggagttcaaaatcatctctctgcatggattggattcttctctccaaaataaaacaaagctgaggtcttacaaatgaccaaataattaggtatataagtgactaaaaacgtgcagggactactttacaaataagtaaaactttagggcttctcaaagacttggcagaaatcagaaattccctcagccgaaataagggtgtcgatcgacaccatcgcgtgaaaaacgtctttgataatcttcattgctgaaaagctcccaaaattccttattatgcttcatagctcccaaatgtgtaattgcacctgatatgactcaaaacatacgaaaaggactagaaagactctaaaaaccattatgaaattatattagaaatcagtaaaaaccaggacatatcaactcccctagacttagcttttgcttgccctcaagcaaaactaaatattgaatatgtgaaagaagtttaaaaacatagaaactcccaatctctctagcttattaccctgatcatacaaaccaaatccacgcactaaatagttctattcaaatccagaccaccatgtaattctccgctagcttacacaacatcctagattccatactaaagcactcaactatatccattaggctctcatcgttgggtcttatcaatcaagttaatgttaagaaccttctagagtcattcctgtactataacataacaaatcgaccattcattttctttatatttctggtattcttcctcttcccaagacttatttctttttaaagagtaaacaaaggggaactcgcatactggattgacatcctcggcatttttccaacctttgtaattgatcattttaaacaatatataataatggggtcataggaaacattcatacccctatacactatatgaaaatcctatcaatctcccatgtattatattattatttttttatcaagggagaggaaatactttctttttatcgcattagtcgacttataaggtaataacaaggagtcaagcattttctacttttttcaggtctttacatgtttgggatgcatttggagattatggagcattctggagcaacaaagacaacttaagctgcacaagcaattcggagacggaaattgacgtaggtgtcgatcgacacaacccctggtgtcgagcgataccaatacctgacggtaattcaattgcgcaacttattcatgttttgaagatttccaaatttggcccagaactttctcttatttccaaagaaggcccaaacgtttttagggcttatgtattgatttttatggtcattgtttagacctaactcttattatctcttttattcttgggagcaaaaccctttggagactccctttagagaagattcttctaaactcttttctcttcttaatttcatcattgatttcttattcaatcatattttattcttctatgatcatgcttgagtagttctcttgttgggtttagggattctcattagggatttggatgaattagtaaatcgaaaaccctgttaggataatatatttagaattcttcatcttaaattgttcttaatgctagttttagggtaactaactagaacttgattttaggataataggtatgcccatcatagttatctattactggaaataccttagatgagcctagtatttagatgcgtgctagcgtccattacttaggtgaacttatcaaacctgtttataatgcttgcttagttctagggatttacaagagagttgggatcaatactattaaacatagtgaggtttgcggaacaccaccggtcactctatattagtgatttgtgttctagaatggttcaataataaccctaatttactgctagatctactattctgatattttctgagaatttccttaaacctgacaccttaatcatctgaatctaaaaccaacttttaattgctttcttgtcttttacttttataatatttttcagtttagctttattcaaaacagttagcctattttgtgatccgagaactttgtggaattcgatccctaagtgctataacaacctctttatttgagagagtagtcattagggtaatttgactcatatcaaatttggcgtcattaccgaagttctctttgattcaccattagattaggtgtagaatttagtctaagcttttcttttcttttgatactcatgtatttttatttcttcttcttcttgtttttcaagagtttaaggaattc

SEQ ID NO: 197 - DNA, 151828 bp, Arabidopsis thaliana
gaattctcgaggatggggtaattgagtagtttcgtttcctcagtttacaggtgactgacatgctcaataaattatccctaaacaacaagttcattaaccaaatctaagtgccaccgcaacagagaccctcaagttaacctagtcccagactcaatcaccattgacgagagctaacctaacaggcattacgaatcaacaagttaaagccaaaacgctccttgcaaccaataccttggtacagggccacgaatctctagaattaatggttcagacatttcatcgaacaccttttgggcgcagaaatatctgggctcaaattccagttgatcagaaagcaataggcattaagaacaactaatccagaagggatctatcaatcaatacttaaccacctagcatactgagaattctacactactctaacccatcctcagaaacctattcactactcagacatcattgtagagaacataaacgttgaacaggatgaaaacacgataacaacagtgtaatagcaaaacgataacaggatgaacaacagtaaacgaaatcaagaacaaatactgaatgctaaatactgaatagataaagagaaatccggattacaaaaggtctagaacacagtgtctgcggaataaaactagataaaaaaaacttgttctcgaaaatgtagggtacatgctacttatagcaaaatattccgaaaccctaatacttaaaacgacgcagtattgggacggattaagaactgtactcgacctaggtggtcgagtgggaggtcgagtgaatagctggagtcttcttttctttcttatgcttgaatgtctggttgagtgcggaatgaagaagactctgaagcttgccatcgagtatgtagtcgagtggtggtgatggtgatactcgacttcccggtagagaggtgtgatcgcggtggtgatctggtgatggagatgaagacactcgaccttggggtcaagtgaggtgatcgagtggtggtcaggtgatggagatgatgacactcgacctcagggtcgagtgatatgatgaaatcgagaagtcctctactcgaccagggggtcgagtggtctcttgaggtcttgaagcttctactcgacctcggggtcgagtggtttgacatgatcaggtccgcttcttccaattagctcgtcaacagctccaaatcacctcaaatcaacacaaatatgcaacatgcatgcaaacctatcctaaacatgcaaagtgatgacaaatgatgagaaatggtataaaacagtaatgatatggtgctaaaatgatgacaaagggatgctcaaaacatgcaaaatacatacttatcagctatttcaagaaatcagatagtagaggtgaatgctaagctggattcagttcataacttgctcacagggaagaagcatgtctactttgcagctgaggaagagactattgagcctgagcctaagttagaggaaggagtcttctacataaatggtcagggatacaggaagtttgggcaaacacagggcaacttcagtggcaacaggtttacagggaaccagggttcctccaactacactccaaatcctgctttccagaagacctttcctcaaagaagctttcacaggacctatggtaattcagcttaccaagcccccctcccctccaccctcagcagagacaagaatggaatcgatgcttgagcaaattctagagagccaaacaaagcttgttgtggagtttaatggcaagtttgatgctgtctacacagatcttaatgggaagatcgacaatctgagctctcacttgaagaagctagatgtacaggtagctcgaactgcacaatctatcaagagacaatagggttttcttcctggtaatcctgatgctaacccaaggaagagctgcaatgccatcatgattagagaaggagatgatgtgtgggaggaattggactctaaagacgagttggagctcgcagttgcagagagggtgtcgatcgacaccctcctgtgtcgatcgacaccatatgggacgctcttatcagagacgactcaatacgacggtgtcgatcgatacccctcttgtgtcgatcgacattggatccggactgcaccctgtaaggtgcaaatacctatgtagcccgagcctgtctacactcctcctgtcgcgtatccgaagaggcgtcgttctaagcaggagcttcatgctgccaagtgcaaagccataatggagaagatcttccatactcttcctaaggatgcttctgagacatctgcttcctcactcaacaggtatgtcaagcgacttgttgacaatggaattagcttagatgaagctaagctgcttaccagggacatcagtgcaatcatgctgcctaaggccaagaaggagaaggcatagagagtagacatagccgagtacatccgcaccattactcctggtcagaccactgagtagcttgtagatccatgtagctttgttcttaattgctctatctccagaagcaggtttagccgctttttgtgtgatatgggatccatcatcaacctcatgcctaagtctgtttgctgagagactaggcatgactcactacagacctactcgcatcactcttctcttcgcggatcgttccaagcgaatccctgaaggaatccttgaagatgttcatgttaaggttggtaactctgttatccctgctgatttcgtggtcctggactatgagaaggaacccaaggatcctcttatccttggaagagcattcctagctacaactggtgctaggtttgatgtgaagaaagagagaatctctctcaaggtttgtgatttggagatggagtttggcatggatggttcagagcttactaagcctatcagttgcattgcttcaagcatagatacacctcctcagactgatcatcccaccacagagccacacaaaatgctccaacccgctcagctcgccaatgagagttgcagagcaacggtgtcgatcgatactactaccccctgtcgatcgataccctcgggtttcacagacagaggattctgcacactctcttcaaccaacaccacttaaggacctatgtgataaattctcttctctctcttctcctgctttacctttgattaattctttagataattcgaagattgcttcacaagataacaagcctagattcctcgaaagcttgtttctcctgttgttcttgcaggtgacgagatgagtgtcgatcgacacatccctgattgtcgatcgaaacctgcagctgccccagccagatccgtttacacaccgccttggaaggcgaggaggcagcatcaatcctccaccactccacccacatcttgaactccaccaagtcaagctattgactcaaaacgagcgcttagtgggaggcaacccactggtttgatttttcttttcactttcttttattttcttttatttttgtttcattttcccctctttctctggatttgaatgccactggggacaatgtcgtttaagtctggggggggggggttcatactaatatggcttttatttttgtttcttatcatttttcattttgcagttcatttggttatttcttttatttccttttctaaatttttttaaaaaaaacgttttgtttagtttagttaggaatcatgatctatatttgtcttgttcgagtcaatctgactattggaaaatctagatggcaaaccaacagacttaaggatatcctagtttccaactcagccactaaggctggagctaatctcactgctcttccttttacctcttcaagtagttagtattcataaatcttgactccttgttgatacctgatattgagaccaatgtgataaaaagaatatgttcctctccccttataaaaagaaaaatataatgagagatggagatgactttcaaatagtgtatatgggtaggaatgtttcctatgacctcattattataccttaattggaatgatcaattataaaggttggaaaaatgtcgagggtgtcgatccagtatgcgagttcccctttgtttactctctaaaaataataagtctgggggagagaaagaacatcgaaaaagaaaaacaaatatataaagaatggtcttgaatgtcagcttgtttgatgagacccagctatgaaagcctggtggatatagttctggaacttaggtatggaatctagaatgttgtgtaagcttgtagagaagtacatgttggttaggatttgattagacttattaggcatatggacttagtttgaatgatcatggcaataggctagagaatgttggcagttcctttgttttcaaaacctcttccaagggttcggcttttgtgttatgcttgagggcaagcaaaagctaagtctgggggagttgatataacccgattttcactgattttatctatgttttaggtataggattttaagcctttatgttatttctcgagtctttttagtgtcttttcaggtattctatgcaatgggataacaatagagataaggagacattttagagcaaaagctaaggacgattttggttcaggaatcagcgaggagtgtcgatcgacacactctttgtgtcgatcgacaccagtttcggcccagcagaagtccacgacgctttcaagtttacagaagaggaaatttgccccagcagacttccctatttgcattattagtctctggacgtttttagggttttatatattgtttttagacctaagtttcttttatcgagtcttttatcaagcttttgcaaaaccctgtgactgagagacaaaagctattcatccattgttcttgagacactcattccagttttaaataccgtgaagaaatcttttctaactcttatctctattgctgtgtttatgctttctatctcaattatgttgtttgtttcattcaatatgtcttagtagtctgcttgttaggaatagggtatctcattagggattcatatggtttagtagattgccccctttgctagattatctgtagaattcttcatctttaattatgtttaatgctagatctagagtaattaactagatcttgaatcgagacaattgatatgcccgccataggtatctgtagattgatttattatttgatgagtctggtttataggtgtgtaataagaatcggcctatctactaagatgaacaattgaactcgctaagaatgcatatttaggttgatagtttctcggcttctccggttattattagctatagatatagggagtttcgcggtacgcccaccggttattccataataagagtttgagtttaagaatggttcgataacaacctagctttcattagatctactgaccaatagtttccagagaataccctgttcctagctctttattaaatcgttcacaacacaatcatcccgctgtctttttactttgttctcttttattttcactattacccggctagcttaatcttgacattcaactcattgtttgaacaaaagaactccgtgtatttgatcctaaaatactgcaattaatctcttatttgagagagtagttcaaggtaatttgaaccatatcaatgggctttatctccaagtgagaatggaaacaagcgaagcttaaaccatcttcactaactccattgattttagtaaggccacagagtctttcaaactcgtcaagatgatctagcggatcttccattggcaggccatgaaacttgttcccccgaaccattgaaatgagaccgcttttgatctcaaagttgttgttctgtactagaggtggaacaattccatgacgctggttgtggttgtgagggaagtcaccagcaccaatgttggtaggttgctcttgctcatctacaacgtcagccactgtgtcggtttctgtctgttctctcagttggcgagcaatacgatcgatgttatcattgaataggacgttctgattttcttgtgaccttgtatacatgcaacagatagcagccgggctataacagacgaatcagagatgcgtctataaagcgggttgcaaggtacctgaaaaacaaagacagaaagggcacaatgttagtaacttgtgtaacaaaaacgaacttgatcttaatgcttataatgatctcaaatatagcaaacaaacaccaaattggcaacggcgccaaattgatattaagattttactcaattaatcctaaaacactatcctgttgttgtagtattttaggttgtcaatccaatccgatgtgatgtaaacagatgagatatgattagaaagctctaattcaagtcaagcagagagttggttggttctaacagtcctagtatgcaataacagaaatgaaatgaaactaaaagcagaaatggcaattagaggcaggtgaataacaaatcaaatgataacaggctgtcaaatggataaacgattcctaaggatggggtaatcgaatagtgtggcctccttaatctattcaggcggtggacaaaacttcacagaagctatccctagacaacaagttcaacaacagattaattcactcccgtgatagaaatcctcaagaaaagctagacactgacctaattctaattagcgatctctaactaagcaggcaatatcaaatcaactcgttaaagccaataccctctctacaagctaatcccttggggtgaggcaaatatctctgaaattaatagatccaacgtccagtaaacgccttctgagcgctggacgtctggattcatattccacattagccagtgaaaaaagcaataagcgcaactaatctataagggattctagtattctaaactcaatcacctaaaacgaccaagtaaaccacaactactctatcccatcctcaaaaatacggttcactactcagacataatcaaagacaatagcaaagcaacgattgaaaacatgataatagaaatgatgaaagacttaaacaaaaactgaatatcaaatacttgaaagtgaaaatacaaagtcgcaggagaaacactgcggctatgaaagctgcgaaatgtaaaagttggatgaaaaacgggatgccctagggaaaaccctaagaggctacttatataagggaaaataaaacaaataaggaaactagatagatagcgaatcttcacgtcatgacccttgcgatcgagtgagatgcagtgaagacgagattgaatggtccaacgaccctgtgatcgagtgcgatcgagtggtgatcgagtggttgctttggcttctcttctcttcttcgttctcagcttgtctggttgagtgcagaacgagcaaataggcctcctggtgatttgccctggcatggctccgaggctgcgatagagtacttttgctgaaggcgtcattgggcattctgactttctcttctgtttctcctctgtttgaactccaaaagcatccaaagtacctgaaaacaaccaaatatgcaatacacatgcaatcctaatgcaaaatcatcctaagtatgcaaaacacaccaaaacaactcctaatgagatgaaatgtggatgaaacaatgacaaagtggtgaagaatgaatgcctaaatcatgcaaaatattgacatatcagaagaggacgcttcgtttttgtcgtccacctcgggttcattctggacgcgcttccaggggttgttgtccccctcttcgtcgtcatcctcgctgtcggatgggaccacctcgacctgagcatttacggggccaggaacttgaccacgagtacggagatacatccgaagcctagtcgggatcctggctacgcagtcgaagttcctccactcccattggaaggtatcactttccatggccctcaccttcatctccactcgagcgatacgggcctcgagagtctgccttttgaggcctagccgctgcctctcatcgcacaagtggtgataattatcaacaacctaaatatagaaactgacaagcgtaaagagaggaagaagaagaagcatagtagaggaaagaggaatggatttcgaccttgtccatgaagtcgtacgcctctttttttcctttcgaaggaaagtggaaagtggcatggggaaagagaacactggtcggttcgaaaccatcgccggacagaaacagtgggctaccggggtcgagagaacagaccgtggaggcttcttcgttttccattcttgtagtgtttaccaagtaaatttttgaaatcatacttggagaattcggcggcagataagcttttatttatagagggttaggttttgtcttggaaccaaaaaatcaataattatggcgtatctgaatggtttaaaccatttttggaaatggagaaaaggtaattattgcatcaaaggcgtgaagctttttcctgtttctcgaggaacgggaagggaaatggcaaccgtcgcatttaagacgaaaatcccattaaatacaaagtaaaatagttaagcccaagcccaacaagtttaccgaattgactaaacccgaggtggggaatttgcattaaaaccgagctcagatctcgcattctgagagaaaggtctgatcaaccaaagaatctccaaacttagccacatggtcaaaagcatttaagagcggaatttgcaaacccgcactctatttttagcaagaccctctagggattaaagtgaaaaaggtttaaaagcctccttaggcataaatcttgttcaaacaaaaagcctctttaagccaaaaaacatacttatcctaataataaatttcaaattcttaaaagtttgagacaacccccaatttcaaagtggacgcagcgactagggatccataaccatctctagcttaacgtcagtcggctcggtttcattcggttcagtggtagggacttgctcggaaggagcatccggctcatgcccgacatcacattcatcatccgggatgatcaccgtctcattgttcacgaccagaggagcttcctgcaaaacatgatcaggttgagcaatccctatcggtatggtagacacctcggttgcagcaatatcaaccgacccactcgagcttggtgaaaacagctcaagtcaatcaaaacataggaaaaaagtataagtaaaacctataggtaaagagctttaataagggaatttaccagcccaatcaaaactagattcactcaaagggggtgactcggtgaagaactcctcaaagtgttgagggttggaggatgaagcgggaagagcagcaaggcgacttcgtttctcagataaaacagctttcagttcggacctttcctgctcctcagagaaatcctcctcgtgggtttggtccagtaagagcaagttgctttcgtgatccttgatgtccgattccagctccgatcttgtcttctcggtctgaatgaaaaggatagccccctgaatcaactccgttccgcgacatttcacctcctttatggcttttgactctgacttagccaacttggcatctcgaagcttgacaattgctttatactttgcctcaagttcagtgaattggttgttcaaagcataagcggctgattcagattcggaaagcctgccttgggcaaccgagagttccttttgaagtttctcgtgtctgctgtatttatcttgcagtttgcagtttgacttcatgagtttggaagagagatggttgacttgatcctctaacttttgcttagaactagaggggagtggatttcggcttcaagggtagaaaacttgcccttccatgcgttgatgtcctgttctctactaagcagcaacccatcgtaatgctcaaccatgtcgttgagttcgatgtttgcctgactttaagcaagtcagctcatgaaggaatagcaaaattaaaaagcatgaaagaagcaatactaacccgagacgagtgataaacatgaagtaggaagcgttcacggattgcaggacgccatctatcaaaagttggcaagatagcgtcttttcgggttttgaagcaccaaaaaacattaccctctgtttccattgctataaaagaagaggggataaaaatgtgttatttagagtacgaacaatgcaaaagtaaagaaagaagaagaagagggccatttatcaaacctgagagtgatttggtttgaggcacaagaacggtttttgatttcaggggagcatcccgagactcagcatcttcctgtcgaggagttacacctcggttagtcttctcgccactaagttgaggagggggagatgtgaccacagggggaggaggacccatcaatcgaggtggaggagatgacctaggagaacgatcagttcgagcctttgatttctctctccttggagaagagctacctcgggctggtctgtctctctttttgcgaattaagtcagcgactggttcgctactcaatccacctcggggagaggacaaggagagccgcgacgaggagattgtttcttcgaggcgaacggccaccatgacgttcagcggatctggccccctcggcgctgctatcgtcgactagcaaggtcctactatactcttttttgtcgatggtggacatgagaaatgtcttatttgcctcacaggcctcagccctcggtttggaaaacgttttgcgccaggaagcaagggcccgagctgacgttccttgaggtaaaggaggaggcaatggaagttggaggagctgtccaagtggactcattttgagcttgcgattagcctctataaaccaatcaagggtgaatgagttccagagggtttccccttcaaggacgattttgaagaattttatgaattcctcggtcgggagagtttgagcgatgaaagctacgaagtgaaacaacagatttggtcagtaaaaataaaggtgaatagagaaggtatgtgtgacctaatttctaccaggcttcacagaccacttcgatgggagtgcatcggaaagatttctgattgaagtaggggttttcttaatcaaaaaccaaggatgatgttagttttcatccttgttcaggagatgctagatgaggtttctattagcgtttgggtacgccgagaaataccccgttttgttcgatgaacttctcacgctgagaagctcgttcagttcggggaccccgataacatatctggcttccgccgcaatagttatgattcccaagatagttttagagaaggttgggggttagctgctgtagggcaattccaagagcctctaggtaacgaactagggcttcgggaagaggaaaggtcaacccgcagcccttaaaatagatctcataaacgcaataataaccggggagatggtcctccagggactctaaggggtaaggcatcttcgattccaccataatctcaagcggaatccggcagagatccttcagtcgttctagggattgaagggtgcaagtagatatatagtgtggaccggagatattgttcgggcgagtgcatatgtcgctgctagaaccccctcatcgaaggacatggaagagagtggaaaaatcgagcacttgaagaagagaaggtttgcagagaaaaaagagagaaaattttctttctaaaggcaaagcgtaaaagtaagaaagaaataaaatgaatttacctcacgcaagatggtggtgatgatgaaatcgcctcgggagttgtgggggaaatggaagagttttcccgctttaatagtagtactgaagatgcggtcataatggtgatagatgtcatacgggtaaatacggacaatgccggaatcaaaggagtaaaaaaggttttggtgggaaataaaaaagtcatttagcgcaatctttgtccattaagataataaagtcttccgaattggacaagcacttcgagaagacttgggggctaattgttggtgtcggatcccgcaccgaagtttgggacctacgaaagattgccacgtagatgaaaagtaagcccacaaggagtaaggcccataagatacttgggaagaaggcgagttatgggcgaaatgatcacaccgcgaggtgggggcaaagtcgaagtcaaggatgggctgggctttgtcggttaaaaggcgaggcccatgaagatcagagtcaattcaaattcaaacgtttgagcaatgaattcgaagaccgaaacggacgcatttaagagagtataattgtgtgtaataaggaatttaatgtcatttgtgagtataagtattagggcaagaagccatggaagacacacacatttttgttaaaacttaccatacacatttttcataccaactcatagttttttccataatacttagctctttctattcaatttttgtcctcaagaataatccttctcactaaacaaataaatatttgagtatgtgaatccgacattcacatgtactgttgttttgtttcctttattttcagctacttagctttttatttttactcttaatgttcaccagttatgccctctgatacttgccaaagcccataatcaatatgagggaaaactatttggctaaggatcatgatttatccatttagaataactcttttccgttaggatttttaatataaaatacatacaaattattggaatgctacaagtattatatacgagctctgaggagtaatgcgtcttactttttctctatacaaactcataaaagtatttatacataatctcgaacaactataagtacatgctggcgcagaaggaaaagctcaccaaattaagttgcttccttttttggctgaaaattaccagagtaaatttggcacgtcaatagtaaaaatatctcattgatttagttcaatgatgatttggtgtgcaagggtcatattccaccgcgtcgagaagaagaaaaaaagttggaaatgatattcgaggtacttcagaagaaaggtttatgcttcaatattcctatatgatcatgttaaagaagatgaatcctgttacaattttatatgttggaagttgatgagaaactatagtttaagtaattgttctttgtattggagtttccattaaaggcttccgagtcattaaaaagtgatcattatggattgaatccaccttaagattgcatatggtggaatgctaattattactacttatatattcctatttttactgtttttagctatgttttcgatataggtttttgagtttttttgttatttatatagttcttatagagtcttttcacgtattctatggagagggacaataatgtaaatatgaaaacattttggagcaaaacctgaagaaattaagccaaaagacgaattcactttcagatcaagtcgagagtgtcgatcgacaccagtttcggccaggaaaagtccatgacaccagttgaagatatgaaaatttgccccagaagacgattctatttcataattagtccctacacgtttttatgtcaatatatataattttaaaggtcattgtttagaccaaagttcttttctaacaaccaagttttattctaaaaagctatagagtattttcataagctattcatcccttgttttcagagatttcaataacagttaagagatcttttctaactcttttctctattgacttgtttctgctttctcactcatacatgttgtttgtttcatccatcatgtctaagtagtcttcttgttagggttagggtttctcactagggattcatatgatttagtagattgcccttttgctaggttatatgtaggattcttcatctttggttgttcttaatgctagttctagagtagctaactagaacttgattttaggtagtaggcccaccataggtacttgttactggaactactatttgatgaaccaacgtttataggcgtctcgaataagatcggtttatatcctttggtgaaactatcaaattcatttagaatgcatgtttagttataggatttcacgacacatcatcgaaaatcttagatctatgcatagtgagtagcacggcacaccaccggttattcgataattagggtctgagtttaagaacggttcaataataacttagctatttctagatctactaatcatttgtgtactgagaataccttaaacctgacgttttattatcttgatttacaaccaactgacttgctttttgcttactttgttttcttttattttattttactcatctagcttaatcttgacactttagtttattgtgtgaacaaaataactttgtggaatccgacccttaagtactatcgacgatctcttatttgagagagtggtcttgagacaatttgaaccatatcagctacagttcaggatctcgatcatcactattatacgatagcttttgtataattgatggtgagaaagatgcaaagtggacttgatttgaaaaagctcaaatctcttatacaaaatagtataaaccaaattcttatcaaggcaatagctatggtcaatcatttgtctcaccatgagcaatattttcaagaaagggtttacacatatttctctgtttactccaaaaaccctcattcataattactaacgtaagaccttagtccattaacaaaacaagtttactaacctaatgagcataaaaaccaaacaaatttacaaaactacaattttttaatttaaattgagatttcacaacaattaatttcattaggtaattttatatctaataaaattcttgtcacattgctaatttagagaatatggaaatattactttgaaatgagctttaatggtagataaacacgatggaaaagaaaaagagaatagatatggaagattcaatatcgaaactgaagaagaagtgaggagacgagatctaaaatctccaaattatgtttgttgaataggaaagaggagagggagtgtttgttattggttacttttatttgttaatttcttaatttaattgtttgttttaaaaataaaatttcttataaaaagaagaaaggaatttttgaaaatggatttagagcaaaatggctggagatattaaaattcgacaaccaataatagacgttttcatagcacattaaaaaattagcgcaccatacaaaaattgttttaatatttgaaatatcactctaatgtgtatagagcactctaatgtgtatatagcactctaagaccatctagcactttgatcttatcactatatcacttcatcaccaagtgacttcctccccaagtctttctttcttatatatatgttgcttcattgtaaaaactacaagtagagaaagaagtaaacgttggcaagagagactagaagacgaagagagttattataagtgtttctacttctattactttgttccccgtattctcttgtctctctctaccattctttcccaaatcatataataacataataataatttgtttgcgttatattttatcatacgttatttgcacgatcgtcttttcgtatgattgtttaacggaccgatcgtctatttgttcaagcatcttttgaggtaacatttgaattatgttaaattcatttgatatcatttatataatattatatgcatgatatttttggagtatgaggctatgcatcttccttaatcgaatggtaggtcacgcctcttcaaaatgccataaatggcttattaattgaatgattatttatttatttatataattatgtcaaggcttcctaagctcgatgtcgtttctcttgatttatctagcaaaaattacatgacatggacatccgatgtaagaactcatcagagatcaattgggctttttaataccaaagatgcatctgaaatgacatcatataatagcaaagcagctaaagtcatggtattcctacattatcatctccacgatagtttaaaaaatgaatacatcacgagagaagagcatgtggatctatggcaatcacttaaaatcgttttgatcataaaaaaatttaattttgccaaaagctagatattaatagctaaatctctggtttttggattacaaaagtgttggtgattataattccgccatgttcggaatcacctttaagatgatattatgtggtgaaaaagtgagggattatgatatgattgaaaagacgctctccaacttttatcctggaaatgtaatccttcaacaacaataccggaccaaaggatatactcgttattctgagttgatgcaagtcttttggttgctgagcaaaataattagctcttgatgatgattcatttatctcgcccacttggatcaactccacttttagaagtgaatgttgatacatctagtgatgataattggtgaggacacgggccttggctaggttgtggttgtagttgtgggaaaggtcgtggccgttgtcgtggccgagtaaaagaaagaagttctcatcccaatgatttgaacacggaaaaaactaacagaaatcttcaagtgcatgatgttggccatgttaagaaaagacatgttgaaagcatttgccacatatgcgtcataaaaggacactggtacaaaatgtgtcgtataccataacatttagccaatatgtatcaagtctcaaaaaggcaaaataaaggaacgttgaaactaatctcatatgtgatgagccgggacctccctttaaaggccaaaatgatgatactcatcttgataagacagattttctcgattgatcatgacaacgaaaagtcaatgtaatagatttagctatatgtatgatcatgttatgtatgacaagcattatagatgcttttattttatgggataatgttgttattatcatatactacgacatataaatagtctatgtcaaagttttagtgaataaatattttatcccagaaaaatgtcaaaaaataagattgaggatgaagatatttgtctggcgaatagtgtttctacgcgcacaatctttaaagataaaaagtacttcttctctcttgaaataaaagactcagctagaagtgtgagtagtatatatggccatggaaagattataattgattttagcgaagccaattttacaatgccaaggggaactcattttaaactaaatgatgcattatattctcctaagtctcatagaaacttgaaaagtttcaaagatatccaaagtaatggatatcatatatccacacaatataaacgttgcaaagtacacgcaattttgcgatgaaatagcatcaaatttttccgacgcaatgttgcgtcgaattagcatcgaacgtttccttgcaacttcgttgctagttagtgatgaatacgcaagtaagtgtgtcatgcagagcaaggaatttgcgagggatagttcaagaatccagtttaaaccctgtttcacaaatttggttttctgtttgaattttagaggctaagaccaatcggaaaaaaaaaactgaaatcaataggaaatatgaattctgattaaaactgaaattgtttgatgttctaataaagaaatgcatagaaatatttaggttttgattacaacaaaagaaagcaaaataagtagatcatattatgcttgaggagatggttgaactgctgctagttcagattgtgtttggtctcgtggttcctctctttgctcttgtgctccttgtgttgtagatctttgagttctaagtgttgttgctatagctggacaatcttcagcaataaggtcaaagaaataatcatacccttggatccgttttagaagtttgtcgttccgtttcttctccgcttcataggtctcctgatcaacaaaatcatccccagcatgtcgatcaacaaaagcagatgggataattggaatagaacctacaccataataccgtccctttttattctttggagtagcctgaataatcaaacaaaaacagatgcatatcacaaaccacataacatttcaaagaactatacttaaaaattcaccaaacccatcatcaccaaacccatcatcaaacaattgatcttaatagctcaaaaggttcaatgatgcaacttatattcaatgatgcaattgaataagacttaaaaactcaaacaagattgaaaaaagaagggaaaacgtgaacaactagcatgttgcagtttaataggctgagacagttcaaaaataatacctcgaacaggatttgatcctttgatgctgttgataagccaccaggctggccagaatcacctggagaaagctgagactcctgctctaagatcttggctgaaacttccttgcaaatttgctctacaaaaccatcaatgaaatctccattctttctcttgtgagtctgctccatgatctggacaattggagggagttgacctccattcttcttagcctaacatgaaagttaaaatagtaatcatcatcatgaagctgggaaaatgagaagaaaaagtgaaaagcataaattacttacactttctaatgcacgtttagcgtatgtcttttgacctgaggtgtgtctactcggaccatgaccggccacactagtgttgcgagattttgaacacttaccactttattttcagactatggatcaagccaaaaaactttgaggcccttccatacctcaggattcatccacataggcattgctttatcacctgtttccttctacttacttttccacttgcgaacaatatcacacaagcggattcctgccttaattgtaaattgcctcttaaccaattcgttaattgagttgtcccaattatattgttgttgtgtcaaggaaataaaagtaattaataccgcaaacctacttctacaaatcaaaaacagaaatctaatcaattaccgcaaaaatgtgaaaccaagtgtcaacaatcttcttaggtgcctgtgagatgttagcgtgaggttcagtgaagtatcatttgatgtagttagagaccaccttcccaacttcattatcaacctcaaacctacaacagactttagtaacttaatgatgtcattgaattgaaaaatacacattatacaattaaaggagttaccaatgtgttcttggaggacgtttagggtctagttttgtaagtccaaacccatttgatattgagcttgaccttcaggtggagaaggagtgtgagtagaattctgaaatgtctcttgaataggagtgttatgtggtgaaagagatgggatgcgttgcaccggttcagttatctgaggacaggctcttgttgtcgaatgaggagaggactgtgaactccaagcagcagtagacccattagaccgttgtcctctattactcgtaaagtttctataatgactcattccttgcatctacaattataaacaccaagagatatgaaattttagctattaagtttctaaattcaatattcagaaagaggaacaatcgtttaataatgaaccaaggcgttgaagtcaaagtaataaatcaaaaataaaagtgaaaccaaaaagacagctctaagcctttactagtaccatgagtgaatgaaacaagttacacaacagaactaaaaacctaggaatcaaacttacaagagagcgttaaacaaccaaacaaaaacataaagattttcaatttctcaatccataagcacaaaaagaagcctagacataaaacaacaaaaaagaagcatcagacaatcgattgaccatgagtgaatgaaatatctagaaaccttgattctaacacataaagagccacaagactgaactttatataggccttgcaataattctagaaatctaaacaatggcagaacggtcaccggactacaagaaaacaagccatttgcgactccaataaacgtccccagacggtcgcaaacaccttagtaaagactactttgggactactttaattggtcgttaaaaaacggtcgcaaaatctttcggttttaatatagtcgccaatttgtgacaatttcctgacaatacataacagtcataaatacgcgactaatatgtgcctcagttataagttactcttttccgacgtaaatgcaactagttttgtacgtctatgaaaaaagaaccatggtcccaaagtattcgcaaatgagtattggttttgttgcgactaactgtagactctttttgcggtcacattttagtctcgtatttctaaatgtttaacctcgaatttggtcacactgttctaattggtttggtcataatttagtgacaggttttggctaatcataaacctaattaattaccaaatttgaaattttagtaatcaaactccaattacaaagattaaaacccaatataacttagcattatcatcttaaacagacaaaagattatcatcctacaataagtttacaacataacaatatatgaaaatagttcatgagtttcagaaagcattagacaaaggggatgagtttaattcgctgcctgctggtatggtggctgaaggtgtggagcttgctggtatggtgttggtggctgccggtgtggtgcctgttggtatggtgttggtggctgaaggtggtgtagaagaggccagaaaagctactaattctggatctttatctttcatgtacagaacaagcatctcgaagcctgagatccgcttatgagattatcgttggtcctcatcccgtcttgcattctcagtgtcgtgctcagctatcttgcggcgtagttgttcttaaagtttcaaagctattgatgaagaagagcttgcataactttctttcattttccctttgctaagtgtctgcacaagtgatccaagaccaaaatggttgcccttttgatctttttcagtacactaaaacaaagagaaaccaatgcaaagtcaatcaacataacaggctaacaacaaagtattaaaattagataatcctatgatgcgatataaagtgaatgattcacatacaaattaagggtgtcatagaaactatacctggagaaagatctcattcttttcttcaatacagaggtcacgatgagttgactgttcagaggaattcactgaattttctggaccatcatcatctatttctatcagtcgctcttcacatgtcttcttataaatctcaggtactttttcagcttttgcatcaacatatgacccgtcagctcgagtgtgtgttttcataaacacttccccaaatgctacagggcgcccatatagttcctcctacaatgaaattgaaacacattaaaatcatgtaactaatataagaaaatagtgaattgtttggatgactattagaggaatgttaccaattcttggtgaacttgcacaaatgatttctgaccggatacatgtttgtgtggaccaagaccgccacgaccggagtttctacactgtgaagcactttcactcctcaccattgcctgactggtgttccaatgaacccacatctgattccaaagtttatcacgaatcaaaagaggttgtgaaccactcctcttagcttgactaataatgcccttcatccgcttctgggctatcacttcgaaccccgctctaacagcctcagtaagcccatgatcccaatagaacatccgctacatagtacaaataaaagagataagttagcacatatacttagtaaatgagtaacaatatatatttgaaagataaaactgaaaattttaccaggaaactcctgaaatatctctctcggatgttcaaaggagtgaccttccaaatgaagtatggaccatcaaatttcctcctaaatactccagcaatcgccctagatagtttacctttatgcctgttaaacctgtaaaaaaacagagaagagaactaatctctgtaaagacaagaaaaagatgcatctctagcaaaaacagagaagagaactagtctctataaagacaagaaaaagatgcatctctagcaaaaacatagaagataactagtctctataaagacaagaattcatccatctctagcagtaactagtttacctttaatgctaactttttaaactctagaacacatgacaaatcacaagaactaaagtaactagagattgctctaaactctaacagtcgtaaaatgtttgtaagcgctaaatgtttttatgttttgttggggtcggatttcacccaagtacctgagccggtcaaatggataccatcagcacttcgggagctaggcttggtgttgttccggttcgggtgttactcaaggaaacacaccctaagccgggtgcgatgaaacattgtgacccaggggaacaccttagataaacgatacttggctcgggtgttattccagaaaacacacctgagccgagctcaactatatctcggggatcgcttcggttcgagcccaaggtagaatatccacccgaggaggatacttatacaaattcagtgaagggtcaagatatcatttccgaaaaatccggtgaagcatatcaaaaaatctttgggatattatcgaatatggaagttttccgaaactcccaaagaataaggaagatttccatatagaaaatatcccctatcgccgacccggagataactggaaatcttccgaggaatatcgcgagaggcgggttaccaaggtcctatataaagcgcctcgaggaacgaacaaaggggacacgcataaagacgctctcaacttcaggctatcaaaacgctctgactttgaaggcaaaacacctattttttacttttctaaacacttgtacgatcgaatcatcatcttttcagtaataagatcaagagcaccgtccacggtaatcaaataattctgttgttctttgagagtctcacaaagatctgttctttgaagaaaccctaaatacaatttgactatgtgagtttcgactcgcacaattcggcgctagaaggaggggaaagagatttctcttactccaagaacacagaaccgatcgatcgagcaacgatgaccaacaaccagatccccgctaccaccgttgacatggagggaaaccctgttcctccaatccagacaaatgctcccgaagtcgccgctcccgcagtcctagcaggactgagaagcatgatggcacaactccagaagaaggggaacgaccaagagcaagcaaaccgattcttggcccaacagctcaaagcggctacttctcaaggacaggtcaggaccaatcgcttcggcgcacgacactttcctgatcggcgagcagcggcagatctcaatccaacaagacttgtgttcaacacaccaggtaacacaacgaggccatttcggcaaactccttcagggctcggcgaaacccgagcagaaccagtagcctcgggagagaatatgatggattaagggaaagaagccgacccgcgggatccaattccccgagccgaagttgacgaggttgaccagatcgaagtctccgatggcgaagatttggaagaaaacgttagatgggctgaggaatacgctaggaagctggaaataacgccatcaaactctccctagccaaggcggaaaccgagatgaagctcgtacgatcacagatgcacaacgcagtctcctcagccccaaatatcgactgcatcctagtggaatcccacaacacgcctttcactcgcaagatctctaacgcgataatttcagacccaggaaagctaaggatcgagtacttcaacgggtcatccgacctgaaggggcatttgaagtctttcataatctctatagcccgagccaagttacggcttgaggaaagagacaccggtctctgttatatgttcgttaaacatttgaaaggaccagccctagattggttctcaagactcgaaggaaattctgtcaacagttttcaggagctatcgacgctcttcctcaagcaatactcggtgctaatcgatccgggcacgtctgatgccgacctttggtcgctatctcaacagctgaacgagacacttagggatttcctaacaaagttctgatccaccctagcaaaagtcgagggaatcaatgacgtcgcgactctctctgctctgaagaagggatgtggtacaagtccgaattccgaaaggagttaaatttgtccaaaccacaaaaaatcttggacgccttgcacctgagcctcgaattatgttctcatgaggaagaaatagaatggctgtcgaaaaggcacgagccgccgaaccaaacgcctcgtggcgaaaaatcccaaccaagcgctccaagccataaaaagggcgctcaaggcgggacattcgtacaccatgaagggcgaaacttctccggagcccacaatcacaagccgatacacccctaggtcgagggtgagaccatggccaaggacgtggatgaaggatcaacccacgggaaatgagcaggagtactacaagttgcacaagagctacggccatcacacttctagatgtcgtagcctcggtgcaaaattggcagccaagttcctaactggtgaaattggcgggggcttaaccattgaagacatggaaccagagaatgtgaacgttaagcaggtaaacaccgtggcaaaccctgaacaggcagtgtagtgaccctcgctaaagggtaagcggccaaacgggaaaacatcaaggaacgaccgaggaagaattagaagagaaagaaatagttaaggaacgaaagccaaagagatgggcaaggtaaaaatgaacttggccaattctagttcaaagttgggtcatctaggcgaagccaaaacgagaggaagttgccccgcgtacatggtcaattcccatatgtgcccaaaaggtgttaaaccatcaaagggaaaacaaaattactatttgggcaaaaatgggcaaagatgggcaagaatgggcaagattgggcaatacgggcgtgccgcgggcaaagtttgcccagacgggcgttgaccgccctttgaccacgccatggacacgtgggctggcttacttggagcccaatcaaagttgcttgaagccaaatttaagaggattggagccgaagtttccttttccacgtgtcatcgtcccatttctacagcatatgtgtctccacgggcgggcgacatgtgtcccgcaaggtgtcaccacgagatgacatgcgtttgcttggtggccaagctgtcccatttataaatacttgaccaaactcgagccatttgatgagagaaaggagatagaaccgaaaggctgcccgactcataaaaattgcctttaaccgagagaaaacttgcccacaattgaaaaactctgcccgtgactaagattctttgaccgtgagggaagaaatcatgtccgtgatcgagaactcctgcccatgagcgagaaatccatgctgttattctgtccgatcaagaaccttccgaggaacccgtcccataaatgtttattcggagtaaagcttcatgaatcaaggctgcttctatcaagaggtgttagatcaagatgaggagagttaaatttagctgggatcaagattgggaagccatggaatgtccgagaatcgttgaagctaaccttaaaccttcaaccgaatctctgtgagtctcgaagcgtgtgatatggcgcatgataggtttgagtgtttgtttgggtgattgattgattttttggttgcatgatcatatactcttgcattcattgatttatttcatgaattatatgagtattgattaatggtgtgatggtactaagccgcatattagatcgtttaaattcttatgctttaaggcttatgtttgggaggttgtggtgagtaagaatattgatgattctatgagtttgagtaacaatatgtctcataatatcttaaatgttgggtcttgatacgtggtgctcgtggtacgaggcagagatcataagcttatcaagatcgtggtatgtctgaccttcgtagtgaaccgtgctattgtgggatcttgttaacgttgttacttgatcgccacttagtgcaaagggctcggagagacggggctagctaccctggccgagttgtctacacgacggtgtagcgttaggtagggatgctctggttatatgcctttgtggttgtaaagcgagagatcccgagagtttgtgtttttggtgtgggagtgtttgaaggcaacatatcgggccctatttaaaagacttaataaaacttgagtcttagttgcatgtgcatatttttggtagatgcttcggcaagctaccttttgttgttattctctgttgcgtgtttcgtgttatgataatgggatggggaactaatatctgttgcaggtagaccgagctcactaagtaatcttagattacttatgactccattttgtttcgcagaaaaccttagtgggaaccattaaagggatgctcacgtaggaacgccggtatagagtttgttgctttttgcaaaacttatgattatgatttttgttggatttgagcgtgtatgctcaagggcccattgttgaaacgttttggatacttggttgtctgagaaatttctatattataaaaaattattttcatataaagagtgtgtttcatgcgatattagtcttgttcggactgacataactcacgatcatggcaagggttgaaaagcctaaaccgcgttcgtgagggatgttcatgtggataatctggctaagggtctaaagccatttggaacctaagttgggttgtccgtgttagctatcaatgtagcgtttctgggttgcccttggcttgtccggccatagagcgattcggggtacaatttttggtatcagagcatggttcatgatgctcacgggacacacgttttctaaaagttttatcgagtaaatgagtcgtaaaagcaactaggtaaaccggtatgtcctgagttagtggggaatgggttaggtattacccttgtcgttcttgcaattgtacatttagattggaccgagaatggatggccgtggggaaccgcaaccaaaattatgaaagaggtgaagcattgtggccgagttcagtaacaagggcttgtaactcaagtgaggtcaagtggagaagcgagtgagtggttttggagaaaactaaagaatagtgaaagagaagttgagtagaagttttggataaagagtaagagccaaggtgggtgatgagatgcgaattgtagaggacaagagccgaaggtggaaagatcatttctaaggaaggaggaaaatggaagatgaatgaaatcatttggaagaatgatgagtaagacttattaatcagatttaggcatgagggaagtgatgaagctgagaagaagtaagtgattagaaggaaagagatcatttaaatgaagagtaaggagcataacaaagaagtgggtgaagaagagattgagtactgggggagcaaaacaatttaagagacataagtggtgatcacaaatcaatatatggtgagtaacgatgaagctcaagaaaggagatggagtatatttttgggatcattataaagggaaaaaggaggcgtaataagacaaggtgaggtgaattaaaaaatcgagaaggtgaagtttgatcaaagtaatatcgttatcggagggatgtgggaagaaaactgagcctaagaatcaaatggtaatgttcgaagaaggatacatgatcagagagtaaacgggtgtaagcgggatgatcaagatagagataatgcaagaggattatcgagcgagtaaaggtgcaaggtatgaaagatccaaaacttaaaggagaaagtcggtacagaagagtgatgagttaagtagttcaactgaagccgctaaagggagaagtgtacaaaataagaggaggttgtagattcaaagaagatgatgagttaaacgaagttaagattggaagcatcgtaaaggtaaatatgagaacgaaaggacgtagtaccgaaaagcgtatcaagatcgtggtatgtctgaccttcgtagtgaatcgtgctattgtgggatcttgttaacgttgttaccttactgccacttagtgcgaagggctcggagagacggggctagctaccctagccgagttgtctacacgatggtgtagcgtttggtagggatgctctggttacatgcctttgtggttgtaaagcgagagatcccgggagtttgtgtttttggtgtggggtgtttgaaggcagcatatcgggccctatttaaaagagttaataaaaatggagtcttagttgcatagaccgagctcactaagtaatcttagattacgtatgactccattttgttttgtaggaaaccttagtgggaaccattagagggatgctcaggacgtaggaaagccggtatagagtttgttgctttttgcaaaacttaataattatgatttttgttggatttgagagtgtatgctcaaggggccattgttgaaacattttggatacttggttgtctgagaaatttatatattataaaagattattttcatataaagagtgtgtttcatgcgatattagtcttgtccggactgacataactcacggtcatggcaagggttgaaaagcctaaaccgcgttcgtgagggatgttcatgtggataatctggctaaaggtctaaagccatttggaacctaagttgggttgtccgtgttagctatcaatgtggcatttccgggttgcccttggcttgtctggccatagagcgattcgggggcgttataggcagcccccacggcgaaccttgaagggcccaagagaggcgaggcaaccgcgaggtggatgatgacgagccagaagctgctcgagggagaatcttcacgattttgggagattcagctttttgtcaagacacaacggattcaatcaaagcttatcagaggaaggccggttcaaactgtaactggacgcggtcatttaacggaccagacgacgaagtcactttccatgagagcgatactaacggcctgtatcggccgcacaatgatcccttggtcattacaatgactatcagagatttcaatgtcgagcaaattttagtcgatacagggagcacgctggacatcatttttctgacgaccttgcgagaaatgaagatcgatatggcgcaagtcgtaccgactccacgacctgtgctcggattctcttgagagaccaccatgaccccagcaccatcaaattaccagtccgagccaaaggaataacaaaaatcgtcgatttctccgttactgaccagccaaccgtttataacgcaattatcagaacgccatggctaaatcaaattcgagccgtcgcctcaacttatcatctctgcctgaactttcccacaagcaacgtcgtgaagaccatctggagaaatcagaaaagtgcccgaattcgcttcatggcagcacacaaacttagaaaccccgtcaccgaatcaacagccgacgcaaatcacaagaaggctaagttgggacgagccgaagaaaaagcaatctccgagcagttatagcaactaaagatccgggaatcaacgagaccagtttctgacccagtaatatatgtttgtcttgatgaggagaacctcgaacgatgcgtggaaattggcggagatttgggcgaagaggtgacgaccgagctaacttctttcctcagggaaaacgtcaacaccttcgcctggtcctcggaaaacttgcctggagtaagcgtcaaaatcgtagagcacgagctcaacgtcgacctaatgtttaaacctgttaagcagaagaggagaaagttaggtcgggggctgtgagagccgaggtagagaaactgctaaggatcggctccatcaccgaggcgaaatatcccgactagcttgcaaatctggtcgtggtgaaaaagaagaacgacaagtggagagtgtgcttcgacttcaccgacctgaacaaagcctgcccaaaggacagtttcccactaccgcatatcgatcgcctcgtggaataaacctctgggaacaaattgctatcattcatggacgctttcgctggatacaaccagatcatgatgaaccccaaagaccaaagaccgatttctacacagagcaaagaattttttgttaccgagtgatgccattcggacttagcaacgccagggcaacttaccagcgtttcgtcaacaaaatcttcacactacagatcggaaaaacaatggaagtgtacatcgacgatatgctggtaaaatccatggaagaggaagaacacatagcccatttacgcgaatgtttccagcagcttaacctctacaacgttaagtttaatccaaccaaatgtcgcttcggagtaagattcctcggatatctagttacgcattgcggcatcgaggcaaatccgaagcaaatcgaggcgttattgggaatggcatcgcctcaaaacaaacgcgaagtgcagcatctaactggaagagtcgcagcccttaattgattcatctcccgatccaccgacaaatgcttggctttttacgacgtgcttcggggaaataaaaagttcgaatggacaacccgatgcgaggaggctttccagaaactcaagaagtaccaagcgaccccaccgatcctcgcgaaatctgtaatcggagaaccactctatttgtatgtcgctgtatcggattctgcgttcagcggagttttagtctgagatgacagaggcgaatagaagccgatcttttacgtctcacaaacatttactggcgcagaatctcactacctgcaaatggaaaaacttgcgttagcagtcgtaatgtcagctcgaaagctgcgaccctatttccaatcccactccatcgtggtaatgggatccatgccgctccgcgctgtcttgcgtagtccgagccaatagggtcgtctggctaagtgggctatcgagctcagcgagtatgacatcagtatcggaacaaaatgtgtgcaaaatcccaggtcctagacgactttatcgtcgaacaaaggaagctagggagaatccgctcgatacaacttgacaactacacgtggacggctcgtcatcaaaataaggttcgagcgtggatctccgtctcacctcacccacgggcgaggttctcgagcagtcattcagactgaatttcgaggcaaccaacaacgtggccgaatacgaagcactcgtggctgggcttaatctagctcggggactgaagatcatgaaaatctgagctttttgctcctcctagctcgtcgcgaatcagttcaacggatagtacacggctcgagacgaacgaatggaagcctatcatgctcatgtacaagatcgggtgaaacagttcgacgagttcgagttgacaaggattcctgaggggaaagtacgtcggccgacgccctagctgctctggcctcaacatccgacccaaacctgaggagattcatcccagtggagtttatcgaaaagccaagcatcgagcttgacaaagaggaacatgccttccccgtacaggttgtcgcgggttgcgaagatgcttcagatgacaggtcggaccttggttgcaattcagaatggatagaacccatcagaagctacatatctgaaggaaaagtgccctcgaacaagtgggaagctcggaagctgaaagatcaggctgcgcgtttcgttctggtcgaggagaaactcttcaagtggcggttatcaggacccttaatgacttgcgtggaaaaagaagcagctcgcaaagtcatgaaagaagttcacggaggcttgtgtggaaatcattccggggaagagccctagctataaagataaaacgccacggttatttctggccagcgatgatcaaggattgcgaaaagttctccaaacgatgcgaaaaatgccaaaggcacgcaccaacgatccatccaccggccgagctttatcaatcgcctcaccatatccatttatgcgttggtcgatggacataatcagcccgatgcacgcctcgaagtaaaagaagttagtttttgtcttaaccgattacttctctaaatggatagaggccgaatcgtacgccagcatcaaggacgctcaagtcgaaaagttttgtgtggaaacacatcctatgtcaccacggtatcccttacgagatcgttacagacaacggctcgcaattcatatcgacccgcttccaaggtttttgcgataagtggggaatccgtcttagcaagtcaacaccacggtatccccaagggaacggtcaagccgaggccgcaaacaagacgatccttgacggcttgaaaaagcgactcaccgccaagaagggctcgtgggccgacgaactcaaaggtgttctatggtcacatcgaacaacgcctcgtcgagccacaggggaaaccccattcacattagtctatagaacggaatgtgtgattccagccgaaatgacagtaccgtgtctgcggcggagcctgtctcccgagcgcgaaccagataatactcaaaggataatcgacgagctagatctaatcgatgaacgaagagattcagccctagtgcgaatacagaattaccgacagcgaagatttcatgaaggagaccgagttctccgaaaaatctttcaaaacaccgacgagccgaacgctaggaagcttggggcgaactgggaaggactatacctgatctctaaagtcgtcagacccgcgtttatgaacttgccgatctaagcggcaaagccattccaagatcttggaatgcaatgcacctaaggatatactacaactaaatccgaggtgactaaacttgaactacgaggtggcttgatccctgaaaagggtacgtaggcagctcgtcttgggatgagttcagctaccccccccccaaataaaaaaaggggggagagggtccgtatatccatactcccattcattatttattttgtaagtttccgacttctgcataaataaaaatccatttcccatttctaaacgcttcggttaatacgatgagcgacggctcggagtatcttttatgcttgctcggctatagcgcactatataagtacgagataaaatctgtcagattacttctaaacataattcttttatcttcagaaacctggttatactctaaacactggtaccccagcacatttctaaacgctggttaagaagtgaatcggatcagatcacaaccgagaagtttcactcaaaagtcctgttctttcacactagccccagtcaataaaacgcttcgggaacgaatcagtttttaaaacattcaagcaaaaaaaaatcccaagcataagttctacaataataagtggataaagccatccagacataggttctatagaaatacggataaagctgtccaggcgcaaagtctaaagaaaaacgccacgggtatctactcaagcttttcagtcgggagagtcccagcggcaagcagatacgatccagactgatcggtgacccccacttcatctgcgagagtctcgaccgatctatgacctccagggcttagaggagcaagctcaggagcaggggctttgagctcttccttcaactcagacgggagacgaatgagattcacctccgcatcagcgaaatccctgagccaatcctcaacctgcttcttctcggtcgccaaggatccaccatcttcaagcgccttaatgagctgtgcattggcccccgcttgggacaaatacataaactgatcgttagcgtcctcgaagagcgacattttctcctccacctcgccgtttgcgcgacccgagccacttcgctgtccttgagccctttcgcttcgacgagcagtcgcttgcaacgaacaacctcagagtccatcttcatgttgcgctcggccaccctgatcgcattctccttattgacaaaggcctctttctcagccctttctctcgccagttttgcctcagtggcctcggcgatcgccgcgtctctcgccttttcggcctctttcgccctggcctaagcctcagccaacctattaatcgcctctagattgttccgcatggccgtatcataagattggaccatccggttcatcgagccaacaacctgatacataaaaacaggcatccacgatcataacagctcggagaacacgccaagcatctaaaatgaataacatacttacccttagaaaatataaagcagtctcacgtactttctagactctagcagagtatctggaggcgggagcaggcgaccggcgcacttcccgacgagattcaccaaagtagccttatcttcgaaaatgggaggctcgtcatcctttttgctaccttcttcttcttcttctttctcttcttctcctcggaatcgtcgacctgtggacgcttccccgaaaccttttcaccagctggaagtgcgacgattgcttgcttgcccgcttataccgacagatctgtcagaaccgcatcaatgccatccgcctcagcgggctccgatgcggcgggcacaacagtttcaggggcaccttcccgatcctcgactgcatcgggatcgacactctcaccctcagcagcgcgtttatcatctgaaatacgcttctccttggccgcatgtttcttctcggctgcaagcctcttcctttcataaacctcccttatggtaggtttgctggtgtgcatatcgacaaggaattgggttcgctgatttgaagattccgagctggaagggcaagaaacaccatgaaataatcgaagcgcccgttcaactcgctctcaagagaagtgctttgtccaatggcacttccgggccaacaactcttgatgacacgagacgagatctacgggacacagctcgaggaatcgaattgggcgatctgcgataaagaaaattgtgtaagcaaagggtcgtaacaatcacctcaggcacgaatgaataaaccataaaatctaaactacccaaagtctccatttcgtcagaactttcccgaggagatcatcaagaatgacatcctctaaggccacaaagaagaagtgatcggtgtaggcgtcatctttgctcaggaagccttcgataattttcctacctttagcaggagaaatataatatcggtccaccacggacttcgagactcgccggatctccagataattcctcagattggcaaacgtaacctcggtttcggtctcataaccatgcaccagtatcccaatgagatgcctcaaagaccaggccgttatctaagagagagctatctgataccaagtcacgttctcttggattagccttggaactggcaaccagagaaagcaaagataaaagaatccctcgtatagagtgaagaaacctctggaggattgtcaacgctcatctgggctcggaacgcgaagagtaaccccatcgccaaagtcgaaccgagctcttaagtccgacagtgaccgctcagtgcataaagacgagccaggaggatttggtctcaccacctttctatttttcttccttttcttcttctcggccttctcgaaggccttccgctcaaacgctcgcacgatgttttccgtctcgtccggaccaaagtaaagatgctcctcgaccttaacttgggggaagaacagctcaggcacatgttgccaattcgatgctccggcctcgttaacagctgaagcgcggttctgcggatgagagatggctcaggatcttcaggtaaatctaactccggagcgatgtcagctgtagcatcctcccgagccaaaaagggcactgccgcctcggaagcattagaagatgacgctgcgttagtctcggaaccctcagatgaagtccagaccatccttcgcttgtaaattgggggaagatcatttcggtgatttgactcactagagtcgccgagaagatcactgggggacgaaagagaggcgttagaatgtgacgaactcatgctcggctcgaaactgtctgacgaaatgaggatcagaaaacgtaaattctctaactggagaaataaaaaacaactaaaaagcggcggagatctaccagaaaagaaagaccgttataagaaaatcaagatcagagaagagagaccaaacctcaaatttttcttcagaaacttcaagtgaacgatctcagaggaagagctcgatatatatagaggtataaaggtgcgtcgggtccaaaagagttagtagaatgcgtcaacggcgcgtgagctcgggaggatatagcacgtccgcgtgaatctcgggaacaagcgaaacgcttccgcttctcgaggaaaaaggcggccacacgcaatagaagtttgaccgtcccggaaactggaacgccaagagtcacgagtaagaagacgtacaatcagtccggttaacttatccttctggtcaaaaacaacgagcaggggggcaaactgttggggtcggatttcaccccagtacccgagccggtcggatggataccatcagcatttcaggagctaggctcagcgctgttccggttcgggtgttactccaggaaacacacacccagccgggtgcgatgaaacattgtgacccaggggaacacctcaaataaactatacttggctcgggtgttattccagaaaacacacccgagccaagctcaactatatctcggggatcgcttgggctcggcctggaaggcgcggcattcggtccgagcccaaggtagaatatccacccgaggaggatacttatacaaattcagtgaagggtcaagatatcatttcaaaaatatctctgggatattatcggttatggaagtttcccgaaactcccgaagaataaggaagatttccatatagaaaagaacccctatcgccgactcggagataactggaaatcttccgagaatatcgcgagaggcggtttaccaaggtcctatataaagcgcctcaaggaacgaacaaaggggacatgcataaagacgctctcaacttcagactatcaaaacgctccgactttgaagacaaaacacctattttttacttttctaaacacttgtacgatcgaatcatcatcttttcaataataagatcaagaacaccgtccacggtaatcaaataattctgttgttctttgagagtctcacaaagatctgttctttgaagaaaccctaaatacaattcgactgtgtgagttttgactctcacatgtttaatgctaactttttaaactctagaacaattacacttgacaaatcacaagaactaaagtaacacatcacaaataacactctagcacaatcacaatcataaatcacaaatcaatctctagctgctctaaacacatcactaataagatgaaaaggagagagatagattgacagagagcttctattaccagagagtttcaatgcatgggataggaaccttggacaaaacaggtaaatgttgtcggcctgcaagattaagcaaaccatctaacagctcttcgtagtctaggtctggattttcttcttcatcatcatcttcttcgattggtatgttgttgtcgtcgtcatctgtttcttcgtcatcttcctcttcgtcattttgaggagcaagaggcggttattgaataacaggagaccgtggttgacgagcaggaagaggttgtgtcctcggcgggtactgggatggaagagttctatgagattgtctctgatggattagaggagtgagaagacactccgacaccactccttcctcctctcctcccacctccgccactattattcatagtccgactcacacttggattcgatggaggttgaatcaaaacaccgcttggatctgttggatttggactcaagcctctgcttggtttcggaggatctgcccttttacgcttaccagtggttggatacggaggattcaccggtaatgtcctactaccacatggcttcgccggatttgacccagtgaagaccctcagacgtgattgagatttgccaccgcgaccccttgtagactttcctcccttcggcgacattagattgaggggagattgagaagagatcaaggaaagattgagaagagactgagagagattgaggagagaaatcgatttgagaagagaagagagttgagaagttttgagagtgaaaccctaaatggagaaagagaagccgcataataaaaaatcgactaagtgtttacatagtaaataacgaagaggagtccttaatctgtcgcaaacgagtcacaacagaaacgaaattggaggcaaaattcatctcccaaaccaaagcccaattccattaaaataaaagcccaaaattcatcttcaaaaattgcgagtatcaaaagagtccgaatacagtcgcatattgttactcttttgtgactccttggtttaagtcacaaattgattttttagattcaaggcattacagatcaaaactattgataccaatcactaaaaacaaacataactgtaatctagagtatccctattagtataagagtttaaaacattgatttgataactttattttgatatttacaaaaaaatcaaatccttcttctaaacaaacatgttaaacttaagaatgatttagaattaatgatattattgtgttcaaacaatgtgatttaaagcttttagaaacttttatagtgattaagttttattcaatcaaagtatatatgtatatataacaattctctaaggtgattttccaaattcaaaaaatcgcgagtatcaaaggagtctgaatgtagtcacaaagtgttactgtcttgtgactcctatgtttaagtcacaaattttttttttggattctaggcattacagttcaaaactattgattccaatcactaaaaaacaagcataactgtatactagagtatccctattagtataagagtttaaaacattgatttgataactttattttgaaatttgcaaaaattcaaatccttcttctaaacaaacatgttaaacttaagaatgatttagaattaatgaaattattgtgttcaaataatgtgatttaaagcttttagaaacttatagtgattatagtttactcaatcaacgtatatatatatatatatatatatatatatataacagttttcttatgtgatctttcgaattccaaaaatcgcgagtatcaaatacgtccgaaagtacaaatcgcgaccttttgtttataggcagaaattagtcggaatgtagtcatgaaatagagactatattgtgacatattgtttgcgtcctaaaatggtgacgtaattgcttttgtatttcgtctagtagcgaactagtcgtaaatgaatgacaaagtagtcgctccgtgttgtgaccaaacataacgtcgcaaaatatgtattgaaagagccttaacctagacatattgtatatcaaaacttcaaaggatatagtagtcacataagcaacataagtatgcttcacgagaaaaaatcttgaatgattaaaaaaaaaacgaatcttgagacttggcacttgcagcaatcaaaagattactaagttccatcaaaattcacaagtgaggaagacaatgtatcaatgaccactttgtctaaaccaaaatatgaaaatagatattagaggaaatgcataacgattaagctaagcttggtacagaaacagagaatacaaaatcccaatttacgcagaattatgttaaaggaattagcagtaaaaatcatcgttttaagctatgcaataaattacgcaggaatcataaaccttaaaactgctgatctaaacgtgagatcaagaaagtaatgaagatccaaggttgctaatagaagaagtacgaaaacagagtttcataagatatattgacaaaacagagtttcatcaatgtgatcttaccttgaagaaaactgatcttcttctcacctacaagtatgaacacaatgctatctaaattactgaaaagatacctcaagggaaatagtataactaaaggaaagcactatgtggttgtgtaacttacagcccttgtgctcgtttagatctttatcgcagctgcaaaatctgcagaagataaggaaacatgtagatatatagaacaaaatgcataatcttaaacaaacaagttacaaaacagacatataaacataggaatcaaacataaaacagagcgtcaaacaacaaaaaagaaacgattaaagttctatctcttaatccataaccagaaaaagaagtctagacataaaacaacaaaaaagaagcatcagacaatcgattgaccataaaattagcaccaaagaacataaatttctagcaaaaatagataatagagggcgatttcaatttcacaaccttaatatcatgcaaacaaacaaaccctaactcttattgttcaacaaaacctattgataggcaaacacatttagaaaagaagagacagaccatgagcttatgatgatgctttcgccaacagaagatccgaagtttcccaacacgaagagaagagaaagagaaactgagaagaaaagagaaagaaatggaagggaaactgagaagtttcccgaacataaataagaatgacctaaattttggccaattatttagcgcgtgttttctctcaatttaattgcgagcgatgtcgctaatttgtcgctattaaattacgagttccgttgcaaattcgacgcaaactcgttgcaatgtaatgagtgttggactcaaactatgattaatatctaaattcgaattgaggaaccagagattgagactagaagagaaagtgaagaagattgagaagagaagacgtaagaagaagaagcgtgaaagagggagaagaagaagatgacttcggtttaagtgtgaaagggctttcgggccacaaatgtacataaggcccaactagtaagtgggtttagaagtttgcacaaaaccatagattatatggtaagtttattattcataataaatataaatataaattaaaattatattcaagctttattattcagaataaattaaaatacaaattaaaattatattcaactttattattgataataaataaaaatacaaattaaaattatattcaaacattattattcattatatataaatatacaatcattttaatcctgatattcttcttcattagaactatcatttgacttcatctgagtaatcaccaggttcttctagttgtcgattgtcttgatcaagatgtacgacgctttcgagtgtatgttctggaacatgaatctctccttgtgtgttttgtagtggtacttcatcagagactccaacaatacgacctcttggtaaaatttcaatgacagataaccaagataccgcagtttgccgaatcttgggatatggaatgaaactgacttgttgagcttgagcagcaaggataaatggttgaaacctttgatatctctgagagtcattaacatctacaatgccgagattgtgtttcctcacaccgcgcttgataacaggatcataccactcacatttgaataatatgcatttcaaattaaccaatcctggatattgtatttctatgatttcttgcagcactccgtaataatctgtttcaccacgtactaaaataccaaagtttgttgttgtccgatgctgacagtgagcttgcacatgaaaagcatatccacgagtgaaatacatggatgcagtagtaattatcgcaagaggaccttggattaactcgtgaaaccaaacgggatgtctctgtcccataatgtacttgtaaaatacaacattactaattagataaacatatataagataaaatgataataatttgatatataaggattattaagttattctacatattgttttaaccatcccgcaaattccctgtctcttagcttcgctatttctttctcagatatatcggaaaatgtttttttcacttgtgttatgaaatactgcaattagagaggaactagttagcaatgatattaaattaatatatatatatatatatatatatatatatatatatatatatatatattgtgtaaaagatacctttcaaatggttgaacatattcgcaatttagaaaaatatacgtgtgggcactttgacgatctttatcggaccaccaaatttttttaacttgttcacttagtcttccaatttgtgcaaatatatcaggaacacctgtaacaggatatacaggtgccgcaccaccatcatcataccgtcttggggcccttttccgtgttccaactatatgcggaaagtagtaggaagagaaataagacgtttcttcggtcaaactccctgcaataatcgagccttcaactcttgcaagatttttagcttttctttttagatgttttatgaatcgctcaaatgggtacatccaccaaaattgaactggacctccaagggatgcttcatgtggtaaatggatgggtagatgttccataacatcgaaaaataaaagagaaaaaattttctcgatgttgcacaataagatcgcaatgctattatctagatgatctattccgtcttccgtaagagtccgtgtgcaaagatcacaaaagaaagttccaataatagcagattatgagtataattacatatattgctaactaaattaattaaattatcacacatacctacaactgcctcatgaacattttttggtaatagctctttgaaagcaaatggtaataggcgttgcgtaaaaacatggcagtcatggctttttcatacccgaaaactttttgccttgctcaacattctttgaaagtttagacacataatcatctgggaatttgacatcagatttaacccactcaaaaagcgctgtctttgcttcagaggataatctaaaagttggaacgagaaccttcccatctctcgtaagatgcaaatcaggtcgcgaacatatatcaggcaaatccagtcttgtttttaagttgtctttactacgcccctgcacattcaaaagtgtatgcatcatgttatcaaaaaaactcatttcgatatgcattacatcaaggttgtgcctcaacagaagatccttccagtaaggaagctgcaaaaaaatgtttttcttgtggcaattgtgattaaccagatatcaatctggcatattggcggggatgtgccaattatccccacatgaaatatctttttaagaatcccaataatctatctgctcaagcaaggcttctccagaaacataagctccaaatggtgattgagaaattgaaccaactgaatgagatgaataattataagttgaacaaataagttgaataataaaaatgagctgaataagatgaataagctgcagagaattaaaaagtatgtcaaatggtgagcatttagctgaatagttaaatgtagagaaatattgtttaaaataaaatctaatgttgccgacgagaactacgtcgacttgcagaccacatttgctcagcaatttaatcacggacgatcttcatataattcccatcttgtgtttcttcttccactccaacactttgatcatcattggcatcatcactcacattttgttgcccatgtgaatcttcactttctttatttgcttcttcaaagtcagcatcttcaatgttgttccgccgaataaaattatgaagtcccattgtagcaaatatggcacgtctttgtactgcaatattatatcttggaaattcatttaaaaccctccattgttttttccaaactccgaatgtacgttcaataactgaacgaagggatgcatgtcatctgttaaacatctccttgctattctttggcggttcaccattgaaaaactcttgtagatgatatcttgtgccagtattactttgttttctatatggagccaaatatccacttttgttggcataaccagaatctacaagatagtatttaccttcagcgggcgtaggaaacataggatcatctcgaatcgatgttgataacacacgtgcatcgtgtgctgatgccataccaacaaaacaatatgtaaaaagcatatcgaagtcgcacattgccaagagattgagacttgcattttctttccggttcacaaatcgaatggtttcttgtcctggaggcatcataacaggtatacgagtcccgtctaatgctccaataaatccactaaagtaaagacaatatctcttatctctttgtagacggtttgctatagcttcaagttcttgggtagttcttggccgtatgtagtccaccgccatacattccattgctccaaacacttcatgaaacttccgacatattgtttcttgtgcatgaccaaatcttagaccaatgtcaccttgagtgtcattctgcccacaaatcataagaaagatcgcaacactctcatcaacagacatattttgcgtgtcttgtaagctatacctctcttgtaatatttcacacaaacgttgaaatgctactgtactcatccatatcagcttttgacatgcgatttcattgtcatagatttgattttgaatcattcgccatccactacctatatcttgtgtcactggttctttacaaaagaacttgccataatattccatcaaaggagagatgtgggtgtctaagatttcagcttcttcaagtaaaatcagttttgcaatttcttcatctgacagattttcaattcctcgtagatgtagttctgcaatagagcttcctaaaaaaaaaaaaaaaaaaaagatttgtcatattaaaatatagacatgaaccttaaatattaaaatatagacatcagacatgatataccaaagacaaacacacgtacatactcatcgtttaccaagaagaagtgtgaaactaagtcaaaagcattacacgtacgtacccatacatgtttccttaaactgatattatcacatggaataccatatctatcaacgccaacaagcttttccaagaactgaattttgatctcttcactccataatttcataaatccatcacgaacatcctcgtcgttcatcagcaacctgtttgcttcccaccaaaacttttcccatcggttcaaccgacaatatttctagttcagccaaagcatctccaaatgtggctttttgatgatgtcgtgaccttaagacatccagtaaacctgtacgagactcttcaagacgttgaaaccatgtcttaacttgagtctcaaagttgtttcttctatactttgtacgtctagtagtcgtctttcgaacacccaaatttgatctattggtacgggacggagaacttcgtccttgttcattagtagtgggtatcggtgatggagcagctcgttgaagatcctcatcagatgttagctttagaggaaattgactcccattatcatctgaagcttcatccacttctacgtcatcatcgctaggcccttcattttgactttgttcgaggtttgttcgtagagtatgcggagaataatgatcatcctgctccacatcatgttggctataaatttgatcaagtatctttttgaatagaataggcctgttttgcaacactcgcacatgtttgccatttctcccaaattcctgaaatataatgataaaactaattataaaatagaattatatgtaaatataaatagatattatatgctaatatgttttaagaactcacctgaattctatctttccaccaaacgtcggggcatatctatctttcctattatcgaattaatcgaaataccagtgcggtcacttagtattttgttacactgccacaaatttcgcatatattcgagtctatttttcatctctggcttcctagttaatctaactcccgtcaactcaaaaaacttttcctgaatttttgctttccccggattgtccggcactcttgtgagatagcttttcgatttaagcttggtgtttacaagttggagaaaaattttggtatatctaggactctatatatactgataattttaaagcatataagccaaacaaatatatgatgacatgtgtttatataaacaacgagataatactttaggttcctcagtagcttttgctttgccctttgcttaacccttagaatttgatgatggagtactagtgcttccatttttgctctgtttgtttctaataaaaaaaaaaaagagacattcaataaacaaaagtaaaatgaatgagctagaagcaaaattatacaagtgaatcaaattattgaaactaaacaaatatgaccacgattgtgtttataagtaaattgaagtagtattacctttcactcatgattgagtgccaacgattggttatgaaagaagaaaagtgtttagttcattatattttttgtgaagataaatcttgatgggaatactatatttataggaacaaatattagatgttagtaaaataaaaaatgaattattcaaaataagcaaagattgagctgatttataggaaaatattatagttgttgatttatattcgacaaaaacaagattacaaaatatttaaagatcgaactgaattagtttagtatttgaatttcctagattctctaaacaaattaattaatttaaatatgataaaaaaaatattacaaatttttctcacgttcaattcgtttctctcctattttgaggctgaacaattttcatctaaaaagtgtaaattttcagctttatggtgggtcccaaaaaaattgggttgaatctttttttaaagcaaatggtgaatttctggaggaataaagttgaacacacgattcaactcttccaacttagcaaatctatgtatccatttgcagccatatacaggtggaggttcacataccactttgttcttcttaaaaaactttttgtccttcctgtacggatgactcatcagaagaaaacgacgatggcaatcaaaccagcttgtcttacgaccatgcttcagttgaaatgcatctgtccgatgaatgcaataaggacaagataacctgccatgtgtagtccaacctgatagcattccgtatgcaggaaaatcacttatggtccacataagcattgcatgcattgtaaagttttgttgttgtgagtaataaaatgtacgaactccggtatacaaaagctgatgtaattcatggatcaaaggttgtaagaaaacatcaagagaacgtttaggatgcttaggacgagggactaaaatactcaagaataaaaattctcgctgcatacacatagatggaggtagattgtatggtatcacgattaccgaccacaaagaaaactgtcgactggacataccaaatggactgaacccatcagtgcatagaccaaaataaacatttctactctcccttgcaaagtcagaatgtaccgtgttaaatggttgtcaagccttcgcatctgatggatgtgtgacctctccatcttcacgtgaatgctcagcatgccatctcattgatgcacatgtcctttctgattgatataatcgcttaagcctatccatttttggaaggtaccacatatgttggtacgggatcttggttgtcctgaacttggcttatatcttggcttcccacaaaatcgacattcctgtaattgaccatcttctttctagaatatcatgcaattatcaatgcaaacatctatcatctctgatggcaacccaagactatataccacttatgtatctcataatatgactcaggagcaaaattatcctctggcaaaatatcgttaattaattgagcccatgaatccatgcaaatctcaagtaagttgttatttgttttaatgttcatcattctagatgcaactgataatctagacattccttctctacatccatcgtagatcggttgatttgcagcatctaacatatcataaaattgtcaagcatctaaattaggttcctcatggttatcgatgattgttgttgtttcaagaaatgcatcatggaccataaactattatgattttgttgactataatcaaattgttgaggctcaaaattgatattaggttcctcttcatgttgaaaactagagttactagacgatgcattcaccatattttcctcaccatgccaaaaccaaatataataatttgccatgaatcctctattatataactgctttcatactgttttgaaagaaaatagcgaccatttttgcactttcgacatggacaagacatattacaatttcttgcgtgagtggcaattgattttcgtttatcatgaattcttctagcccatctgcaaactctattgtcattgatccattaacatctttgtgcttatacatccattcccgtcggatataaatctcgtcacacgccaacatattatatattattttgaaaataaaagaaatataaatttgagaagaaaagatttgaaagagagatttaaagaattatgttccttactcatcccaacgtggctttatataggcacacaaatctgtttgcgaggtatttgcgacgaatttttgcgactatattgcgagaatttgtaaactaggtaggtagcacattttaaaacgtttctcacctaccatatatatattcgtctcaaatgcgtcacacaattgcgtcgaattgatacacgcaaattccacgccaaatgtgcatgtagtttgcgatgaatttgattggaactgttgacttcgacccacattcgtcgctaattttacgcttatccgcctcgaattagggaggaattatttcgaagcatatttgcgacgaagttgagacgaattacgctattccatcctaattcgtcgcaaattacatgcttatctgcctcgaattagcaacgaaattgttccaagcaaattagcgacgaatgtgagtcgaatcgttaatgcgatgctaaatccacgctaactacatgcgaattagcgacgcatttatttttacgcaatatttccacgctactcatatgttttcttgtagtaaaagataaaaataaaaaataacgaaagttcatgtcttgcaacttaagtttttcggttttagttttgacttttgaatatagttttttaggttaaaaaattatttgatcccttaaaaatttcaagattatcattttttttaatgaattgaacagaaatccaaaaagtctacttttaaaataattaactttaatcatcattcacatcttttccataaatcatttttatgaatatttatcttcaatgtagctttcataacagaataaacacttaattcattgaacatgtgacaaaattaaaaaattattatactactacatcatttgaccaataaaatattcaagaaaagccaaaaaagtgaaagagttattttaaaaagagtactaaaacccaagtgacctttgaaaataagcactctacgttatggtgttttgaaataagcactctaacacttctctctcatgttaaaatgacgcttatgtcctttctttggtgatggttttacaagagtttttaatattttgaacaaaaatattttttatttatggtgaagaaaatagatgtgaaataatatattgacaacttatttatcttttattatagaaaaaaaaagattgtgaatataagatatgtaaattttgtgtagacaagaaatcttttctattttaactatcttttttgatggacatataatataaatgtcttttttatatgtaccatgattattttttattatgttaaaaaactgataaactatttaaattttttaattaggtatactattttaaaatggtttatgatatgcaacaaaacttattattataattttggagaactctgtaatctaattgagtgaacatttttcaactatgatccatcgttctttttttaatattatcatcaggtaaaatagttacaatagttacattattgtgttaagtttctcgtttttttattttttattaattttgtgtcgtaactatattggtttgggttcaccaatttttgactagggtttagttttttcttctcagttttaatattggccattttctaaggtgattaatgcattgtgtttgagtttattttttttattaggatttagctttctcttatttagaatattgtaatctcgtatagtagttaacgaattatgtttgggttccatttttacaacttagggtttaaatattatgtatgaatggtttctattaattttcttattttttattttattttttactagttgtgtgccgtaactaaatctgttttggttcaccaatttttggctagggtttagtttttttcacattttcaatattggccatcttgcaatgtgattaatgtgttgtgtttgagttcatcaattttgttttattaggatttcgctttctctcatttagaatatttcaatctcgtaaagtagttaatgaattatgtttggattccgtttttacaacttagggtttagatattgtgtatgaatggtttctattaattttcttgttttttattttctactagctatgtgctgtaactaaatcagtttaggttcaccaatttttggcagggtttaatttttttcatatttataatattggccatcttgcaagatgattaatgtgttgtgtttgagttcaccaatttttttattaggatttagctttctctcatttagaatattacaaactcgtaaagtagttaatgaattgtgtttgggttccgtttttacaacttagggtttagatattatgtatgaatgatacactgtaaaagtaaatgtggattcactagggtttaaatttcgtgttttttataatgtgttagaacattgtgtttgcgtttttaaattacagttaagagtttatctttttctatttttgatgttttatttgaatgatgggataaatatttggcggttaggatttatgagtcgttgattagggtgtattattattttatttaaattattaagatagttaagttattgtatttaatttttttaaaaaaactattaaataattaagtgaaaaaacaataagaaaatcatattgaaaaaagaaatgcatattgcccacatcatctgatatttgcaccaatatgaggaagggtacaatggtcagcaacaataaactattgcctttttattttcatattatatttaatagggtcttttgcagaaataaccattttgagaaaagtaattaaatttttaacaccataatatgataaattaagtaagtaacatgagtggtttttaaaaagtctattttttccttctgatttggtgtaggacgtgcgcgtgaaacacacacataatgaaagaataaagaagaatagaagaagagagagaataatgatgatacgacattttttcccaagtgatttgaatgttagattaatttcataaaattgactaattaaatcatctaatagtttttaataaaacatagattttttcggtttataacctgatttaaatttttgaaatctgatacaaattattaaaatagtaaataatatttgtctaaaacacaccaataaaatagtataaaataaaactaaatagtatagaacgaacaatagacaaacaaatgattgagctaaaccgatctgatccaaaaaaaactataccctatgagatacaacattggcaacccaagcaaccgaagtaaatcgcagtggtaacgttgacgatagcggtggtagtgttaacagtagcggtggtggtgatgacgacaatggtactagtggcactaatagtgatgttgacggtgatgattgtgtcgatacaattgttgcagtgatagtgataaataatcgagttaaaccgatctgatccaaacaactatatcctctgagatacaatattggcaactcaaataatcgaggtaaaccgtagtagtgacgttaacggtagcggtggtgctggtggtgacgatagcagtggtagtggtggcactaacaataacgttgacagtggtggttgtgatgatacggttgtggcagtaacaataataaataatcattgtgacttcgtggtagatgcgataatgaaagataattataataagaatcttatatattttttgttttattaagatagaatagaaggagaaaaaacaaagacttaaaaaaaaattaaaaaaaaaaaaaagaaaaagaactatgtatcctgcaatatggacaaactagattttaacccgcagtagaccgcggaacgatttattttttaaaaataatatattaaaacttgcaaattttatttttataaaatatttatattttacagtttataattgctattaagtaacgctataccacgaatccatgagacaattgttaaaaaactgaagttttaacccctattaaaacagcatattaataatattttaaaattttctaatattgattcaaatacatccaccatacaacccaattccaaaataaaacccgttctgtcatttctttacccgtcccgtgatttttttttaaagtagtaatttttaaaatttaagaattattttttatatataaaagttttgtaaattgtatcattctctaataaatttatattttatagtttaattttatatatagtaacattatacataccacataacatttttggttttatataatcttttctaaattaggatgattttatatgcttaatattagtggtcttaaaaaataataaattaaagttttaacccgtattgaaacggtggattaattatattttacttttttattaatgttgattcaataacccgtccctccaaatccgtcttgcaaaaaagccatttattttattaatattaagtttattaatgatatgactctgagttataatctaaacattttagctaataacataagagtgcaccatatttatttaataggggaatgtaccatatgacccgaatgcacttttacccaaatccaccaaaaaagtcttgcaaaaatactatactgataagaaacgatagtctgttttgataggtataagattagcaaatatattagttagcttaaattagttaaagaatacaaattgaaaaggtatattatactttattcgaatatagtatcaaaacttatataacatagtgttgttgtttatagttctgattcaatttcattggtttgattggtttaatcagactaaggacattggaccaggcggttatctccggttttgggatggctgagtaaaccgaaagatgatgaagtaaagaggagtctctaactgcagtggagggtcttcggttctcacgggataaggttttaaccaacccgagtttgttataaagtcatcatcactttcttcttcctttgtaattcttgttcttagagagagagagtaacagagagagaatccgccattgttgtaagctcaagtttgagcataactcttcctttgatctagtgaatttgccggattgattcggctccggacgtaggttagatcacaccaatctagctgaaccgggttaacaaattgagtcttgtgttcttctttacttgttcgttcgtgttcttgagctgagttcattgtgagaatcggagattgaatctataacacatagagatttgataaatttttaattgttgaattcttttttttgtgctaatttttatgtgattaagatttatttgatttcatatataaaatactaaattgttttacgaacttatttgtttataatttggtaacagatagatattcgaatattcaatatattttgcttcagtttagaaaatctttgatgatccgtctttagatccaataagccctataatctagatattaacctgcagtataccgcagataggtttatattttagttaaactaaaattttttattgtaaagatgatttaaaaatatataatattattttattttattttaaatgtatagtaaactgtgagttgtatatgttttgttgatattatctatattgtttaatgtttaagattatacacttgtagtttgattgttaatttaagagttccaactgtagtataccatcttgtattaatattgatctaaaccgtcaattctaggattttccagcttgtattaaaaattgaatcacatcatacacataaaaaaatctaatatattattaattattgtagtatataagattataaattttcaatataatatgtatgaaattgaatataaatatctcaaattatgacccgttactcagtagaaagttttcttaaatctatttttcatccgttataatatttattcatgtattgaacagtttatattcgtttttaaaaattcaaattatgcatatgcaaaaaaactctaattcttttttttttataatgatgatattattttttcgcaaaaatagaatcatataaagatgagaagtgaactataataattaataaaaaattaatatgataatttagatatcaaatctaatttgttgattttaattggttatttttttaaaaattaataatgtatttcgtttttctaattaaattaaattaattaaaatttatatatcaaatcttatatgttgattttgattggttattatttttggaaattaataatgtatttcgttctttaattaaattagtatttgactttctaatctttaaagagataaattaatttattctttaaatttttatttctaatagcatacctatgtaattacttacaaaaattaaggttacatttaaaatgtacttcccaaataatatagtaggatatgacattattataaattgtattctattgtaatgatatggttagaataactagttacttaattaaagtttttttttggttatacactcaaatttccgtatctaatatgcctaaatccgaagatctttaccaatttgtgcctattttaataagatactcttcaaacaaaacaacaataaaaatgtaggtcccttaattccttaattttgcactttgcacagccaccagtgaggcagagatcttctacgacagagataatacaactttcgtactcaacaaaaatctcagtcgttgataaaatacacgtgttaaaatctaacggtcttgataaattaaaggaaaaaacaaaagctggaaacaacagagacgtaaaaacgatagtttaggaaaacaaaacaaaaaagtgttctttgatcaatcaataatcattcatcagggccctgtgttctctgagtcaagtaagattcttttcgacgattccatttactctttgattagggttttatcattctcaatcagggttttagtttaaacatcgaattaagcactggattagctgattttgtgtgatttgatttcaaagttcacagcttttagtttctctgatcctaatttatgatttgaagtttctatcaaaaggtttgatttttatgttgactttgtgatgatgttaaaccccatttagctttggatcctagaattgtctttaggattgtaaagttttagtttttattgaatttgattctgttcatggtagcttcttctttaacacgtctctttggtttcatcaaaagccatatttaactttgcctaagtggacataaatttcattctctgagtactgattccatatcctttatgtaatgtcctttcactatccacatgtagatgcttctccatgtagagtttgtgatctagagcaaaacaaaaacgttagaaatattcttgagagattgtttcttttgactagatagtaagggaattgattcaatggttcatctcctttgcataaagttatattctgtgtattagtgtctcatttctcgttgccattcaacactctgaattaggatactgtgtggtgttttgcaaaactgctcttgtgctatgactctggctaatgatttcggatattcgaccgctatgtcttcatcttattcagctcttcatactagtgtagaagacagataccacaagttgcctaactctttttgggtttcatcaggtcaggaactgatgaataaccctgtaccgtgtcagtcggtctctggtggcaattctggtggttatttgtttccttcttcctctggatactgcaatgtttcagctgtcttgcctcatggaaggaatttgcaaaaccagccacctgtttccaccgtgcctagagacagattggctatgcaggattgtcctttgatagctcaatcctcgttgattaatcatcaccctcaagagttcatagatccacttcatgagttctttgatttctctgatcatgttcctgttcagaatctacaagcagagagtagtggagtaagggtggactcatccgtggaacttcataagaaaagtgaatggcaagattgggcagatcagctgatttctgttgacgatggttctgagccaaattggtctgaacttcttggagattcaagttcccacaatccaaattcagaggttcagtttctctagccatatatggtctctatgtttgttggttgtccttatgttatttaatcagtgttttgcataattggtatcagatacctacaccatttttggatgtaccaaggctagatataacagctaaccagcagcaacagatggtttcatcagaggaccagctcagcggcagaaactcatcatctagtgtagcaacatctaaacaacgtatgcgttggacaccagaacttcacgaggcattcgttgaagctgttaatcagcttggtggtagtgaacgtgcgtaagctttctccttctattgttcctgaaaataattgctcaaggatgttaaccgtacactgattcttctataatttccatcataggagccacccctaaggctgttttgaagctcttgaataaccctggcttgaccatttatcatgtaaaaagccatttgcaggtttgttcttatccatatactattttgttattgtatctcatactgcttctctgctaagctaatttctcatttctcaccgtctttctgttgaacttcttttctacagaaatatagaacggcaaggtataaaccggagacttcggaagttacaggtaaggagttaaaatactttaacataatactactgcactttttctaagctttaaagtattggtcactctctagaagaacctaaactctcgacaaacagcttacgaatgtatgaactttatttatttcttgcacaggagaacctcaagagaagaagatgacatctattgaagatatcaaatctcttgacatgaaaacgtaagaatcttcagtcttctgactgcataacaaaccagtaatctttcttcgtattcttcagatattcttgtatgtatattttgctagatgattatgttactatttcttttccaggagcgttgagatcacacaagctctacggttacaaatggaagtgcagaaacgtctccacgagcagctcgaggtaatgattttacatgcctaactgctaaaaaactatccttctttacctgatttcgaacttagatagagtagtagttgtgaatatcatgagtattatctgattttgtctaaaccatatgccagatccaacggtcactgcagttacagattgaaaaacagggccggtacctacagatgatgttcgagaaacaacaaaagatacaagacaacaagagctcttcttcagaagcatcaccaaagcaatgcaatggttcatttgcagaagttgaagttggtcttgagacactaacaggggaccaaaatgaatctgcttcagcatcaaggaaacgtgtcagagaagattaaagcatgtttaatttgatctcgtttgacgaaacatgtttattgggaattaattgtggaaaccaactccagttttgttaaaagaatctgtttctttcttagctctgtattgttctagtttagaagcagttgatttggccttgcatggctgcaacactaactaaagagtaaagactaattgtgtatatctacatatacatttttggggacgatttgtgtcgaaaaatcctttttcaatttttgatattgtatgtttagtccctacaaaatcaatcagacaagatattttctttaggacaatgaccaaatttttgattaacaattaagatattgcactaactacttacctaaacatagatattgttaattactaccctaataaattgcacaaatcaatccctaaaactataccgaattcattaatgctaaaatcctaattaacaaaatccggaaatcaatcataactaaccatatttacaattacttgattcgaaaataattttagttttaaatgctaatgatatcttaccaaaatttattcttcttttatcaattgcaacacaaaatccggtaagtaactatgcattaatttttgttacctcaaataaacatacaatatactagagaaatctgtatttttgttcttaattggctttattcctaaaaatatttatacaaaattttgtttttgatttgaaaatatataaatcgtatatgtagttataacaaaaaactattttcaaatcaaatagaattctagaataaaccgtaataatattttaatgccatatctaaaaaactctataaattgatatattgttctaacaaatcaatatttaataagaataaattaattttattcacgttttaatttaatgctaataaaaaataatttattctaatggtttttagttatgacattaaagatttattgccaaaaatgaaataattcgaatgctaacaataaacataaatgtgatcgagttctttcctacaaaaatggtaatctttaacatcttccatagctaatttatattttttcaaattttgagttcaaattttccttaattttcatcaatcgttgttaatatattttttgacaagatttctctacaaaaaaggaaaccacattaacacttgcgtattgtttttgtttagatttgtaatctaacaacaagcatatattctcaagatattcgaatatcagaatattacctaaactaaaatatctagaacattctaacgtaaatgtgttaacaaaaatatttttattgttatataatgattcgcaatcttcccttaaacatgtgagtatcattctaatttttgatttgtatctatgatttttctacttgctctccaaaatattctcaaaccgtcaaacagatgcaaccaaaaccttaagattatcgtctataaataaccatctcatatcaaacaattaccacaaccaatttgcctcagtctaaattatccctcataattctcatatagcaaggtatttcttattcatagctctagatatgttttgctatacagaatatttatcaatgcttgtgagacaaatttaatagattgagtttgtgattttgttgtttgttaagctttatgagcaagctattaagtatgagaaaggttcgtttatcatttctaatggagctttggcgacgctttctggtgctaagactgatcgagagataagcgtattattaaagatgcaactactgaggatgagctttggtggggaaagtgagtattcttaatccttaaaaactaaagtttgtaatttcattttattttagtttatgattaagggaaattgaaaaacaaaagtcctctatatccaaatttcccaaataactttcttctttctagattctcccaaataactttggtaaaaaaaattattttatcatttcatttagttttcaaattttattttattttacaccacgggttaaatcctataccacattttttgtttgcatgcactttaagttattttacaatttagttaaacttacttaattttgaactttatgatggtaacttaataacattaatcttattcatataaatatttagctatatagtaaatgccgaataatactataatataactataagagctacatcttattaaatatcatatattttatagtttacaaaatcaaaaatttataaattataaaataaaaggaaaagaatcaacccgcagagtaccacttaatatgttgatatccataatatttagattctataaaaagtttgtaatattaataatatttgaactctagaaaaaataaatttttatacgataaaaaccatttgaaagcaaaattttatattgactcaaattacatgtaaaataaaagtactactaaaaataaaaataacaaaattatgttaaatttcaagggacgaggttatatggtgggatgggtttgagttagcctaaatatgaggcggcataccacatataaagtcctaaaatatacaatcaaaatccgattatacaattttaaacactaaaaaaaaatagtaacaaaaaatacaacttaaaattttaaaaattatagttacaaaaaagtaacccgcagtacacaatggatcatagccatatgttattaatattttaaaaacacgtaataacacaccataaaaataaacacttatatattagttaagaaaactattttaagcgaaatacttttatttttaacaaaaaaaaatactatataacaaacacgtaataacacaccaaaaaaatacacaccctatataatgatgcgtataataaacagatttccttaattaaacaaaatcaaaccaaagaaatacaaatataatatcaaaaataaatagatataaaaagtaagatgagaaattcaaaatataacttgattatttaaatatagatgatgtagaattaaaaaagataatataatttctattgtaaataatcaatccgcggtgtaccgcgggtcaatatctagtgataaaatgatttcgataactagtccagacaccctctgatattttcattgtgtggctggtcggaccggtccaattaattggtccgggtttatatttctatttttgtctcaaatacatatgaagtaataattgggtctggctgaatcagatgcatctatgatggatcttttgtcgatccatcattattgggctggattacttttttagttttgatttttgaataattaaatgtttgcaagaaatcaaaataactaaaaagtttctaaaatctttaaacatttcttgaatcctagattctgaatttttagattcatttaaaagtccaaaaaaaacttcaatattctttgaaattctacaaattaataatttatattttcagatttaaatatatgtaatattatgggaattggacatgtttaggcacttgtacaaacttttattccttttgaggcacttctcacgtacaaggcacttttccttgtttttgaaaaataaatggacaattatatccccacccatctaaatcaaaaatttacttaaccggttagaaaggttttgttttgatttggttcccttctaatatatcgacagttgatatttacagatgagaaaaggaagttaccttcgccgacttaaattatctcacaatatcaatgtcgatggttgttaatttttccgaccaagcaattactatggaaagtctcggaatctccgggtcactgtttcttgaattggttaatattactgtgcaacgatctctctcccttcaaacaaaacctctgaaacaatttaaattgagttgcctccgccttaaccaaggcattgtgacgatgttttttgcagcgaattaaccgccactgtgattggagagatgacatagaagtcgattaggaatctccccctaaattagtatcggcctgcaatagccatttttttacagactttgaaaatcttaatatgatggaagttgtagatatctgaaaggtttagaataactagagtggcgggtagagatattttgttgctcgatattgttgtttccttccaacacccagactttagtcggctttatatcatcacatgagttgattaaagaattgtttcaggtaactttcctggttgctttacccactgaaacatgaaatgaagtgttttttgttgataacttgacattgatgattaaacaattgtttcaggtaattttcttggttgctttaccatgaaaaaggtgattgttgccatttctaatgcgttatgcatcgtttgcaggaaaaatataaagataactatgtacataaagcatctaaatcataatgggctagaaaattccagttgcgttcataaaatatgataaatcgtatcaaccttagtagagtccatgctggggtttgacttgatcaccattaaacaagaaactcgtatgaaaaaaatttaagaaattgtttctgcaactaaactagtatccaacatatcaagtccaataaaagataaactgcaaaatattaatgtccacttctgtatgtccaactattttatcatatttgttcactgataattgtccagtatcgtcgaatgtttaaactgttatattgattatgtttgatgtaaagggatgtaaattatatctttcatgtttttgaccttatttccttcttggactttttagacaaacccaaaaaatataaaaaagtaaaccatgatttatattggttagtgatgttgatgcttctaaccatgttagtaaaaaatataaaaaagaggattccaaataattttgtcttctatcatattgatgcttctcccaaaatgttcagctctacttgcacctctgtgagtgtataatgcaaacaatgaattgaagattttttttgattatttaaaattttttccacaatgttttatggtttttggtttgttttcttttttgtttactgatttttaacttttcattatactgattgttttctatatatccacaatattatgtccacaatataatgtccaataagtcaaaaaaaaaaacatgtacaattgatgagtgtttcatacttgtgtattgttgagtgtccaatatgatcaatcaattagttaaccggttttggatatgttcacaacaaaggagaagactcctccagttttggttacaagcgaggttggccttctgtactatctaagtgcacttagagaaaacagaggtcttaatttgtttgtgaagtttgaagaaatggaggaagatttacaaagttttgatacacgaggagatagtagcactaaacgaccgcgtcaaagcaatttggaggaagagtgtggttcaaaaacgcctaaaagtggtgtcacagctgttcgcgatatatcgtctgtgggttcaaaaactcctacaattgtgttgactcctcgtgatgacgaattcatggaggaattggaacaagcagaagcaaacataggaagtaacagtgggcataaatcgtcacggaatgatactgataacgaaggttttaacaatgatgttgaaaagttgtttttcgttgataacgatacagaggaagttgaagcagtcacggaaaaacctgaagatagtatgccctgtggcggttatgataaggagttttggtcaaatttcctaacagatgattatggtggctccaatgctaatgagttgatggcaacaggaggtttagatgtaaggtacgggtctaacaataaggttgtgggctccaatccggatgaagtggttttctgtactggcagcggagtctttgatcacgctatatatgtgaatggggctggcgaaagtataaagatagagcatacaaaaaagaccccacaagttatgaaaggaaagatggtcggtggagttggaagctctcagggaacgaggaatgaggtcaaaaagttggaggaagtggatgacgaagagtttgacatcccacctttgtttgaggacatcgagtatgaaattgataacttacctgatttggacattgatgatgatggtaaaggtatataccagggaaaagtgtatgcgagcaaagaagattgccaaataggattggctatatttgcgataaagaatcagtttcatttcaagcaaacgagaacaaaatggaattgctcagatgagaaatgtgattggagaatattggcaactgtaatgaatggcacaagttactatgaaattaagaaagcgcagcttcaacacacatgttcagttgagactagaaggcagtacatgaagagagcaacgtcaaaggtgattgcatctgtatttaaggcaaaatacagtgaagcttctgctggtcctgttccgatggatcttcagcaacttgtactagaagatttgagggtttctgcgtcatacaaaaagtgttggagagctagggaatcagctttaatagatgttggcgggagtgatgaagagtcttatagcaatttggctgaatatttgcatcttctgaagttaacaaatccagggacgataacacatatagaaaccgaacctgatattgaagatgaaaggaaagagaggtttttatatatgtttttagcttttggggcttcaatacaagtttttaagcatctgagaagggttttggttgtggatggaacacatttgaaaggaaaatacaagggggttttactcacagcaagtggtcaagatgcaaacttccaagtgtatccactcgcatttgctgtggtggatagcgagaacgatgatgaatggacttggttctttacaaagttggagaggataatagctgacatcaacacactcactatattatcagataggcacgaatcgataaaggtaggggtgaagaaggtatttccgcaagcacatcatggtgcatgtattattcacctatgtaggaatatacaagcaaggttcaagaacagaggattgacgcagttagtgaaaaacgctggatatgagtttacgagtggaaagtttaaaacgctttataatcagattaatgccattaaccccctttgcataaagtatctacacgacgtagggatggctcattggacaaggctatatttccctggccagcgtttcaatctgatgactagcaatattgctgaaacgttaaacaaggcgttgttcaaggggagatcgtcacatattgtggaattgctaagatttattaggtctatgatgacatgttggttcaacgcgcgtcggaagaagtcacaagcacattcaggtccagtacctccggaggttgacaagcaaatttcaaataacttgacaacatcaagtggaagcaaggttgggagggtaaccagctggagctacgaggtagttgggaagctaggtggtagcaattttgttgatctagaaaagaagcagtgcacctgcaagagatatgataaactgaagataccatgtggtcatgctttggtggctgccaatagcattaacctctcgtacaaggctttagttgatgattatttcaaaccacactcatgggttgcgagttacaaaggagcagtattccctgaagcaaatggcaaagaagaagacatacccgaagagctcccacaccgttccatgcttccaccatatactcggagaccatcagggaggcctaaggtagcaagcataccatcaacaggggaatataaggttagataaatattttgtaaatctcgtacattgtctaagcttttgaaaaactaaccaaactaatgcaacatgttggttaacatggtaaacgtagaaacctaagacaggaaggacgcagcagaacaggtgctcacgctgcaaaggattgggtcataacaggacaagttgttctaatccaatttgagaaattgtgttttcgaattttagttgttattatatgtgtgatctttaactagttgctatgtttttgtaaaatatttcagttctttttgtaaaactagttgctatgttttttgtaaaatatttcagttcttataattagttattgctgaaacatatcctgatggtatcgcaaacctctgcaataccgtttacttatccataaagacgtatccatatggagatgtttttttaagaggtaaagtagttctaatccattttgagtacttgtagttttttttttttagattgggtcattacaggacaagttgatgtaatccaatgagaaattgtatttttgaatttaagttgttaataaatgtatgaactttaactagttgccatgtttttgtaaaatatttcagttcttattgtaagacattcccataaatgtttttccgtttctgtaaacctagttcttgatgtaccaaatataagtatttatgtttatttattgtgttaaaatagtctataattagcatatcttgctaaaccgcaaatctgtgcaatcccgtttaactatccataaactcttatccatatggagatgatgttttaacaggaaaagtagttataatccattttgagtaattgtagttgtttttttagattattttttgtatagtcattagtatatgtaatgattaaaggtatttttgttgatttgaatcaaagtaaagcttgattgcgccaattattaatatattttatgatacaaatctctattcaacgtaattgtatacagatagaactatccaattttttattatcttttggctactatgtaagagaaggagttgtatcagaaactggtaaaataggatttactaacatgtgaataattacaaggggtcttaattacgtgtgattagactcggattcgaattagtagagattacgaaaaaccaaacacattagactaaacgaaagataaacgtgaaagatgaaaacataataaagctggaacaggatgtgtatcttactaaactaggaaagcagaaggatgtctcggaagaggtagaagtagaggcattgtgaacatctttctccgttaaattcattgttaagctcatgtattagccagcagtcaggatattcctcgtaaagaaaggtctcggcgtaagatccgaaacatttaggttccgaagcagaaatgtggccgataagcttgtttgccatcaaggatacatcaaagaaacacttgttctcgcgattgaaactattgaaatcatcaatgacttcgatacctgcggaacggtttagagcaatgttgagtagtttggctaaaggaaatctatctttacaggtactcaaaattgaaatggctccacacaggtcgaggcagcgaaatccgagactcaagctatggagatacaatgcgtaggggttccttttttctagacaattggagtagaaagagaaataaagagagttagaggaagacatgtagatgaagtgtgggcttttgtctagacgcactcgggttagcgtttcgtcagagaaagctgctaatttcccaacctgaccagctttaatccaatttttcaaagcgtctattccttgttccgaaacgtagctaacgattagagcaagtattggttccggaatatataacctggaattcttcattttctgctaaaagggtcgatgataagttagaggaatgattaatttaaggaataagtaaaggaaacatatttgtttgtttagttgcgaactaaaacctgttttgcagtgtgtccacgatttggtacaacaacgatggcagcggaaggtggatggatgtattactgaggaggaagatctggatcggcggggtggggagaatctctaatgtttgtattgagcagaacgggttataaagggagaaaggaaatgaaagtttctataaaatatttatattcgagagggataaagcttagtggggagaatgggtgcagttataaaattagttccataaaatgttggagacgaggtaacggtcgaagacttgttctctttataattgtgaaaaatagtggacaagtactacttaatttaatttaatatcgtcacatatgaaaaaaccgataggtaacttcacatataataacttcatatataaattctcataaaaaaaaacatagattcttaagtttgccgcaaatgtgaacaacaaaaagaagaactgaactgaaatttacttatgaaataagggctacttcttgggagaggtaaaagtaaatacatgtgttacacctctgtccctcatactcattgaggttctgatggtccgaccaacactcaccgtaatcctcaaactcctaggaatttttgtatgtcccttggcgacgtggaccaacctcgttgatatggaacattagcttatctgcgaataagtcgacttcactaaatttgtagtaccttcgcttgtacatcctataaaattcccacgggattgatccagcgcaactatggagcatgatgtaaagtagaccagcatgtgggaacacgtctttaataccatccaaaatagcaattgcttcctggagctcacacatatgaaacgccaacataaaataccaagatctgtcaaggcggacacaacttagtgtttccttggaatagactgccgctttaaataacagaccagccttaacaaaggatttcaaagaatcaacaccagattctgcaacgtagctaacaattttagcaagcatcggggccagcaagtaaacttctgggatagcagcaactgttgaaaataacgaaagagattgttagtatttttattaaagttgtagttaaaattgtagaatactaagtactttaggtttggacgaacaaccattttaacatctgaggcagatgatgtttcattgttgcttatcttcgtaaacttctgcataatttctctgttatttggttttaactgaagaaatgggtaatgggaaaaacattaatgaatgttgggtgtttatatagattattaaggaaagagtagtttaagtttttctgcggttatattaaacaagttataatcggtggtaaattgtcccgctataaatcagtttctcaatgttgaggagggaactaaaatcagatgcggaaaaaagtaagagaatacatcgtttataattagggtataaaagacaagaaagtaatttattaacctatccataaacaacaatccacgatagtaattgcttatggatttcaactaaaagtttcaacaatccaccctatcagtcatgtaaacaagtatatgttgagaaattagatatgttgggaaacaatattttcagatcaccaattatattccttttaaaactcaagcaatttgctaatttctgataaaaagattgtaatcttgatataaccgatcgttagtaaggtgcacttaatttatacaccttattactactgtactatttaataaaatatttgttacaattattacatatgagaaattttgaacaaagaaataactttttttattaatatatcttatcatttataaaaatattacaactttgaaaaaaaataaaagaagatgagatagttctaatcatcttctattagtcgacaaccattttgatttcttcaacttcctcaacatcaggttctggatacatggttgatataggtgcatagttaacaatcttaaaccagttacaacctggataaaatctaagaatcttccaccaagcaagagcaataacaacattattcttgcgaaatgctcgaaatcttttctccaagtccactgcaatttctccataagcctcacataccaatgtatccttgctgaaaatatgtaaaaatatgagattatatacttactataaaaatgtataaacatgatatgtttgaaaaaaactgtaaattgaggttttaagaaatgtactttttatccatgatcgtgaacggcaatttgaatccggccatatcattctcgttacttgcggtattagtcagaatcccaacattaacgagtgccccgataagatctataagagatatgttggagatatctttttaaaaaagtaatgttttgaaaaaagtgaatgaagtttataaagaagctattacttaccaaccaaggtatcgttgccaacaacatcatccacaatgtagtcaaatggagtgaacttgttgagtaaaccggtttctcttggtgtggaagaagtgacaatggtgtgatccatgaatagaatgcgaaactgatgaggagttgtttttattgcttcgcagttaggtcgaacgagaaacgtagttattgttttccattgattctctttgatcctgtcaaagtagaaggcagagaaacgaggaccgattgttgcttctatttgagtgccctgtgaaaacaacattttaggggtaagggatacactgaaaaaaagaaaaattctgcaaattgcaaaacaaattaaggaaaattgtttacccattcatcggccaaaacaagacgtagttcgaaagcgttcaggttaagaaattttttgtaaatcctcaaaaccatgacacagatcgtccaaccagtaaccatcggagacaactcgtacaagtggtgatgtttaaccatcgtgaaaaggagaagtgaagagtaacgaaaaacagagaattatggaaacgaaaatagaggatagtgtttttcttttgcgattgggttgtcttggtagagtcaagtataggagaggtatttatagcaagtgaaagtgttcctctgattgaagccaaaacggtgtaagttcgtctgcgaggaaaagatgtaacttttaacatccaagggatgcttacttgaacgatccgttgtcgttatgctctatgacatatttatttgagaatattaagtattgagttggtggtgcttgtaatattagatatataattcgtctgctgtggtttatagtcgagttatttatctgtaattgttatgctaaatatatgttctgtccaggagaacaagtccaaagagaaatgtccgtttgaaatttattataacgaggtgaccaaacgtatatgaccttagaggattatcaattggaattcatttatgctgaacgaacaaatttgatgggatttgacttttcataggattaaatagtgtataaatgatgtattttaacaaaaacaaaagcagaacatcagaaatgaaaaaggaaccacattgtctttcaaagtttgggactatctgttccattctttgatttgtatcattcatgctctccatacagctccgcccatagggtagatctatagcattcggcagcaaaattctcatatgctattggtttgtacattacagctttcaaagcatgtagatttttggcttcaagacattttgtgaagaaatgataataaatggaatgcggcatggaccaccacatgaaataacgagatttgtctatgcggacacaactcagtgtttccttggaatacactgcagccttaaatgctggaccagccataaccaagggtttcaaagcatccacgccatctttggcaacgtagctaacaattttagcaagtattggtgacgggatgaaaatttcaggaaaaacagcaacctgagataaaaaaaaacaaacatatgcagactataagtttttgtttacaatgaatataaaacatagaaaactaagtagttttgtttatgttgaacaacctttttgacactagatggtatttcattcttgttgtcttttgctaacttgagcataatttctttgttttcaagttgaaacggatggaatggggaatggaagaaacttaaacaaatcgtgagtgtttagtaactgtatataattatgctcaacactggataattatctataataaacaattataattaaaactaaaaaaaataaaactaaaaaaaaaaggataatgctctaactataattgtgctctaatcataatgtccccggatttgtctcgaaccataataatcccagttttaaacctgattgtggaaatattcccgctatacaacagtatctcaatatttcccgtagaaggaattttagatttgtctttcatggtgaaagagaaagataattgttaatatatccatatgaatccatccacaacataactgtattaattcgtttgtctgattgaataattcactatgacttttagacatttatattaagttttaacgtatttgtaaacataattagctcgaatgatttataaaagcaacaatagttcaaaatactcaaaattatttatttctcttgaaaaaatggggttatggatggaacaaacaaataatatgatacaaaccactacaacattcaacagcaatatagagataagattattttgtgggaatggggaatggaagaaacttaaaaaaatcgtgggtctttagtaactgtatataattatacctaacactggagagctaaccataattatcttctcataataaacgtgataattaaaaaaaaaaaaaaagaataatgctctaactataattgtgctctaaccataatgtccccgaattatgctcgaaccataataatcccagttttaaacctgatggtgggaatattcccgctatacaacagtatctcaatatttccggtagaaggaattttagatttgtcattcatggtaaaagagaaagataattgttaatgtatccataagaatccatccacaatataactgtattaattcggttgtctgattggataattcattatcactggatgacatttatattaagtgttaacgtatttgtaaacataattagctcgaatgatttaccaaatcaacaatagttcaaaatacgcaaaattatttatttttcttcgcattgtgaactgatatcaaatgttagatgcacttgaaaaaaatggggttatggatggaacaaacaaataatatgatacaaacccctaaaacattcaacatcaatatagagataagattatcgatatggttaagaaaaacaaaaaacatatttatagaatccagagttataagcattcaaagaagggggaatcaacatttatattacaacagatttgtagggtggcattccataactagtcagaaacattagatgaatagagtgggcagacacattgtttatatatgtccatggcatattgacgcctaaacgcgtcgacgtgtttgtcagtaatttcagccattttatctgggagtttatcacttgcctggatctcgaggaacttcatggcaaccgggccacagtcaccactccgcaaattcttgtagataccatcaattcgactccagccaaacggttgaagaccgtgattctgagaaaactctggcgtacagtacctttggatgaggtggggcaaaagattgactactggctcaatgcatctttttaccttagcgtcgtcgtagaggtctgatttgggtcaagaatttcaacgctccatatgccaagattgattgaaagaccaacccagtggcaatcattccatatcatgggtgcgtaaattgtatctatgtccttgaaccattcagttttggatcctttgatgaagcgctgcatgtcctctgaccaacgaacacgtgatttcaccttcgcagcgttgaaggctctgaatttagcttgtagatggcttgtgaaccatggatcaacaaaagcagaacgatgattctcaagtgtagttgtgagcctccgagaaagtaatgacaccaaaacctccatgtgctaggaaataaaacatttacacattagtatctcttgttaacaggttaatttgtactaaggtaaatatagtggactacataccagggttgaaacccattgctgaggtttggcaagtttgacgaagaatttgttggaaataaggaatccacacttggttagatgttcactatgaggtaaaaaaacagcattagtgaagaacttgatgataaatgttgtggaaataggaaaaatgaatgataaccatacatatttggagagctcgagagggttttgacaaactgtgaatactctgctttttttagtgttggtaaaagggcttgtgtctcaagtattggttgcgatatgaactcggctacgagacgtgcttcagcttgggagagatttggtttttctcttttatgcgccggggatgaatcagataactcaaaatattgatctggttcctgggcaagtgagttagagtgttctgagttattatcctgtacaggaagataatatatcagaccaatagggacaagctgttacaaaactgaaaaatcattccctagtcattattaacaaaagtcagtatatgttacgcaatacctcgttccttgtacccacaatattgggactatgtgtgggagatgattggggctctttgtcatctttggaacttgtatcaaatacaggcttcccaaacacaaccattgcctggaataagaagataattttaaaaacaatccaaacagagctgtccattaaaacataccagaaaattatgatacatgttataccttcataggatcagtgttgtctttacaaactcctgaatgaattgctgcagccgtctccatggtgacctgaatgtttagggttcacaaagagatggtgagaaaaacataagaatatataacctgcaaattatctcgaatccacaaactccaatccaatataaaagtgaacatgcaagcctaatttagtttagacataaggatgaccttctttttggagaacattgcaaacccagacaatgaatgagctgctggaggcgtctccatggtgtcctgaaagttgaagtacacaaaaagatggtgagaaaaacataagataatattatctgcaaatgttaaggtatacacaaaatcatgtcgattataaaagtgaacatgggagcatttttctataaatgtttgttgcataatgcttgagagatgcatcaaacctctacaatctccaataaatcaaagaatgtaaatcattagctgaaactagttagaaatgtatacctccataggatcattgccaatcttttcttcgggttgagcctccgacactgaatgcgatgatgcagacatctccaaagtaacctgattgttgatgtagacatgtagctagttagaataaataaaagaaattttgcctacattttatgaagtaacaagaaaatcatgtccaattacacaagaaccacaacacataaaacttgatgatgattgttacagtataccttcatagaatcactgtcgatgttgacttctggttgagtctctagcaatgaatgagatgctgcattgccctgttgagaattggcctataaatgttgttttggaaaagatctgatagaagaagcatccctctccagtgtcaaataaagcaaggaactagttaaaaatgtatacctccatagggtcatcgggttgcggtagttccactgagtgagatattgcagctgactccaaagtgacctgaatgttgaagtacactagtaagtatccacaaaatcatgtccacaataactatgcacaagtgccattatttatattaaggacaaaatccaatgtgttaaatcaaattatgtattagcctacctccgtcatatgatcatcgtcaatgttttcttcgggttgcgtctccaacactgaatgaaaagtttcaaccgtctccaaggtttcctgaattatgaattacagaggaagaagaagtaaggactgtgaaattaatttggtttaaggagtgggatgcagaaaccctctccgatgtgttccaacaaattatttattagcttacccccctcataggatcatcggcaattttaacttcgggttgcgtctcgaacactgaaagagaagcttcaaccgtctccaaggtgtcctgcatgatgaattacaaacagatatgtcttaagggctgtgacaataatttggtttaataaagttctgacaataatttggtttatatataagcttacctccataatattgtcttgctcgagaggagattgttttttttggcttaggtttgcacttgaatcaaactgattgtaaagtacagtagtcaattgtgtcagaatctctaacctgtaaaataaagtgtttgatgtgttgtgtttgtatttttgtacctggatttttccctcatcatctgcttcatggccatttggatcttttagaatgtactgagatgctgcattgccctgtggagaattaccgtctggagaattggcctgtaaatgtttttttggacaagaactgagtgatgaagcatccctcaccggtgtccaataaatcaaggaactagttgaaaatgtatacctccatagggtcatcgggttgcggctccaccactgattgagatgcttcatccgcctccaaattgacctgaatgttgaagtacactcgtaagtatccacaaaatcctgtccataataactaagcagatgtgcaattattatgtttacggtctgtgatgcaccaaccatttccgatgtgttgcaccaaatgatgtattaacttacctccataatattgttttcctcgagaggtgattgttttttgttgcttacgtttgcacttgaatcaaactgattgtaaagtagaatagtcaaatgtgtcagatcctataaactgttaaataaagtgtatgatgtgttgtgtttgtatttataaaagtacctggatttttccctcatcatctggttcattgtcatttggatctttggcaccagtgtcataaattggattgtcctctgttgcatcatccttataagaatcctgtgattcatgtggagtatgattgacatccatggggtcatcagtaatcacctgaaacaaaatattttgacgtaatcaattctaccaaagagatattggaaattaaatattacactaaccgtgtttgtcaaagttgttctatcaatggattcatcttgaaacttcttgaattcatcatcgtggactatcatagaagggtgggaaagaggaggagaaacatcccatgaatcatccttttgctcagatagatgctagcaagagtgataaaaattgattaagtacatatagatgtggtaacagaataaacaataaacacataaggttaaaacagcagacctcaatatcaaaatcctcattctgttcatcagacatcgtgtgtgaatgagatggattctatgaggaaaataaaagttttgttatgcgttaaaacttgaaaaatgtataagtagatgataaagttcaaatattataaactgtttgaaatcttgattacctcagaggcttgagattgagtaggtacctccaatgacttcttgcgctttgaactagaaacaaatggaacaaaactgaaagccggttttctggaccgcttgaatctgacagtttttcttttcttttcaagcttcattacacgatttgatagctcttccatcttgttttgtagatcaacgagcaacctagacttctcatcatcagatagccttacattttgattaaaacgagttgaatacctatgcttggatttgggagggtcagacttcacccgtagtctcttcttacgatccacaatatgctttttgtgaacaacagaagacttcttctttgggattttaattgatggcaatgtagtatcacctcctggccaatcactttttttgaattgatgagctgtcagtatcaaaccattcatgtaagaaactttcctgtctttcagctcgtcatcccactctgcccaactttggtcaacattaatatcttcacctataagcggatccacaggtctctgttgaaaaatagaatgttattattagttaataagactggatatatagaaagagaatattatagagactatataaaaacttttgggttagaaaaaaaccttaaggttgctttctaaagagtgaatctgatgaagagtaattagttatgttggatgagttaaattcttccaatgaaggattgtcaaggaggtgtcgtcaaacttcagcaaatccaccattccaggtatgtttcgaaatgctaagagctgcagggcatgcgggaaacctttaagacggaatgtgatctgctggagttgcttcaccaaattctgaataggatcgtttgtgagctgtcttttaccggtgctcttagcgagaatccgtttctcgggtgtcatcgcttcaaccgtcttcataaacgactctctaccccaaggaaacgaaaggaatttctctaaatctgccaacatctctacatatttaaatgtaggcctaccggtttggttagatgctatgaggacaccatctacaatgagtaggaaagcgagcttcagtttgtggtcagaagacagtttactgggtttcttggttagcatggcagatatatcccctaatgtaaccgtattgtttggaccaattaactcattccagtagctcttcttgccatcatcataaaccggagaattttcagggtcatactcgtcaggaaactccccacaaggcaagccagtcacggaagcaaattctagtagtgaaaatctcattgggtgtccaccaaaaactgtccaaaactcatactttttcttagtaagcaactgtctacataacaaggcatgaatgaccttacccgaagtcgcaaccctactaactggcaaatggaataaaggaccaaagcaagactgaagtataaaatctaattcctctgtcccatcaaaaaccttcttgataaaggatagaatatctggtctagagtatacgttcagccttcccctcggataatgatcggtggcgaagagtctatttggaaagtttgaatcccactgagaagatggttcctgagatgtcgaccttgttcattggcaagaaaccagttcaagagataacgattagattaacgagtatttgtacaaactactaaaaccacaaacgtctgtgcttagctacaaacaattgggaaacctttttcgattcaaaaaaaaattgtagaaacattcagcgagaagaggatttcttcttctcagttaattggaccaaaataagatgattggaaacgatttgtaccttccattgagtattccgatcagtgagaatcaactggaatgctaatgaaatctggcttacgagaacaataaatcgaaatcgaattcgattattgcagagatttgggggaaatgactatttggtttttattcaaagagtatagagttgcctgagtggcagattgatggacagcgacggaggagtcgccggattcggagcagtcgccggattcgctggagtcgcgatgtggagaaacagtaaattaggttttttactgggtaagcgtttttttacgatcgtggttggaatatggagttaacccagacggttgataagacgtggttcaaccggaaccagtttaaagaaaaccggctatatttgttaggttttgtttaaccaacgatttcagggtaaaggggtaattccgtttgattaaagtgactaatgcttttaaagtgcctatttgtggccaaagtttcaaaatagtgcctctacgtgtaatattctctaatattatttacatgtattatatcatttaagaacatgttaatttattaaataatatatatacataaataatttggtgctatactgaaatctctaaaagattttttttttgtttaacaacaaatcagttatattatatcacaaaagtgttacataatacatgaaatcattcgaacacaaccatctaacgattttacgattttggcgagaaaatatgattttacggttttggcgggaaaatatgattttgcggttttggcgggaaaatatgatttttgcggctttggcggaaaatatgattttgcgattttggcgggaaaaacaaattataattttgacgtaaaatgatagtctgtgatttcacaatttttagagtttttttagtacaataggtaattttaaaaaatatattaaataagaaatctatcgaaaattaacattattaaaagagggtatatttgtcatttgtttttggactaaatcatctccatccaaatgattctaccaagtccatccaaatgaatttcacaaattagcctaaatttacaaagtcattcagatggaccatccaaatggttcatccaaatgatctgttaatttatcaaaaacaaacatcatttttcatctccatccaaataatccatctggataaagaaacaaacagaacctaactacaatatttagaataatttcgatgaataaatggagtgatcttacttttccaatgaaaatcgtacatgcaacaaataaaatatattaagtttccttttcatatagtttccttttaaaaaataaattatataggacttctcctccacaatgtaacataaagaaataatcataggatatgtaaaaattgtttatcacataataattattatgaaaaaggaagaaacgtagattgtaataatttaatccatattaaatcaaaaggacataatttctaatataagtatatatacaaatactccaataagcatccaaaaatatagagcatgaaagtattgtataacagccacggttgtttatcgtactcgattttttttttatcgtcaacttaactttccattaataaaattacgagacattgtactctataatcctaggagaatattgttgataaaatataatttcagactcctgtcgatatttataatttaaaaacataagattccttttatcatgtgttaccatgtgttgagattgggttatagagccgcccttctacaaggcagaagaaactcttgctttaggccattaattaattactgaactaggaaacgtacaagaaaaaaataagaaactaactttagcaccaataaagatcatttcaatagtttcaatgtttcactaacattaactttagcaccaataaagatcatttcaatagtttcactaacattagtatactgtagtattgtttccaaagtcttatgattttataactttatttttacatgttcctaaaagatttcaaatcaaaaacactgttaaaacttaaaagagtgggtttgcaatttaaaaaaatatatatattcgaagctcttagaaaattgaagatttgaggctttagctgttaattcaacaaatgttcattggactttttttgaaaacaattttatctgaaattgtaatactttcaataataattaacacgacaagttaaataactctacgtaaacatttgttttctataattaacactatatctcacgtagaaaaaaatgtttacgtagagttttttttttttttttttttttaacacgatgtttacgtagagttatttaaattttcgtgtgttaattattactgaagtagaacaatttttgtttatatattaatatggatgtttatgacgataatcaaattcagattattagttgcataattattgacagaaaagtgttaaatgctttgccaaaaaaaaaaaaaatgttagatgctgcaatttgtaaagataagtatccctttagtgcatattttatcttaattttaatttccttataaataacaccaatggccaagattagttattattactaacattagtacaattttcgtttatattaatatttttacatataatttgtttttcaattaatatataaaggatatatattggatttggggaaacatcctaaacttttcattggtgaagaaacttaaaaaaaaaaatcactacattaagaaaaagaaataaaaataagaggagtcttgttttgtacatagcataaccaataaagttaccagaaccgatctttattgacactaagataaccggacatgactttcccaccagtattcctcataccatcgatgaggaaacaccaagtggaacccaaagctccaacgaaaaaatcagcttctgacgccattaagaagttaacaagaggatagttcgtgcttgtctctctcccaaggctagcttcatactcagcaatcgacttattaccaacttgtctcgccacttccgtgtaatagaatctccaatgatcataatctttacttttgtccacaacttccttcatctctgtagacaaccagatcttgttaagctccggaaatcgatctttgatccgatcagctaaatgcatgtactcttctaaagccgcgactctcatctcacacgctttgtctcccatccgtacgtgcacacttagcattggccttggaacccacggcttgtggttcgaccatacttgttcctcaatctctgtcttaacctttttcttcttgttctttctccaatctcccgctgaaagaacaatctcggcagcttcttttccaaacgcggtgtttcgagcagcgttcattaaaccgcaagtgtatgcagtttgaaatctcatcaagtatctcactgcttgtgctctccaccatcttcgatccatttttcggtgtttagagattaaacttccgttgatttctgtagtaggcttcatataactccaaggcttaccccatagttttggtataggtccagcccatatcacctttgagctgtagttttgtttccctgtaacagtaccactctcccatgcttctttctcccttacaaccgcaaacgcgcgtttccgacactcttccgacgtttcaggtagaaaatagcatgaccatcttccacgagaagaacctgaaaaaccaaacaaattaaattccaagaatttagttctttttcacgggaaagtataaacaatgagacttatccgcctacaacaatgttttactcgctctcttttaatttatttgtagtttaagaaaaaaaactttctgttgctaaaatattgttttcaaattaaatatatttaatagttttgaccaagttatatctaatataccgtatattttttaattggttgaattagttgtaactaataacatttttaggtaaaagaagtaaattaaatgagattttttatgattttttaatttatgtgtaaaaaccttaaaacgacaaataaatattgaaataaaggagtattaaaaataattacgaagacggaaaataacatgctaggtaatgtgttagctgagtaaggcatattgaaaagaacaaaacattgtatacctctgcaaccatcatgatctgctcggttataatgatttgcaacaagcactcggttttcgtttatagcgattgcgagaagaccagtcatttcagtgatctgagctccggatccataaataggaagtgtttcccaatcaactacaaggaacttgacagtttcgttttcgcagtccaaaggatgttgatgaatccatatctcactttgtactatcctagttaacggatagttctgttcgtctcctccagtgatctgaaacaagcttggtttttaatagtcatcatagttattgtttgatgacaaagaagaataagaagcatacccaagtaggaaacgactggttcgctatccgtgtatctaaacgctccctaactcgtgatatcacctcacaattctccaaatgtggagcgtttggtacatcggatttgttcatccctagtttcttcaagaagtcttcattgtttagtactaaattgtcccaagcagagaccaaaagttttacttgatcatcattatctcctttctcagctttgttcgtccatttcaatttccggtccatgcttgaaaccatatctatatatcaacaattttcattacactaaaaataaaacacaacaagttacaaaaatgctaaatcttttgagacttacggataatgtgagaagtggaattgtaaggaagaaaagcagaggaggaggcagataaagagaaggctgcgagctcgaaggtgccaagggaagtaagagctgctaagaagagtgaagtgaaacagattccacatagaatcccaactacacagatttgacatggaaatgaatttccaagttttaatgctttctctgaaaccattctgttcaatgacttcatgctcatactaatctattgtctaactaagaacgaaacccacttgttggtacataaacatatgaaacggatagtgtacataactatggagatattaaatgagaggaatacattaaggttgatcatttctaaacgcaaatattttaaaacatgttgtaaaagaaaaatattaccaaagaaaaaaaactgtagaaaatctatttaagtttttgaaaaatgtgaatttcaaatttaaaatgacacttgcatcataaagaaagatagaacaacaaaaagcctgtttaccagcttgtgtgaaattatggcagagaatcaaaacacaaatccactcgacattgtttacgtataaatttgtttaaattactaatcaaagtaattaattgaagaaaccaagaatataatattaatttatgttttatggaaagggagagaaaagagaaaaagcattgagaggttaacctcgaatctcggtttcttaggacaaataagtgatttaagtaagactaagactttgatgtgagcgaggttgtgtgtttgttttctgttaaaaaagtaatattatcatcacgtggtttattactaaactatatcaagtcgcttctactttttcaaacacgccaaacgaattgtaaataatggctacactagatacaaaaatttgaagtatattaattgataagttgtaacacctcaaatttaaagaaaatataatcaatttaaggttaaattaattaatttaaaactatttgatttcgaaggaatttctgatcatttcaaaagtttgacgcaaaatcgtaaatagagaagttcagagagtaaagtgcaaaaatgatcctacttaattctgaagttaaaggaatagtttttggaattttaatctccatctaaagatttgaaagccgattctctcaacaaatagaggttttagtgagttttcgagacctttcatatcatctcgaatttgagtatttttgggcaatttgtgaccggattttgttatgacttaggttgatcgtgcttctccatattactgtcttcattctggtttatgttctgcttcggtagaagagtttggtaagccttatcttcttccttcttcaatttttctcatagaagtgatgttcaacctctttagtgggggatttctttccaggaagaattaaaacttaatatataccttgttaatatctcttcaatatgaatcaactgccgctgagatctcatcaaacggaaatcggaattgatggaaatctgattgataaatattgattttgttgatttatggtcaaatctgaatttatatacaccggttcctaaagttttgaattacagttttgggatggccattctatgtaatactcgcttgaaattaaattttaaatttgttgagttttaatttttaactgaatagtaatttggatcggttcagcttcttttagaccggtttagtaaactctgatacatgaatacgattgcacttgaatttagctttcggatgatatattgtacgtatttttctgatttgtgttgaatttaggtgaattaattagtgatttgggacatgtgtagaattgccgttaacactcgttaggtctgaaattttttcccaggttagttcaaactcccttttagatattatatagttgtaaaatatttcaggagtgagaaaataaataaattaaattagttgaatgataagttgaaaaataataatttgtttgtttgtttagataattaatatgaatataatttttggtaataagatttgttattctgtttagaaataaaatattatattctgttactaccggtatcagcatgcaattctgatttagctagctctgttgagcaatctgtgacggccgacatcgccaacagctatattttatgttagtctgtaagtggtattgaggtcggttattgatgtgtatcgtacttccttatcacctcgttaggaaccaacatccttatcggttatattatgtatatattctgttagtaaatagtttggatcgaccaaatctggagtagtaccatttcaacattgcattgatggatacctggtcaatctattccgatgttattattttgttctgctgatattattttgttccgatgatttgatcatgtattttgatagtataagttttgatgtgtttattttttttacaattaattgaaatttatgtctcttagtaccaacacgtgaatattaccatgtgctgggatcaacctatgttggcacttgttcgtagggtttgtaatctcactcggcgatttttgctcacacaagttctgattccgtcagagggcattgacgaggagcattataaagctgagatttagaatttgtttttttggtcgtagagcgagttttgatagtttttccaaagtttgatttattttgtttttaagatttggagtttgatttaggctcgataaaatatttgatagattcacttcgatctggtattcgactcgattcagtttgaaaaaatcatatatccgtaaatttacaaagtaaatcaaatactaaaaatagaaatttgtcaaaagagaatcaaataacaaatactataattttcataggcagatattcgctccgctcaggaatacatacatatatatatatatatatatatatagataatttgatatctaaattacaatttttttttaatgtgttttataattttcttatcatttaaataatcatttgaactactagttctaacaattaaaggagatatatatatatatatagatgactgataaaatattaatattttcataaaagtttattattttggattaaattttaaattattgtattttttattttttaaaagtaaatatttaacggatctaatatccggcaaatagtttggattttaatggatgtttgaactgctaaataatcggtccctatcaaaacaaatacgactcgaaaaactaggggggttattggatcattgatttgtatggatttggaaattcaagtaacatttgtaaattcacacagaatccatttgttttaaaaatcaaacaacgtggatttgaaagtcaaataaagtggaatttaactcaaataaagcagatttgaaattcatacaaaaggattataaacattacaatctttaagaaataatctgtcacgttatgatctatgaattctcaattgaattgttccacatgtttgatgctattgtttctctccactgattggcatattctctctgttgatcttgggttgtaagaacttcatcattattgtcattaacttcttcgacaacttcttctgcactttcgtcttcttccagaaaattatccgtttgacaaaactttcgaagaaaattatgtaaaccaacacatgcaagtacaatctctgtctgcgtcttataaggaaaaggaggtgcagatttaaagattagaaatcgagatttaaaataccaaatattctttcaaccacgtttcttaaggatgcatgatgatggttaatcaactcttttgcatccgttggttgtgaattttgaccagaatattcttgtaggtgatatctgacaccacgatacggagctgaaaagtttcgacgatttggaaatccacaatctactacataaaactttccagaaatacagtaataatttcttataaaagatacaataatatatagcacttgtcttgttgaaaaaaacatatttacaatataaaaacatgtacttaccttctggaactggtagtcgattactgttccttgtcaaagcatcatttaatacttttgagtcatgagctgaaccttcccatccactaagcacatacatgaattcgacatcaaaattacaagcagccaacatattttgcgatatatcaccttttctgttacgaaaagaaggcatttttttttgtgataccattgcaaagatatgtgtatcatcaatagctccaacacaatcctaaataaacaaaaaatttatattccatgaaagataataaaaaagcaaagacataactttatgaaagatataccttaaaatacggataaagcctcgtactttctctaatttttctaggcactgcaatctcaggcttagccattaaacttggagcaatttgattaagagcccgcaaaactttgtgaaagttcacgcttgttgcaaacgttgacctattaaaagtgttttttgtataacaataccttgaattttggccaactactagaagaaaagttgcaaccatttcttcaacactaatatcttttgtatcgcataaacttgtctgctcctggagttgttcacataacttcaaaaaacgtttgcggatacattcgatacaactgtcgaaaatgcatagagttttgcttttgcgcattttctatatagatttctccgtctcttgtgatcgcacgacgaatagaatattgaagtccatgtcgtaggcatttcctcaaatacaacatccaaaaagaaatcaagagcaccaacaaaataatgtgagcatcccactcgtcatcatgtaatgcattattttctctttcttcaaggagttcttgatctctataatgggctcgttccatgtttgacgatgtacacctgtgaaacaaaaatataactcgtaaaacttttcttacaagcaaatgacatgataattaaaaaatcaagcaacaaaaaggtggagacgtgtattgaaatctcacaacaagaaagttgaaaaatataattaacatataaagttaagaaaatacacttacaaatttatcaatggtgcgccatctcttttcaagtctcttgtgttcttatagatttgtacttttattatatgtatattttacatttttattttatgtaaattttacgttttacaaacacacataataccttttcttttatgtacattttacattttcaaaatgacaactgtgagataaaagaacacataaatgctcgtagagaaagtgtatatacatatatatatatatatatattgtgagtcaataaattgtaagatttctaataagatatgataaatcaccattttcgtaagaacttttaggtgaacgaatttttttgtgagtcaaaaaattgtaagatttgtcaaatcagcatttttcgtaagaacattttacatggtagctttctaaagtggattcatagatacagctgtgatatattacaaaaaaatttgtgactcaagaaattgtaagattttcaaattttttaatcgaagatttgtcaaatcaccatttttcataagaacctttaggttaacgaaaagcctatattaactaactttttatactagtttttatgtagcattaataaaataacaatgagcaaatcacaacaagatcaagaaaaaaatgcataccttccatggagtccacaagaaaccagaactttgatagatttacttttagacggtcttgcttcgggttggcgtaattcaagtggtgtgttcagcaagtttacagtggaaagaaaaatactgcctattgttaatcgaaaacatgaggatgacaaaactcataaacactacctaaacagaatgaagaccttgaagagaaaatacgtaagtggtgttgaacttcttagttgcagcccgggtttggagggcatccaaacacaaaacggtttacagcatcagataaggtgtggaataattatataaaggtaagcttcacatacgtacattagctttttcttttagcttttttaatataattttaaatagtacgtggaaggttgcatcaataagataataaaaaaataaatattgaaatttgtaattatgctaaaatatatatttctttgaattttatgcgcatccaagttacaaaaaattcaagagatgaaacctttgaagaatttgatgatttcaagatgatatatgaggacaacatagcaaccggtgggaatgctattggattaggtgatgatacggatgctcgaacatgtgaaattgctggaaaaaagcaaacaagttctattgaatcttttttaatggatgtcgaggaagatcatgaaacacctttgccttttgtggacaacaatttaaggggcccttcagaaaaacttcctatgagaaagaagcgtaaaagcaatactaaccatgtaggtgaaccaaaaactcatagtgaagattcagaagaagtccataccgagatgaattcattgacaacagtaactcataaactcttcaatctaatacaagaaagagaaacaagacaataaagagaatctgaacaaagagaggctgagaagaagaaaaataacgtatgagaagctatcaaagaagttcttaatttggaaaacacagttcgttacgatgccgttaaactgattcaccgattgatgatcgttatggttggattgtgcgtaacgtgatggagtgctataataattatcttttgtttacaagtatcattggttttctataatttttcttctagtctcatatggttttcaaaagcttctctttgttttctagtattgttggtttttattatatgatggtgtttcatgatctttatattagcagttttttttcatgattgatatgcttgaaggttttattctatttgttgttcaaaacattgctatacaacaagcgaccatacattttttaaccggatgagattaaaatataataaaatattgttttcttccaaatcaacccaaataactaggtggaacccaaggatttcaatcactctatttataagtaaagcatatattcaattccattcaaatctaatatgaagtcaaatccatactcaaatcttcaatattgaataaggggtgattttaaaaattatttgtaaatcatataaccaatatcacataatttttataaaacatttaaaatcaatgattgaataacacatgattttacttggatttccaaatccattcaaatcaatgatctaacaactccccctaagtatttggatcacgtaaatcggatcacaaatatcactaaaatcccggatatccgctctgtgccaagtcctagttcctacgagattttaattttacactttataaaatttttagtattaaatttagtaaagcttcaaagattcttttgaattttcggggtgttacataagtgaaaactcaccgcattcaacactagagaaattatatatgtatatgattcaaagttgacgtaaacaatcataattactctaaatgaaaaaaccctcaaatctgattttcgatttttctggtgatgaaaaaatgataaaattgtcaggatttgctttataatatagaatgttggctttttttacaatacaaaaacacaaaaataaaaataaaaaagacacaaaatagaaaacccataagtaaaccataacattctcgcacgtaggtgcggatcaggatctagttacctatgtaagcaatattgctcagtattagcttatttgagtcaatctaataaaattgtaagaaaaaattacgattatttctgctttagttatacaaaaatcattctgatattatatcgtaatcggagatttcaagaattagtttattccataaccgttgtgacaagaacgcatgtcaggtttggcaaggagtgaacaatacttatgcataaacatatgatcatttaagttaatatattcttactgtcattacaaaatattgaacgaaatagtaaaaacttatataaagatctgtttaaaatttagataagttttagatttatagtttagtatgagtaaatccgaattgtatgtctatagacattgattttcttataaatcactttcacaaattttcaaattagtagcggtatgcatagatattttgtcatctcccatcgtgttatagattaatatatttgaataaggagtacaagcttaaatttgttgacaaaataatgacacagtacctgggtttttttttttaaataaggttcatgtcactatttgtatttgttgttccctaaatcattagttctttttttttaccgccctaaatcatctctacactattatttcagtaatgttgaaagaactttaacctatcgtgatgtgttatattacattacatgtcatcgtgatttcacataaacaaaaaaacaactagagggtcaaatacataatttgacaaatcaagacacgcggatcctctcctggagcagtggaccattcgacgtagagttgaaatctttatgatccaatcacccacccgagacctgtgttgtaataaggcttttactttcagtcttcggagtccaaccagataaacaagcccattgtggattaataaacatttaaacatttcagtagaggcaaaatatgttttattaggtaatcaagctacattttctgaacaaagaaatcaagtttatcttcacttcgactagaaaaagaggtatctatctagatttcttaaaatcttataaacaaccaaatcatatatctagattcaatatcataatttagcttcatgtatttagcctaataaacgaggtttctacattatatcttaaaacagtttcgattccatagattccagttatgcagatttgttttcagaatattcttaaattctatgacgattatacaagctactatttcctaaaatcttataaactaccaaatcagatatctatcttcattatcataaatcagcttgatgtacttggccatatacacgggatttatacattatatatcataacagttttgatttcatatcttcgagttatgcagatttggttccagaatattcttaaattctattttgattataccatttttctaacctaaacaatgtatgattgaaaactataaatactcacataacttacaaccctaaacacatcaccctactgcaattaaatagcaacaagttataaacaaaatgaatggtgcaatggctacgacttaccttgctgacctgaagcccttcaaaaccagctggcgtgtgcaagtgaaaatcctccatacctgaaaacaatacacagctcagtcaggagaaacactcgaaatggtactagctgatcagagggtacgttcaatctaaacattttttacaaattatgtgtcgagctgatttatagaatttcgttttctaatgttatataagaactttccagggatgcaagatccatgcaagtgtgaaaaaggcactggtgaaaaagtatgaaaggcacattgcccttgatcagtggagaatcattgagaacttctttttgggtcaagtcaggggacaattccgtgtgacaaatcatcagttcaaaatggcatttgttaacagtacatttgtttcaccatgtcctaccgtgactaatgatgcctacctgtcattaccaacgtttgaatccattattgttggtgaattgaatctattctatttggttggtgagtagtaacaaacgatattatttttgagtattttgatttctgtcatctatatgaagtgaacctaacacaacactacttattgcagatgtccttggccaagttgtcaatgttggcaaagttgaagacatagttgtcaacaacgaatcaaccaagaagctggaatttgagcttcgaaacgaaatgtatcattacttttttagaataatggtagtatatataaactatattgattaataattgtaaaatggtttgtgttttaaggaatgatcgcctgccatgcactttgtgggggaagtttgctgatcaggtaattcaggagtgtgagaactcaactggagagattgttgtgtgccttattaggtttgccaaaatcaataccttcagaggtaaaatcctaaaccgttattttaactctgaagttgctattactatgatagtgtacagattatctctgaaacgatttactttttgttttcgtttatgttaggggagaaccaaatcacaaatgcttttgatgcttcagttgttaccatcaatccagagttcccagaagtggaacatttcaaaaacaggtaatcaaatactatattgtaggtgttttgattgctaataaatcatggatattaagtttggggtttattggctgattggtaactacagtttgccaaaagatggtcttgctctcaccatttccgagactaatccaagacgtgaattgtcattcggaagtgatggttactttgaccagtatcccataaaatctatttcctgcttacttcatttcttagaggtagccatattgaataggaatgtatagagttttaatactgaaatcatatcctaatagttgtttgaaaaaattgagtatattttcaggttcaaaaatgcaaggtcatgtgcaagatacatactatagaaggtgattttgggtggttttatgttgcctgcaagaagtgcagcaagaaagttgagatgaacaataaggacaagaccgccattgccgataaaccaacaaagactacatactggtgtccaaaatgcaaccttaacatcacacaagtggttccaaggtataccatttcattcctttttatataattatattattgtatatgtagtctatgtggatcactcattaagatgatttcttttgctcctaggtttaagttgcatgttggagtcattgatcaaacaggagatatcaaatgtatcatgtttgatagtgctgcatcaaagatgattggtcattcagcttttgaccttcttgatggggtttatgatgatgatgtgagtaatgacaatggaaaaatatatctgattggttggtttttcactaatgatctatcgattcttatagactatcattgataacacagctgcaggatcctgaaagaatgcctccttctatcaaaaacttggttgggaaaacctttcagctacttgtgtgtattgagaatgacaatttgtctggaaggaatgatacatacatggttggtaaggtctggccaggtgttgatattgtgatgattgaggatgctgatgattcagagagagcatctaatcattctcacaccttatcaaacatagaggtatgattgtattttccaacgtctctaaaatacttaatggctggaacataataataaaacgtgatgttttttttgcaggccatgaaattactcactcgcaccagtgaagttagtgagatgttagtgtctgacactgctacgcctaaatccagaggtctatcgatgatataacagtggagggatgctctactaccaagaagatttgtttgaaaccagttaaattggagaaactagatgagaagaatgatgaaatggtcggaaatgaagaagatgagaaaaagtctggggtgaacaatgaagtcaatgagaatcctgagccggattactcagaatacgctggcctctgattatgtccttttcaatacctcattggaaagaaccagcatgcgaggagaagatattcatgtttctgtattttttttctttcatgttgatctaataatgtctacttaggaaatagcagagtaaatgatttactctgattagtagtcaagctttccgtttcatttttgtttttcaaatttatcaataaaatcttctcttctaaacatattcgtttttaagaacaaccataagacatgcaataggaagaattaactaaccttattatactgtccttgaaaatactgtttttctttcatgtatcccattctatgttaatctgcatattaaaaagaaatttaaaagagtactgaattaaacatatacacggaaagaactaagtatacatatgacataaatatattaccaattgatagccgaagtgtattgtcatatatatgctttatataagttatacaataaataggacaaaagtatatgtcatatactcatttatgtgtgacatactcgatccgactaaatttagtccatcaattctacattgaacactaggcctatatgcatatttataaaatgaatatctatttataaaaatatcagattacgtttacaaaatttagtaatttgcctattattttgctaatatcagaagcacaatgaacatttgaacatttcagttgagggaaaaacagtttcattagatatgcaagtaaaatcgaataaacaaccaaatcaaatctttcttcaatatcgcatatcagctttctttgtacttctattaaaaaaccataaaaattcgttatatctaatttcagttatgatttctcgaaatctcataaacatccaaatcatatgtctatcttcaatatcacaactcaacttgatgtatctggcctaataaacgagcttaatccattatatcttataacagtttcgattccatatcttcaactaatgcagattttgttccagaatattcttaaattctattcgattcttgaaacagaattatactattatgctaacctaaacagtttatgcttggaaactataaatacacacatcatttacaaccctgaacacatcagcctactccattttaatagcataaagttcactagcaagatctaaacaaaatgaatggggccatggctacaacttaccttgctgatgttaaacccttcaagactagctggcgtgtgcaagtgaaaatcctccacacctggaaacaatacacagcccagtcaggagaaacactcgaaatggtactagctgatcagagggtacgttcatgttatgcaatatgatcaaagtttttcttaatttcatatatatacttcttgatgataaactataatcttctgtgacagggatccaagatccatgcaagtgttaaaaagagtttggtgaatatgtatgaaaggcacattgcgcttgaccagtggagagttattgagaacttctctttgggtcaagtcaggggacatttccgggttactgatcatcagttcaagatgtcttttattagccatacatttgtctcaccatgtgtttctatttttgatgatccttacatggcattacccacatttcaatccataattgttggtgaactgaatccatgttatttcattggtaggtatttcattaatattatagtgtgctaaattaaaacttgaacactttatcgttaaatataagaccaattttcaacgtgcagatgttcttggtcaagttgtcaatgttgagaacattgacaacatgattgtcaacaacaaatcagcaaggaagctcgaatttgagctgaggaacgaaatgtgcgtaaatagaaagatttatttcattagtttaattgttacttctgtcagaatgatcgattgccatgtactttgtgggggaaatttgctaatcaagtaagccaggcatgtgagaattcaattggtgggattgttgtttgcctaattaggtttgccaaaatcagtacttttagaagtaactgataaaccattatcttacttatatttactaatgtttatgaagtacattgttttgcctttaccattatttacaaatacatttcatctgtaatagggcaaaaccagattacaaatgcttttgatgcttcagttgtcatcattaatccagagtatccagaggtggaagtctttaagaacacgtaataactaaccctttactatgtttttcacttataaaatgttattcacttataagtatacttatagtagagattctgagtctaatgctaattacagtttgccaaaagatggtcttgcactcacaattgctgagactaaaccaaagcttgaattgtctgtttgaagtgatgattacttcgaacactatcctaaaaaatcaatatcctgcttacttgatttcactgaggtataaagtttaatcattattgtattttggttcgttactctggaattaatatcctattagatgatttactaatactcttgcacctattcaagctcagaaatgcaagatcatgtgcaccatttttaaaatagatggtgacatgggttggttttatgttgggtgcaagaaatgtagcaagaaagttgagttgaaaaataacgacacctccatttctgttaagcctaaagaactcacattttggtgtcctaaatgcaaccttaacataacacaagtgtttccaaggttcgtgttctcattactatatatataatatattcctacactttatatatattgattagtaaaataaataagaaaatatttggttataggttcaagttgcatgttggagtcatggatcatacaggagatatcaaatgtattctgtttgatggagctgccaccgagatgattggtgatacaacatttgatctgcttgatggcgtgtatgatgatgatgtgagtaataacaattcagaataagattaacaaatcaaaattttatcattaagttcttatatcgtgtcatttataattcagttgcaggatcctgcaaaaccgcctccttttatcaaaaacttggttggaaaaacgtttcagctacttgtgtgtgtcgagaatgacaatttgtctggaagtaatgacacttacaggattggtaagatctggtcaggtgttgccaatgtgaagattgaggatcctaatgactcagaggggacaatcaatcctgatcatctcatctcaggcagtgaggttgaaatctatatcgattttgttttctactacacattataactatgaactgaaacttttaattattccaggcaatgtatctactcactaacagtagtgaaggtagtaaaatgtcagtttctggcatgactactccatcttccaagagaactgtggaagatacatctttggagagatgttctactaccaagaagacatgcttgaaaccaattaagttggagaaactcgatggcttgactgagattggaaaggaagaagacgagaaggaggttgggggaaagtgatgtaggaaaagacaattctgtgtccaatgaacaagattacactgcaccagattgttgcattcccaatagatcattggagtcagactaatgtcggagagaagatattcatgtttagtttttttcgatgtttttgttcttttgtattggtttaataatgtttacttagggtatatcagactaaatgatttacccttagtagtaggcaatctaggttcattttgtgtttctttctcgctatcatcaataagatcttctcttttaaaaatattatctattactttcatttttataatatatgctatatgaagaatcaactgaccttttaatttcatagactctgcccacctaatccatatcttattctgtagatattaacctacaaatgaaaaaaacgattatattgcatcagtaaaatctatatatatacaaaatagagttaatcagttttcatgattagtgaaaaacaattctttaaactaagtagtttagtacaacttaagttagtatatttgattaataaactatcccttcttcggagttcaatcaggtaaacaagcccactgttgattaatacacatttgtacatttcggtgggggaaaaaactgtttcattggataatcaatagaaatttgctgaacaaccaaatcaagtataacttcagtgaatcaattcagtttgctatgtacttcgtctaaaaaaacgatattattatacctaataccggttacgatttcttaaaatcttataaacaaccaaatcatatatttagattcaatatcataactcatcttaatgtacttggcctaataaacgaggtttctacattgggttagttacaattgatattttgtgagctatatttaagctagcaagttattatatcctaacaatatattctagccaacaactatatattctcaaaacattataaacgcgtcagccacagtcaagcaaatcttatgatcttttttctagattacggtgtcttcctaattcttacctgaatccttgaaagttaagaattcacaagcaatttataatatactacattcaattctttgtgattcttatttaaagagtttcgctagctttttcattattaacacaattccttttttgtatactgtaatgcaggatgaggaagataaaagatggtatgtcaaatgaggatccaaagaatgggtctaacaaacgttctatgcctgattttgataatgaaaattgcaatcctaaccagagtgtcaccagtattccaacccatgttccaaacaagcaaatttttggaagacttttcaatgatattacaaacataccttcatcatcaagtagtccgttccagattccttcttcccacaagtttcctgttagcagtacacaacaaaatatacatcatggtaatatatattgcagttcatttataagtactataatttgcagatgatatcttataatatgtttctcatatgatttcaatattatttagcagattcaagacagaaacaaaatataaatgacagatgctttgataacatatcgaaaacacttactccaatcaataagtcaactataaatgagaaagttttacctgcttcttcattcgtttctccaccaatctcaagatcatccaaaacttcgaatgcaagcaatcatgacaacattttggaatctgcactagacagcgagaactatgatcaatactattgttcatcagaaggttagtttcattcatatacaatatggctttttgaacagctacacgcattaagtaatcagacaatttattaatatgtgttgcagaagaacaagacgaacaaatatatgattgttcaagtgctgaagaggatactgatggacagtcagatgttgaaattgatgatacaaaagttttagaagaagtacagaaaaagctggactatctacatgctgtgaagaataacttccaaaaaatctttgctgatttatgctcattcaaaccaaaaactactcagaccaacccaaataagtcttaatcaaaagccactgaaaacaaaactggtattgacataaaaaaaacttgatggtcttcctgtgttcaatttcaagtatatatctatattttataaatactaactaaacgtttgatatatttttttagagtatattgaccacgacgacccaattcatgagtgtcaggtttgtaaagcttatatgtggtatgatgaacgtattaacaagcagtcaaaagtaaggacccctgttttttccttatgttgtggtcaggggcaagttaaaatttcattcatacgccaaactcctgaattattggttgcattgctaacaaacaatgatgagctaagcagacattttagagacaatgtcagagcttataacatgattttctccttcacttcactgggtgggaaagttgatagatgtgtcacaccaggacgtggtcctcaaatgtttcaaatccaaggagaaaattatcatttaatgggaagtttgaagcctccaaatggtaaaccccctaagtttcaacagctatatattgttgacacggaaaatgaggttgataataggcaaacagttatgaggtgagtttttctattattaaaacattttttgatatttttaatttattatgttgacaatgtaatgtataatctaataactttaactaaacatgcagcaaatccaaggaccctcacaaatataagaagaaacaaccactaagaaaagagctaatccagaagatcatccaaatgttgaatgaagtcaacccataagttgagaaatttcgaactgtcagagacagattcaacactaatccagatgatacatttcatatgaggattatcagtagtcgagagaaggatggcagaacttataacgtgcctacagcttcagaagtagctgcattgattctaggtgattttaatttgaaaatggatcatcatgacattgttttgcaagcaaaatctagtgaactacagaggataaaggaaatacttttatcctatcttgcattacagtaccctttactgtttccttatggcgaggatgggtacaagattggaattgagaaaggtcatgttaaagttggtaggactaagagtaagaagcctcgaaagcaaatcagtatgaggcagttctttgctttccgtattcaagaaagaaaaagtgagtcgcatactcttttaaattctagacggctctttcaacaatttatggtagacgcttataccatgattgagagtaacaggcttggttacataaagtgtaatcaggcaagtttgcgggtagaaaattacaacaacgtcaaaaaggtagcccaaggtgggaatgttgatatgaataaacaaggaagggaaatgtacttgccatcttcctttactggtggtcctagttacatgagacaaaactacttagatgaaatggctatatctaagcattttggatttcctgatctgttcatcactttcacatgtaatccaaagtgacctgagattcaaaggtatgttgatgcccgtaatttaaagtctgaagatcgtccagaagttatatgcagaattttcaagatgaaacttgattcattgatgacagatttgaccaaaagacacctgttgggaaagacttctacatgtaagttttattacaattaacttaatgtttagtttgattatttttcatatgtttaacttaacaatcagcttattcctgcagcaatgtataccatagaatttcagaaaagagggttgccacatgctcatattctactcttcatggatccgagttataaattccccactacagaagatattgataaaattatatcagctgaaatccctgacaaagaagaggaaccagaactatatcaaaatgtcaaggacatgatgattcatggaccatgtggtgctgtgcacctaaattctccgtgtatggttaatagaaaatgctctaaatactttccgaagccataccgtgaggcaactactattgataaagaagggtttccagtttacagaagaagaacatcatcaagatacattgagaagaacggatttaaatgtgataacagatatgttattccatacaacaagcaccttttgttacgctacagagcacacattaacgtggagtggtgtaaccagtcaggttccggaaggtatttgtttaaatatgttcacaaaggacctgacaaaataactgttgttgttgaaccacctcagcaagacagagtgggtaatgattcagtacatgttgaggatactataaaccaagaacagccaaaaaatgaagtccaagactatttcgattgcaggtaaattttgtaatactatatttagaatcgatgccactgtgttgtagaatcgatatagttgtttatctatcattatttcgatgcaaaaacactatatttagaatcgatgccactgtgtttttatgatgtagttgtttatctatcattatttataggtatgtctctgcatgtgaagctgcatggaggattcttggttatgatattcactttcgggctacaccagttgaaactatctttccatcttcctggggagcaacttatatattttaagggtgatgacgaagtagaaattattctgaatcgtgattcagcagagctttctatgttaatagcatggatgaatttgaacaaggtcagtggtattgctaggaaacttacatatgctgagattccaaacaaattcacttatgattcacaggacaagcagtttaatcttagacaaagagggttttcaatcggaagaataaactatgtgcctatgaaatacgaagaaggttattatctccgcgttttgttgaatgaacaaagaggaccaagaagttttgatgagatcaagacagttgggggagttgtttatggaagcttcaaagatgcgtgtggtgcattgagattgttagacgatgacaaagaatacatagaagatttaaaaagaacatgttattggcaaggtgtgagctctgttcgacaattggaacaaagatctagctcgtggcgatgtctcagtagtggcgctttggtcaacagactcgacatttaagacaccaacgaatagtatatgcttctcaagtgaggagctgatagacgaagatgaattatctagcaacaattgtcttgccaagctaggtatgttatcttgttaagtgtagcttagcaaataatatatgtgttcctacttaacactaacggaaaccaactgaaaaatggtcttctccgtcatataatcaggtcaagacgaggtggcacactactactcaaacccggatagaccactctgtatggcacctataaatactccaaggatgagtagagttaacaaccttgtaaggtaactcaagaacaaggtatggtgttggcaacctagattaaccgaaagatggcagatatctatttgaaagaaacaccagtaccaatagtgttgtatgacaaggacgccccaccatatttcgacgatccgggagaagaaggtaaaacatgttaggatctaattcaaagtttagaaactaaattttagtgtagcatgtgtttttctggtatacttatgaatatattattgttatgaatcttgtagctatcatgtagctactattctatttcgctagtaaaaggttaacatgtaacaaaaactttatctaacaaatagtacacctattgcagattacttgcagcgagccctgaaagatgccgactacgaaggagatgatctattcattggcagattgttaaaaaataaagaagattgtgcgactaaactgacaatccatgcaatacggagaaagtttcatttcatttacgccaaatcttacccaaacattctcctggccgtgtgcgtcagccatactttcccatggcgtgtttatgcaccaaaactggagaccagtgagcgttttgaggcaaaatgtgcaacccaacaacacacttgtagtgtagacgtcaagggagactttcacaagcaggcgtctatagctgtgattgtgaaattaaggagaacaaagtacttgggagttggtaggggccaaggccaaatgagttgaggaagataatccgtaatgaattcaacctaaatgtctcgtactggaaggcgtggagggctcgagaaatagctatggacaatgccatgggttctgctatgggaagctacactttgattcagccttatttcaaacttctgctagaaacaaactctaactcgctagtggcccttgatacagaaaagataacaatggtgtggagcggtttaggtacttgtttttcgccctagatgttgtagtcaaaggttatgcttaaatgaggaaggtgatattgattgatgggactcatctgagggggcgatacggcgggtgcttaattgctgcaagcgctcaggatgccaatttccaagttttccctattgcgtttggaatagtgaacagtgagaatgacgatgcttggacatggttcatggagaggctaacagacgctataccagatgatccaaatttggtctttgtttcagaaagacacttgtcaatatatgcaagcatacgcatggtaaattatcgacataaaagtaatgttatcttcataatttacaattatgaaaatgataacactagtatcttgctaatagttagattagttgatacatgattatctattattaataaaccctaacacatggtcatgcatctccaggtctatcacatgtcttcacacgccgcttgcgttgtccatcttaagagaaattttttcttaatattcaagtcagagggtttgagtttttggtagccagtgcggcctgggcttaccggctaaacgacttcaatcgcatatttgctgagattagagcaatgcacggcccgtgtgctgattaccttacatgcattgggttcaaacattggacgcgctcacattttgtggtagataggtacaacttcatgacgagcaacatagcggagtcgctaaacaatgtcttaacaatggcaagggattatccagtaatatcactactagagactcttcgaacaactcttattacatggttttctcttaggcgagaagctgcacagctcgaggggaatcattaacctccaaaggtgaatgagatggtcacagaaaattttgaaaaggggcaggttatgttgtacttaagattggtgatgtattttatgaagtgcgagacaaagaagattcggcatttacggtaaacctttgggagcgaacatgcacctgcagagaatttcagctccttacaattccatgttcccatgctatagaagccacgatcaaagaaaggatatgtgtagagacgatggttggcgtctaccacatagttccatatctgagattggcgtacaaaggtgttatcatgcctatcgccgacatggttacactggcaccttccccaaatgatgtcggaggtgggaaggttgcaccaccttaggtgcgtaggccacctggatggccacagaaaagaagacttttctcaaggggagagttcaaggtaatgttcgctataatgtttattagtaacgttatcgttaacggatattcgtcatgtaaagaattcgatctaacgaaattattattctttcagagagaacatctaccaaacgttgctgaagatgcagggcgatatggcataatagcgcaacatgtagaggacccatcgcggtaacatataagttagcaattaacaacttccttaacaagtaatattaatttacaaccaagtaaattgttgtagggtccttagctgggataaggagacattttccggcgagtgaagggacttttttggtaatggaaggtttgataggatggtgccaggaacgttagacctttggaatgtgtgaaaataatgaagaaggatgatcagaaaaaatttcaatgtatatacatacggactatgatcctacaaatataatattacaatcgggacgatccccatcaaacctccttgtatcaatgtggaaaagtatgttaaatcttttgttaaatgataacctatcttttagcatacattgacaatcgatgagctcagatccaccaaatcacaaaaggttatgagaaatttgaaatcatttgttgtgaatcagagttagcacctaatcattcgtgtatgttaatattatgttaaaggataacctctgcttagatcaaaacaacaaaagtcgaaaagtacaaaaacaacttcaaattacaaggtaacataattgagtgtgcggtaataaacatattatcaagtgtttttgttaaatgataacatatcttttagcgcacattgataattgattggctcagatccaccaatcacaaaacgttatgagaaatttgaaatcatatgttgtaaattagagttagcaccttattatttgtgtatgttattacttatgttaaaggataccatctggttagatcagaacaaaaaaagcacaaaaccacaaaaatcaatgtcaagttacaaggtaacataattgagtctgcggtgataaacatattatcaagtattttttattagatcaaacccaccaaaagcaccaagggttagagttatgagaaatttgaaagcgtacgttttagtttaatacatatgttaatggataacatctggtttagtatgtggatcaaaacattacgggtaaatttcagtaacgaagggtgtgttaataaaaatattagcaagtaccgtgatagatacatagataattgactagacctgaataaccaagcacaacgattatgttttgtgttagaatataatgcaaatgttacggtacaaaaaacccaatggttggatggaaaaacataacactgttgcattgtttgttatcaacaaacaaaacataaaaaaagaggtaacaacctagaagcttttccaatcacataggagtgtaagaaatgttggcattaactaaacgtctggttacatggtaacataatcaagtgcgcagtaatcagacaattataaagtgtatttttaggatctaccagagcacgaaagttatggagtaattgacaataaacctcgtatgattttgattgtagttagcaactaatacaattaactgactgtgctacacggtaacataatttgggtgatcacaatatggaattaataaaagtattacggcttgataaacataagcaaaataccatacacaaaataaagccggaaattcagttcaaacatatcaaaaggcgaaaggaagaaaaactgagtatgttagtcgatagttcgataataaataacttaggatacaaccctagacaatattatagtggagacgatttttttaacttcttgatccaaagtggcaacatccaaattcacgcattcttcaacctcaccggcagcatgagcatgtatgaggaaaacagagagaacacaaaatcaaagggagaggagacctgagggatgctatgcaggcgatcaagcgggaaagggtgtagtaagataggaccaactgacgagttagactgtttgaagaggtaagggagcatggcagccaacggctggagtttggcatataacgctgaatctcggcgaagctgaatgttggaatcgagaatagtgatcttatgcggcgtagtaaagtcctagaaaatattaaaaaagcaaattaacgaggttaaaaaaaagataataatttaaaacacgtggaaaaaattttgtttacctcatctgaatcctgatgagcgttatcaatcatcgatatttgaaaaagggaaataaacaggtgtaagaagatactaaactagagactattcagtggagagatgttgaatgtcagaattaaaattagcaaagaagaacaattattacatgttgagtaggtaagaaactagcttctccagaagcaaaatccacaacctattaaaatttttttaccaagatgcctaagtataatagcaggataataatccttttgcgtatgtaccgtcgttagtatctaataatgatttttactataaggttaaaatgaaaaaataaataaacaaccttcgaagggatttactggctcagggaagcattagatatagcgggttgagctggaacgatttgcataaaacaatagaaaatttatttgcggattcaacaaaattatagaatgcctctgaaggttaacaagaaagtttcctaacaagtgcaaccaaaaataataaactagtaacaaacctcctcgctgacacgtgtttggtgttgggaagaatatataggaaaatcgtcaccagcctgaaacgggacatttaaacctttagcagctacaaataaaattaccgataagaggcaaaaaaaaattaacctctgcgtgtaccgcaagtggaatgggtacaacgattggtggaacgacaacagagacagttgaactgggtttcaactgaatgacggggttcaatgaaacatggacttgaattccactaatctacaagcaaaaataaagattagaacattaactggcagatagattcacaagtgtgtttctcttaacaagataattaaacttctaacatacctcaacacgatctggtgcaacatcaaatccacgagtagtatcatgaattgttaaaccaccataaaccggtaactgagtgctgatttataaaaataaaaaaccgcggcaataagaaatttagtcaactaacttctgttatatcagacttcgacaggaggacggtggaggctctagggtagcgctgacctaattcaccactatgggagataagcacatataaattagtaagcacacatgtataagataagcagaaatgttattgacctaatttacaataaaaagaatagtaatttgttaccggataagtatgttatcaaagcaaaaaaaattttcgttccccgcagatcttatagaaaactacccgataatagtatgattaccaattaacaagcattgacaacaggacaactacaaaaccgtgttaactattttttcatcttcctttattatctaacatggttcccatgtcagatttgccctacaaccaagacaacatttggaaattagaagagatagaaccgaattggtgaaaagaagaaggttaaaatgcccggatatttggtttgttaacgtctaagtacgctaacaagtaacaacgtttagggatgagaatcatttaatttcatcaaaaaaaacttgtaagatttcactaatcttaactatctttataagtaatacaacaaacttaactatctttccaactggtcgtccgcgcctgtggtaatatcatctcccatctcaacgtcgccctacaatgccaacgtgaataagttagaatattattaggtacaaaacaatttaacacagtatcgttagtatccgctaacgatataacctggtcgttcgtctgtggttgtatcatttctcatccccacgtcgccttgcgcaaaggcgtgattaagaaagaaaaaaaaattcttcaacgaattaacccgatatcattagtatccgctaacctgaaattccttctcattattaaaatttgttcccccgcaagactggccgtccggtacatccaccgagttgtagaaagaaacaacgtcgtctacagcagatatagcttggtctccgtgaaaagacggaagggtaaaatcagtctgcataggtacgggttgactcgacggtggattgaggttaacattcgcatcagcaattttgtttttggactccggagaggaactggattggcattttcatcagcatcggcggcttccttgttagcttgaggaccatgttccccaaaagcagcacctttgagattaccagaatcaacaatcaaattttccggaaaccaatgaatcaccctttgataatcctcttggcttgtgcctttagtttgtcatcaatcatgcaggacaaagcagcgagatctacaccaccagacccttcaccttcctcttcaatgggactttgatgctttctcctcagactagtagctgatctagcattgaatggtgttttcctgccacgaaccaccttggttttgccacctttttttttttttagacgcaaccacaatcttagatgggatacacccgccacaaaacatttcattcgaacttgccttcctcagccatcttcacaatgttctcaaccttaacatcatcttcgtcgtcagaccatgttaaatcttctttgggattcaaccgagaatcggggaatataattggatcaacatgatactgcaagtaatagttaccatataaaatatgttaatgaaatcgttatcatgataaatagttacatcatatttaaaaatattatcggataactctagtggcaactttaattacgataataaagctattaaaaactataactcaaatgctatggtggtaaccaaaatgttatcgacttattgtgaaaaaacattacctcgcatttggcatccacatctttagcattgccaagcttgagggcaacgccctgacaagaacctacttcaacggcggcctcttcatctgagtctgacccagcaaactcatctatttgagggctttcctatatggcgggggatgcttccaagacaacgagttgcaaagcgtatagaagaccttgaactgccacacacgtagtggagagctgttcaacttccctctcgttaatgaaaatcatcatcatctcgaaagagagacgagcccaagggtatgacagaaaccccttaagatcctcagccatttttgcttgatctttcattattttcgggtaatgagaggtgggtaacaagaaaccatcaaccagagccaaacaagcatatcacaaccttatatcccgatccgttaccaccctttttagcattgtaataaccctctcaacagtaacatcttcttcaaggccaaacaaagaactgtagtaaaggatctgctctccacccgtccctctcttcttctttttaagactttcggatttgccacacggaagcccggtaactatcttaaactcctttaacgaaaactggacaggagtacctgatataggtcaaattaatcctaagaccactctctcaaataaagaggtcatttgcagcacttagggatcgaattcacaaagctctcggatcacgcaatagactaaggttttgaattaagctaagtaaaacagttatgaaaataaagagaaacaaaaagtaagcaatagcaatcgattggatggttgtgaaacaagataataaaaacgtcaggcttggggtattctcaagaaacagatgatagtagatctagaaatagctaggttgttatcgcaccgttctcgaactcaaactatgattttagagtaaccggtgggcgtgccatgaaactccctatgcctatagctaagaataaccggagaagccaagagatctttaacataaacatgcattattatcaagtttgattagttcacctagtatctaaaccagagcccttctatgagcctacatgttctttcttagatgcctaaggctcatctatgatggatcaaatagcaagtacatatggtgggcatattaaccctttcgcctagcggttcttctccaaaagcaatcaatcggtccggtaaatcaacctcccccatctacggaaaaaaaaaattgggttaacatgatcggcaatggcaatagaaaccctaagataatgagaattgaactctaatccataccatataaagtgaaatccacaggttgtgagttaaatctgaagaagaaatataagatcaccgactccaaatgggactgtgactaggagattggactgtaaaagtttgtgcactggtaaacggttttctcttcaagtttttctagggttatggtgtctcaatgagcgaagatgagaacagataaatatagaggacatggagacgcgactcttcaatattttctaacaaagttctatttagttctttattaattggatcacgcttctccaaatcaaatctctgaaaagattatgttgtcgtttgacacaatactaggctagcggtaatgaaaattttgaaatgagttatagaggtacaattgtatttgtatgatgaacagagtattgggaacagttgaaaatcgagtgacttaattttacagtcttttgagtagagataatgataatacccttctctttattactctcttgtttgaactttaatattatttttttgaatttcttaagcttacaaattgtgagaatatgtttttaggttttgtaatggataagtcatggatagacaaaccaagtttatctcaagaatacaatattagaagtgataaatttcttggattcatataaatcaaatgcagaaatgatgaagtgtccatgtattcgttaaatgtaacaaaaatgaagtcaagaaaagatattgaatgtgacttgatgtgcattggctttttaagctcttatacaacttgggtattacatggagaggatatatgtgtcacagggaatgcaagagtaccttctgatattgatcgagctgatttagattcaactttgaatctcttggatgatcttttcaccgatattaattcgaatttgtctggtgaacacgtacctggatcgtgtgatcaacctgtggacactgatataccatcaacttcaagtggaaattgtggaaaaggagaaggttttgatgatttgtttgctgaatttatccaaaagctatatatgggaagtaataagttcacgaagttgtctttcatattgaagttgtaccatatcaaatgtttgtgtggaattagtgacaaggagatatctatgatgcttgatttgctgaaagatgcatttacacatgccaaattaccagcttcatttaatgacatgaaaaggttattcgaaaacaaggaacgacttatgaatcaattaacgcatgtccaaatgattgcatgttatattgggatgcaaatttaaaaagggagattcgcaaagtttgtaaaccctcttgttggaaagataacatttcttcgcagagtatggtttttggatcagagaataagaaaaataaagttcctacaaagattttgcgttattttcctctaaagccacgactgcaatgtttattcatgtcatcgaaagcagctacccacatgagatggcatacaactgctaatataatgatagtaaacttcgacatccaagagatggagagacttggaagacatttgattaaaaatttaccaaattcgcagctgatccaagaaatgtcagacttggtttagcaaatgatggtttctacccatttggtactatgagtagtagtatagcatctggccagtgatactagttccttataactttccaccgtggatgtaacgcccctgaattgctctatggtcggacaaaccaagggcaagccaaaaacgctacgttgatagctcatatagacgagttaacttaggttccaaacgcatttagacccttatccgaatcatccatatgaagaatccctcaaattgcaagttgagggttttcaacccttgccatgatcgcaagttgtgttagtctggacaagactaatatcgaatgaaacacactctttatacgaaaataatattttataacatataagttctcgtacaacaagtatccaaacgttttaacaatgggcccttgagcatacacgctcaaatccaacaagaatcgaaatcactaagttttgcaaaaccaataactctatatttacattcctatgtcctgagcatctctctaatggctcccactaaggttttctgcagaataaaatggagtcataactaatctaacattacttagtgagctcgtaattccctgtaacagatattagttcttcatcccataattctaacacgaaacacgcatcagagaatagcaacgaaaggtagcttgccgaagcaattacaaaaacatgcacatgcaattttgactccatatttaaataagttttatagggcctgatatgctgccttcactcacccacaccacacattcacccacaccacacattcacccacaccatacacactcttgtgaactcccaagttacaactacaaagacatgtaaccagagcatcagtaccaaacgctacaccgtcgtgtagactgcatcagctagggtagctaacccaatctctccgagcccttcgcactacgtgtagatcgagttaccaaagttaaacaatactccacgatagcacggtgatgcagcgcattaactcttatcaaacacacttgagctttacgtgtttgatattgatctatctttcttaatttgtttgcgctttttacttgggctttgttcctatttcttatttacttttcgttctttgacggtgttgctttctagggttttaagtcttatttaaggttaattctatggatgtttaaacgcagcttttggtttatgaataaaacagagaagttgttctcttctaaagtctttgaattctctcttcttttgatccattgatacgaaagaacaagaaattttagctacgaatctgctctttagaatccattgatatctaaagtccttttcatatttgttccctgcattagtaggtatcaaagacaaaacgatcctaatcatgccacctaagaagagtcttcaagcaacattcgaagagcagaccttggcgttcagagagatgatgacagagtttcagcaaagccttggtgatacgatttgaaccaccatggaagcggcggtgagaactcttgctcaagctcacgacaaccgtgttcttgcaacaacaaaagacaacttttcaaaagacgttgatgatgaggatgatgacgttgaagataactcgtttgcaagggatcatgttcgacaccaacgtgatgtcacgtaacttactacacgaaacataagaacaattggtttctagatttatcggtggtttgcgtctacaattacagaattcatttctccaagtaaaccccatttcggtatctgaagctcaccagcaagctctcttaatcaaaaaacaagccgttaacgcttcttcttcatggaattcttcaacaacaggtcaatgtggaggttcttttattgatttgggaaacaataagcaaacaaaggttactcttcaccaacctatcccgccacgagcaattgacgcaggcgaaggtacaattgcccatcgtagtaaccgtcttgctaaatgttttggatgtggagaaaaagggcatagaaaatctaattgtcctcatcaagggagatgagggctcttcatcagagatgacccgatatacgatgaggctgtagaggatgaggaaaaggatatgcaggttgattacacgtagaagcttcttgatgcccaatagtctcgaagagccttggctgcgtacggacattctttgctcgacttgcacaatacgtggaaaagtttttcgcctcgttatcgattttggtagttgtaccaatgccatttcagaagagactgtttataaattcgccttgtctattgaaccgcatccagttccatatcgcttggcgtggttacaatcgaaaacagataagcgtatttctaagtgatgccgtgtattgttttcatagggagaaaattacaaggatatactttggtgtgatgtcattcccatggatgcgtgtcatctttttgggtagtccatggcaatatgatagacgcagaatgcatgatggctttgtcaacacttacagcttcacatttgaagaaaaacgcatcccattattgcctttccaagagacttcaaacaagagtttctgtgaaaaagttgcggaccaggctaccaaaaaggtcggggaacacaaacctcctaagtattgtactcgatcacaatttttggctgctactcaagagacggatacgatgtcggctccgccgacgaccatggatatgtcatcttcttcaaatgcagctttagcttttcctaactctctccacgatgttgctggtttgtttcatgaggagattcctttagtggttcaggatgacaatgctaattcgaggtcaaattttttctcacccaagagacctgatgtagcgcatcttctcttatcaaacacacttgagctttacgtgtttgatattggtctatctttcttatttttgtttgggctttttacttgggctttggtgttatttcttatttacttttcgttctttgacggtgttgctttctagggttttaagtcttatttaaggttacttctatggatttgtaaatgcagcttttggtttatgaataaaacatagaagttcttctcttctaaagtctttgaattctatgttcttttgaaccattgatacaaaagaacaagaaatcttagctatgaatctgctctttagaatccattgatatttaaagttcttttcatatttgatcctgtattacacgacctacaatgaaggacagctatatcactgtcttgatacgcttatggttaactctgactccaaacacgagcaccatgtatcaagacccaatacttcaagatattatgagacatatggttaattaaacacatagaatcatcaatatccttacctaaacaacctctcatatataagcctttacatataagaatctaaatgataacttatacggcttaatactaccattcacaccatcaattaatattcaatactcattaaattcacgaaatcaatcaatgaatgtaagactatgtaatcaaaccatatctagaactcaccctaaacgcacacaaccaagcaagcaatcaatcacccacataaatacctgttaagtcaggatattgggctgcgagagatctgtctcgtcctacttgtggccccccttttcagggaccaggtgtttcggcacttcaggcacaagtatggaagcttaaaactacgcggaagcttatgcatttcgcgtggcaatgtatctctggttgtctagctacctgtcaaagacttacatatcgtcatatgggtacggataaaggatgccctcgttgcggagaaacagaagaaacaatcaatcatcttctatttcattgtccaccgtcgagacaagcattatcgcctattcctacctcagggaatattttccctagaaattccctcttctataattttgtctttctcttttggcgtgggcgagaatttgaaatcggagaggaggtattgaaactctttccatggatactttggtatatctggaaaagtagaaaccgttttgtttttgagaacttcagggaacctcccccccccccccgaaactttggcgttggcacttaaagaggcagcggtgtggaaacatgcaactctaaaagaagatgcacacatctgcctaattttttttctaagctctcagagcccgcttacccgtctctctgaaagtcaacttgatgcttcatggcatgccgatgactctcttagcgggcatggatgggtccttgttcgacaagactcaatcctccatcttgggctcaagagtgctcgtcgaagcttatcaccgctccatgcaaaatttgactccttgttatgggcaatggaatgcatgatctccattggcgatacttctagtacttttgcttcagattgctcagacctgatttctatcctaaacaaccaagacgattggccgacattcgtagcggaattggcttcttaccgatctttagtttgttttttcccttctttcaatattagatttcttcctcgtagttctaatactcgagcagatagtttagctaaaaaagcttggccttgaaacagtcttttctcccatgtaagcacatcggttcctgaatggctctctctagcggagagtctcttcccgataacttaatataaatggtgtttgtggaaaaataaaaaaacacccaaacctatcatctgccatatcacacgcttcaagactcacagagattcggctaaaggtttaaggttagcaacgatctcaacatcttatgacttcctaactatgatcccaactcaacttcccttggctcatctcaacttcattcatcttgatttaacgactcttcattataataatagccttcaatcttgacggttaactcaaaatcaacccttataaatagtttctagacgaaaactaaatcatgggaatgattcaaagaaaacagactatcagatttctcgatcatttcttgattatgcttgacgttcctcaatcagaattcttggatattgctcacgatcacaacaattcctccgtagcagcctttcagtgttttccctctcttccttttaaatgacacgggattaatcgagtgtttataggcatatttaccttgcgctccaaggtattagatattggcgagtgttgacacctcacgggacaactgtcaagcatggcgaacggtggcgacacatttctccgacgactttggctcaaagcaacaagaaatttggctccaactctctaaactttggctccaagtttctcagtcaacgacttggtcaagggtcgatgtttggtcaatggttgatcaaaggttgcggcttgtataatgtggtatggtcgttgtcgctcggattggtaatactttaatcatcgttcgcctgaatcactattatctcaccaaaccattgttcttttcaaaattctcccgatccaaactaattttgactcgtccaacttacttattatctatccttaatggtttttagattctttttaagttcatcttggtctcctcttgatcatcccttgtacggccatttacccttaagcaagggtcactacagtggatgtcaatgaatcacacatcaatgatcctccatatggttatctcctggaaacacattcatggtaatgatatcgatgtatatatgcagccactaatcaaagacttgaagcagttatgtgattatggaattaaaacgctagatgcttccacaaagcaaacatttaacatgcgagtagctatcatgtggataatgtttacgacatgaaaaaactgtttaattggttatcgacgttttcttcctcgggatcatagctttcgtcaaaacatggtacatttcgacggaaaagtagaaacaagatctccgccagtaacattgacaggttctactattattcatcaactagaacaagttaatgttactcttggtaagaaaaatggtttagttggagttgggaaaaaaaagaaagcaacgtgatgcaggaagatgtggtacttattagtggaagaaaaaaagtattctctaaagttgtctttttgagtattctttcgtgagctaggtatacgttctgacttgtggcctgatgataatgagaaatatcaagcaacatatttttctttgaacaatcaagcgaaagacacttttttaagtgtcttccagaatgttaaactccggatgattatgcttctaatttatcaagttgtgttgatgtcaatggtcgaaagctatcatgcttaaaaagccacgattttcatgtaataatgagaaatctattttcacttgcgatttgaaatctgttaccaacaaacatgacatcaacaattgttgagctttgtcgtttttgagagatatatctgcaaaggtgcttgataccgatgagatagataaattacaatacattattttagtaactttatgtcgtatggaggtttttttcctcaatcatttttcacggtgatggtgcatttagtagtacatctcaccgaagaggcaaaatacggtggaccgttccattttgttggatgtatccgaccgagaggtgaggttttcccattttatgtttatatatatatatatacgaaactgaaacttactagattcaattatatacacatgatgttaggacacttcaaatgatatgttcgaaattgcgctaagcctgaaggttctatatgtgagcaatatttagctgatgagtgtgtaacattttgctcaatgtatctcgatgatatagagacacgatttactcggattggccgggttgatgatcgacctctagctgagactagcataaacccaaattcagaacttttacttttatttccaaaccttggaatagttgttggagcgggtaaagtttatactcttaatcatgtagagcggcaacaagcacatcgacatgtattggtcaactgccaactactagatcacctacgggagtaagttctcttattcaagaacaactaattttatttatgttttattgaaattcactaatgtagacgttatggttattgtatgtttaggaaatataaaaccgagttgttgaataaacaatctcatcaaagcaggaggaatcgtgttatcgatattgacagagaaatgcatcttagttttgcaaaatgaatcaagtagaaagtaaagacaaaatgagttagatgagctaactgatgatatgatgcttagctctgggtccatctgaaaatgttttaaagtataaagcttatgatgtcaatgttttcaaattccggacaacaaaaagagaatcaaacctgaaaacacaaaatagtggtgtttttgtggctactgagactacgagctatgctagttctcgtgatcctaacccaagaaagggaactgtagcttactatcggaatctgatcaaagttatagagttaaactaccatgaagttttcaaagttgtaatattcaagtgtaagtgggcgggcactcttacagtaaaaggatataaaatagatgcatattgtaacaccctatcccgctattaaaatataaacaaaataggagcatcacgatagacgcccgcagtcggccaacccaggttttcgaaacaaattcgtttgcccgagtcgtcaaaccgtaagtgtccagcctctcgaacatggcctaaggcttttcaacccgtattgcacacgagtgttgtgtaagtcagaaaagactaatatcagtcggtctaccatataaattttagaaatttgagtctttatacatatataccaaatcgcatatagttttcgcatcctctttgaaaaccatacatcatatgcttagtaagaattttacaaaaagctgtaaaacctacatcggttcgtcctaagtctcttgcgccctctacaaggctggtcaactaaggtttcctgcaaaataagtagcgtcataagtaatctagcattacttagtgaaccccgaatctagatagagttaacctaatacccttacccctaagcagaaatcaacacacaataatactacgagctaacaaaaataagtacgagttatacaagcaacgcacaatcaaagatgacacccaacacacaatgcaagcaaaatgtaatgcacaatgtataatgcatgcagactcaaattcctaatatgcagcggacaattaatgcaagcatgcttccgataacctaggtaaggccttctacgaatacatgctatcccgaggcaatggcctacacactcatagacacagagtctaaagaagatcgtcattccttatactacatcgtcatttagcgcctggtctgtagcgaaccagccccgagcattcgtatgtcataacggaacgaagttacacgcgacgcacagcctatgggtggaataacaagatccggctaatgctagttgactaactaacatgacaacagactcacatactatcatgcattccatcctatatgaaaaactttactaatcaaacaactaatcgtacttaattactactaatccttgtttagctcaccctaatcatgcttaggaaatactaatcctaattagccattactaatcataattaacaattaataaacctaattaactatcttaatcaaggattaagcaaataattaagataagtaattaaaattaacctcctaagctgaattaaggaaataagtgaattaaatatcctattcacgtgctacttatcgtgacttgagactcacttggattttccgagcggtttaggcttccgaaggtttctcagcgaactgggattttctaactattttagatctaggaacaaatgggcggaggagggagtatttataaggtcctaaagtcggctattatgtcggccatggaagcacgaggtgaccttggacgaatcaaattgcggcagattttgtcccacaggcgcttcaggacactaatcggcctctgattggttctttcgagtttttcggataatcatcattcaaaagtggataagctcgaccctaaatggataaggattatcggaatgtagataagcatcggacctaacggataagcttgagccactattcaatcatggccgtccattctctcatttcggcgaaacctactatttatcaccggtccgcaagaacattgagacgacattctccgtcaccaatatctcaagagggtccgtgaaacaattcaaggcttgcttaggactataatacgttccatgccagaattgaccgagcatgccagctatcgtcactcatccgcattgtccaatcaatcattttgaccatacacgacccactctcatattggactacccgagatcgatttccctcgaccctctaagtttttcccgaccctttaaggtttcctaaaccaaaacaaaggttccttaagctacactagttcttggggtttaccgatagtcgcatcgtagctaagcttggcccgtcagatggagattcattcttttacccatgtacttgatcctattcaatgctccttacccatgacttaccacactaattggcccgactgatcttgccttcccttggcttgatctcgcattttactcgacagaatgcacgttcgaccgtccgggtcatagttaaggtccgaggcattatacatatggtcatcatatggttaatttttacacactggagataacaaagaggatgaaccatatatattggagtctcaagcaagaatggtatattatgtacaagatccttcttagagtgattggaagattgcagttcatatatattccgcatagagacatgtatgacatgggagatatagaacaaccgaatgatgaatttggccctcacaactccactaatgcttcctaagaaaatatttataatgtcggcatatgtggctgctagtaattgtttctccataatcataatatttgtgggatctttaatcaaatgtcatacaaattaggtgtatttaccggaatcttgtagaacatttttttattactatcatatttcggacctatttggtatacccatcgtgaacctactaaacgttacagaaaaaatataattacaaggaatgccattgtcacgtcagcaaacccgcgtcgccacgtcagaaataattgacgtgtattaatgaactcgactgttaggagatacagcggcagttacagctgagtttagggtatgttgcgtttgactaaagacaaaatggctgagttatgacaaaacgacgaaattatgagtataatttagcctatagttatggctgatttataaaatatgtctaagttatgagataatccagcctacgttacggctgagttaataaaatttgtctgagttatgagaatttcaagcataacccacacaacgttatggctgagttatgagaaaacggctaagttatttcctcgacacggctaatttatcatttttcggctggctgagttatcaaagatgccttagttatgggatgtcgttatggctgagttattttcgagtgtcataaatcagccgtagagagctggattagcggataacttggccttgttaagcctgacttattagcaaaagattaattactataatatcatgcaattacaaccgaattattaaacgatacggctgagttaaagattttcggttgagttacgacattagaaggctgaattaacttggcatttttttgtttttaattactgtaatagtattcatcttgcgactgacttatagctttgcttgatagctgattgatttaggcaaatttacatgttcgtttggtggcttacttgccacttcatcaattaaaaaatgacgtctgatgcaacattccatgtcatcatcatcaacggaaatacaaaacatccctagttttttcaacttctctcttcttctttgtgttgtttttcacccgagttgtctttaacctgtgtctttcacatcaccagaacttttaattcgtcatcgtcttcctcatttttcttcattttctttaatccttctctcgatatgcttgcctccgattgttgtaaaccagcaagaaaggcccaagaaaattaggattacattatctttggaagtcggcattggaaataaacgccttagaaagcaacatgcatgttctctatctaaacaagttgggtataatgctaaaacttgtcggacatagtattgtttgcaagaattttctttctcttctttatttattagcagtaatatgtagttcgtgacaaatcacctatcattatagactctaagaaccataacacattataactcattgagttttaacctttcgtgacaaatcagccatacgcattataactcaactgtaacatgtaaggttcggtaaatttacatgtcacggctgagttatatgtttcagtaaagatgaaaggttgtgtaaattatatgttacagctgatttataatgcttcagagaagacgaaaggttcggtaaatttacatgtcacagttgagttatatgtttcaggaaagatgaaaggttgtgtaaattatatgttacagctgagttataatgcttcagggaagacgaaaggtttggtaaattaacatgttacgattgagttatatgcttcatgaaagaagaagggtttgtaaattatatgttacgacttagttttaatgctttggagaagacgaaaggttcggtaaatttacatgtcacagctgagttatatgcttcaggaaagacgaaaggtttggtaaatttacatgtcacggttgagttatatgcttcaaagaagacaaaaggtttggtaattacatgtcacggctgagttatatgctttagagaagacgaaatgttttgtaaattatatgttacgactgatttgtcacgatttacatattacgactgagttacatcacattacagctgagttataatacatatcggaaaataatatttttgggaagaaaatataaaatttattggtcaaataacaacaatcaaattaaaaacttaagaatatatttaagggagacatatgaggaagactaaactgtatgaattaaaacatagatagaagtagaagagtcactagtcaacaaaactgtatgaatcaaaacatcgatagatgtagaaatgtctccaaatagatcgattgagaggaagactaaaagagaatcatgtaaatccaaagaaaaagagtagctattactgctttcaactcaaacctgtaacaaatcatgtagaattccatagacctctttgatttggatttttatttttgatgtttttcgtgaacgaggttgcgtgtagatctgacgaagcttttgatttgggaccctatagcaagcgttgtggctctgaggtctaggaagatccagcccaatcatataatttgaagacctatgtccatgttgtacccaagttgcaattattagatctaaaagcttttcttggattttgagacaaaaaaaaagaggagggaaataaaatgattttgaggagtgtgagattggtgacgtgagttaatgacatggacagtcaaatttttatttattattttttattaaaaataaaataatcaagagtgttaattgtaattacacaaatactcaaaatatatgagtaatttttaaaacatgtataatatcactacaagaaaacagacaaacaacgactacagaaagcaacaacagatgtagtcgtcgtttttggcgactacgtcacgacagttttacgacacatatacgacaacctgaacattagtagtcaaatagtcgttattttacgactaaatatgttagtcggcaaatactcgtatagtaacgactatttaacgattatattattgaagggagacgtttgtcgttacatagtcgcaaatggacgactacaatttccgactgcgacagttagtcgccaaatcggcgactaaaatacgacacatttctgtaatcgtaaaatagtcgcaactgagtcgcagagtagtcgcattaagttgttggaaaacgttttccgcattgccaagtaggtacacctaatttgtttgttgtagtcgtaaattagtcataaaaattcgtctatataatcaaaattcacgacaatcttctttcaccaacaaatcaaaacaacaatcaaaaggaaaaaaaaacggaaaaaatagaaatttagtttattctataatggcgggaaactacaattattgcggtagtggcggtttctatcgagattggatgtacaagagattcgatgaagtgacggggaatttgtcagccgaatacgtcgcaggagttgaggaattcatgacattcgctaatagtcagcctatagtacagagttgtcgaggtaaatttcattgtccttgtagtgtatgcaagaatgaaaaacacatcatctcgggtagaagagttagtagtcatttgtttagtcaaggatttatgcctgattattatgtttggtataagcatggagaagaattgaatatggatatcggaactagttacacggataggacgtattttagtgagaatcatgaagaagtgggtaatgttgtagaagatccatatgtggatatggtgaacgatgcatttaattttaacgtggggtatgatgataacgtgggtcatgatgataactatcatcatgatggtagttatcagaatgtgcaagagccggtccgtaaccattcaaataagttctacgacttgttagaaggtgcaaataatccattgtacaatggttgtcgtgaagggcagtcgcagttatcattagcatctcgactcatgcacaacaaagcggagtataatatgagtgaaaagttggtggactccgtttgcgaaatgtttacagattttttaccagaagaaaaccaggctaccacttcacattaccagaccgagaagttgatgcgcaatttaggacttcaatatcatacgattgatgtttgcaaaaacaattgtatgttattttagaaagaagacgaaaaagaagatcaatgtcgattttgtggcgcacaaagatggaagcctaaggacgaccgtcgaagaaccaaagtaccatatagtcgtatgtggtatctacctattgcagatcggttgaagagaatgtatcagagccataagacagttgcggctatgcgatggcatgctgagcaccaatcaaaggagggagaaatgaatcatccttcagatgcggcagagtggagatatttccaagagttacatccccggtttgctgaagaaccccgtaacgtttatctcgggttgtgtactgatgggttcaatgcatttggcatgtctcgtaatcattcgttgtggcctgtgatcctaactccatataatttaccccctggtatgtgcatgaatacagagtacttatttcttaccattctgaattctggaccaaatcatcctcgagctagtcttgatgtcttcctccaacctcttattgaggagctaaaagagttgtggtgtactggagtcgatgcgtacgatgtttcattgagtcaaaattttaatctaaaagcagtaccactctggacgattagcgactttccggcgtatagcatgttatcaggatggactactcatggtaaattgtcttgtccagtttgcatggaaagtacaaagtctttttatctacccaatggacggaagacatgttggtttgattatcaccgtagatttcttcctcatggtcatccatctcgtaggaacaaaaaagactttctcaaaggaagagacgcttctagcgagtatccacccgaatctttgacaggggagcaagtttattacgagcggttggctagtgtaaattcacccaaaacgaaggatgttggtgggaacggtcatgaaaagaagatgcgaggctatgggaaggaacataattggcacaaagaaagcatattgtgggagttgtcttactggaaggacctcaatcttcgacataatattgatgttatgcatacagagaagaattttcttgacaacatcatgaacactctcttgggtgttaagggtaaatcaaaagacaatatcatgtcaagattggatattgagaaatattgttctcggtcaggcttacatattgatagtacgggtaaagctccttttccagcgtatacattgacagaagaagccaaacagagtttatttcaatgtgtgaaacatgatgttagatttcctgatggttattcttcagatttggctagttgtgtagatttggagaatggtaagttttcaggcatgaagagtcatgattgtcatgtttttatggagcgactacttccatttatctttgccgaacttcttgaccggaatgtccaccttgcattatcaggtacaatactaactattttttaagcagaaatttttttatctaattatttaacttgcacatatattttaggaattagagcatttttccgcgacctatgttcgagaactttacagacaagtcgcattcaaattctcaaacagaacatagttttaatcatctgtaacttggaaaagatctttccaccatcatttttcgatgttatggaacatttacctatccatctcccatacgaagctgaattgggtggccctgtccaatataggtggatgtatccatttgagaggtttttcaaaaagttgaaaggaaaagcaaagaacaaaagatatgctgcaggctcaattgttgagtcatatatcaatgacgagattgcttatttttcagagcactactttgtcgatcatatacaaacaaaatcaaggtaaatacctttatttatttaacaatttgctatactacttcgatcttaattcaattatatgtggcaggttaacaagattcgatgaaggtgaagttcatgtatatcatgtccctggagtacctaacatatttatgcaggtcggccgtccaagtggtgctgcatgtagaacagctttcagagaaagattaccaaaatgcacatgcatatgttttaagaaattgtgactattttaaaccatttgagaggtatttttaatcactttgatttattcatagctaagatcactttgatttatttgtcttcgtttattgagacagtatgttcgaggattatctttctgcgaaatatccatccttggccgaaaaagaactctacgtcagaagagctgaagaatatcatctatgggttaaagaatatgtaagtctacattaattttggttcatgcatataactatttgtctgttttcttgtagctagtgatttaatttaagatcatattgatattgtttatctatattatgtaggtaacatattggaacactaattctccatttcctacttgggttcaagagattgtgcaaggacctttgaacaaggttaaaacttggccaatgtatttcacaagaggatatttatttcatacgcaaacccacggcgctggacgaaagacatgtaactatggggtatgtgttaaaggtgaaaattacgctgattcatctgatgaagcagatttctacggtaccttaactgatgtcatagaacttgagtatgagggcatcgtcaatttgaggatcacactttttaagtgtaagtggtatgacccaaagctcgggagaggaactcgccgaaaccatggtggcgttgtagatgttctacctacgaggaaatacaataaatacgagccatttattcttggtacgtaattaagtatacttgaaatttctaattcattaataaataatgttgcatatgattttgttgatatatgtataacatgtttgaacagcatctcaagcagatcaagtttgttatattccatatccatatacaaagaaaccaaagaacatttggctcagtgttttaaaggtcaatccaaggggaaacatttctggacaatatgaaaatactgatccgagactgttgcaaaccgaggatgatgaagctgttttgcagactacaattgaagatcttgtaatagactatccggtagcaggcgtaaccccaatcatcctcgattacgatattggagatgctgaaccagaagatgaattccgatataatttatcgtccttggatgaagatgaaatagaagacgaagatgaataataattgtgtgaaatatatgtataattatttgaataagtatttgaataaattttgtaatatacgatgtatttgaataagtatttgaataagtatttgaataattattaaaaaattattaaataattttaaaaggtataaggtgacgaagttacgactattatgcgactaccatgtaagatgttgggcttcgaataacaaagcccaaacccaactcaggtggtgacaaatatacgactatacagcgactatcttgtaagctgttgggcttcgaaataacaaagcccaaacccaacttaagtggtgacaaatatacgactatacagcgacacttgtatatgttgttgggcttcaaaattactaagcccataacacttgtgacgattcggcgactatggggcgactacggtgtaagttattgggcttttaatcgtcgaggcccaaacccaattgatttagtgacaaatgagcgacaaatatacgactactccagtgttgaaaaccctaattcgattcatttccccttcgatccaaacacttagccaaaaattattcttcttcttcgaacttcttcttcttcctcgatcttcttcgatcttcttcttcttcttcttctttttaaccctaaatcgattctcttcttcttcttcatcttcttcttcttcttcttcttcttaaccctaaatcgattctcttcttcttcttcttcttcttcttcttcttcttaaccctaaatcgatccgtctttcaccaacaaaccctaatacatctcgattcatctcgattctctcatcttcgattctctcttcttcgccaaactctcccttgcctcttcgatccatctcgattctctcatctccaagaggatgcctaacgccggtcgtggaggatctcgaaagaggaagaccacaccaaacgtgactcaaagagccggaggttcaacgcctgctggaagaccctcttcgctaccgcagcagtacgatttcaccccggcggcggcggcggttcaagtttctgcatcgattccgcctcaaggagtcggcgccggcgcctcatcctctgcccccactaccgtaactacccaccaccgcagcaacactccaccaatcaaccacagtgtatagatccgttgccaccacaagagactgctcagcaagaccctcctctttcgccggatccagaaactgcatctcacagtcatccctcatcgcaaggcaacaacttccaagagggcattcttgcagtgttgccggagctccaagaagactttgtggttgctctgaatgacattctctctgtgcctggcagagaagcgtggtgttgtgtgttgtctcccattccccggccaaaaaccgaatggtaagttcactttaaattccctgttttcttgttctgcatgctctgttgtgaatcaaaccgaaaatgtgaaccttgttggctgttgtgttgtgaaacattgttggctcttgtgttgctagtgttttcgggttaggcatttagtcaagtttagttctagactcattagtttatgtaataatgcctgttttattgttgtttgatgctctgttgtgaatcggtcaaacatagttgagtgttgtgttgtgattacattagttcttggtcattagtttagttcagttctaaactcgtgttatgttgttctatattacacaaatgatgatgctttgattgtgaatgatgctttattgttgagacagtactattgtggaacatagtttatagtcgtgtgtgacttgtatttcttttgggaacataactttgttcacttttgtaacatgtttacttatttctttgttgcatgtgtttggaggtttactcgagacagaggatctcgcttggttaggaagatcactagaatttttttacaaaaattcgatgctcccttctataactggtcatgtgtgccagttgataaaagagaaagattatttttagagtttgcggtaagcttcctctatatgtgctcttgttcaagttaagtttctgtagttttactaacttcttccttttttttgtagaaaactcaccagtgggatcccttaataacagggacagtccagtattacttcaatgagattgtcaagaggcgcttgaaggacatggttagcaccgcaaggacaactcgagagcagcctccatggattggagaaacgctgtggggaacaatgtgtgcttactgggacacagaagcagcacagaaaaggagtcggacctattccaaagcccgtctctctgaccgtaacggtatcggtcgtcacgtccactactctgggccaaaatcttttcaagaaatccaagatgaattggtaagtgtttctgcagattctcataagttagagttttctgttttctgttttcaatccaatatagtctgttttcttgtgagtatgttgagttcttatgtctgttgactactgttgatattgatttgtgtttgtaggaagagaagttgggaagaccggtccatcttggttaggtgttcatccaaacacacactaagtcggatggctcatttgttgatcagaagtcggagaagattgctcaagcttatcagcagaatgtgagagataggttgtcagcactagaggcggctgcttctgctgtctctgatggctcttcacgacctccggagctcacactagatgattatacagccatctttctcgaggtaagatgttttagtataattatgagtcttagagtccaattaatattctatcactaatgagcttcttctctatttcttgcagtccacagaaaaggattcaagaggcaatccttatggacttggatgtctaaaagacactctaggcagcgccaaccgccatcactccggttcctcatcatcctttcaagccctagaagaacggctgcatgaagctcaaaggaaaatagaagagcaggttgcatataatgagaagagagatgctgagattgctgcccgagaagctgagtcatctcgagttacagctgagcaaaaggacaagctcgagcaattgtctttagtcgagaagtatctccgccaaaccgatccgcagttcttggacttcatggccagtcactctaccacaaccacagaacatctaccaagtcctccacctaatgatccttagattatctttgcccaaactctacttgaacttatgtttatttgaataagttgtttgtgtaataaacaagataattgtatttgtatttgaacttgattttctatatatacaagtcttttcatcttttttagcatttcaaataaaaaaagagaaaaaatcataactttaaacaacaaacaagaaacccaacaatcgatgaccaaattcttattcggacaaaacaagtagtctctcagtagtcgtatttaggtagcaaattagacgtaaaatagtcgtataatagtcatattaattaccgattattatccgactaaccaacctagtcacaatataatcgtccatgagacgtatagtagtcgtaaaacattatacgactattatatgacaacgagaattatttccttacattgatagaattagtcttcaaatagtcgtcaactcgtcggaaacacttatacgactattatacgaccacgtgtttcacacgctttgtacaggataattaatcgtgctatggtcgttaaatagtcgccaatattatacgactatacaacgacaattgtttactgattgtgttattgtcgtaatatagtcgtcgatcaacgaccacgactatctcactcagcgactatgtaataatgactaacgtctttagtcgccgactagtcgtattatcattttttactatgcgactgcggtgtaagtcgtttatcacctgttttcttgtagtgtattatagtaataaacatacttttctataatatctgagtaattaattcaatatttgttgatatgttggcattagtttgatggttgtcttatttttaggacttatttgcatcttataagcttgttaaataagggagcgagattattagatatgattattctactaaacagaaaccacataactaattttgttgcttgtttatataaccagggaggtgacatttttgtgtgagggaggagaagttgtgtaaatctagacaatatgttttgagtaagactttcatatttcgccaatcatgcttagcaagcttttgtttctttgtcctaataagaattattcagaaatattatgatcttcaacattttaagattattttatgtttattttctttttaaattgtttttgtatacactcgtcacttcataaacgagttgtaggtatttttgggtgatatttgcaggtacaaccacattccgaacaaagttaaaatcatttgggccgatactggtccactgtactagactaaatcaccatttacgcattcagtatcgctcacgtgtgttggacaaaacttttttgtatttcttcgggtgaacgacctttgtccccccacgaagtttcatatagtaccacaattatatagatttcggacctcgtttccagtccacacaaaataaacttaaagttttgtatctccctaaatcgaaagttcgatacttatgtctccataaattcaaatttcgtggtttaatattggtttacatcattaaccctatgccaaaccaaaaacccattatagtaaaccgaattgcaacccgattcgatttatttacaacccaaaataaataccaattagaagaatcccaaactgagaaatctaagaacactaatttcgattccctctcttcaacatctttgagttgttattagctgataagaatgcaagagatggtaatggtctgaaagagtatgatattcctcgattgaacatgaagaagagaaaacgttttgaaagcatcgtgcaaatgactgtggctggccaaatgtccaagagatttaaaaagactctcaatcagcattgattcattgtgggttttggaagttcttaggatggtactgggaataaacttgacaatgtcggatatagtgagacctccaagaatatacggcatatactctgtgtaacaacatcatgctcaacgaattaagaagaaagccaaagatttatcgaagaaataatgtgtttgtttccttcttcattcaattttgttttcttgattaatttaatattctaaattgtttacaatttcaatctaaattctacctcaaatccgtttatgtttcatttgttatttatgtagtatgttttgctcatactagagctcacacgtaagatgttaagagagggaatcaaaattagggttcttagattttcaatttggggatttctctaattggtttttatttcgggttgtgaataagtcgaatcggatgcaattcggtttactataattggtttttggtttggtatcaagtttataacctaaaccaatactaaaccgtaaaatttgaatttatggagactcaagtctcgaactttcgatttagaggatataaaactttaattttcattttgtgtggactaagaacgaggtctgaaatctatgtagttgtggtactatatgaaacttcgtggggacgtttaccctatttcttccaatataacattcgcatcttttccatcagacgcatgtaacggcacattgattttttcacacatccaacacatgcatgtaaatcggtttgaacctggcttaaccaagaaaaccacaaaatcgattttctttttcttttttttgtcagaaaaaaaatattttgtagcttttcttggttaaggcaagttccaaccggttttctcacatatctaaattgattactttaaatttttaatcaaaaaaggcaaagagatattattaaccaaatcgataattgcctttacattcttcatctcttcaccgtggtttcacgtttctccctacaaagaaaaaaaataatctcttcacgtttttagaactcaagaagacaaacgtaggtgtgattttgttgctctcgtctaacttaatttgaagtaagttctagaaacctaaatcttatggttaagtttgaggtatttgtatataggctgtttatatttgacatggaatttgagatatgagctgaaatagtggcataatttaacatataattagtttgattcacatatatctccttgattattctttgaatttacagaatttaggtgatgttcttgatgctcacatttcttttccctttgataaatatttcaattgccttggatgttgtagactttccacttagtaaacatgacaagaacaacagtaccaacaacaagaaagggaagcaaaagagaaccagcaaaaccaaagaaaacgattatggctaccagatccaaagtaaaagcaaaggcgaaagcacaacctgaatcacctccacaacaagaactgccaaagaaagaatggggcacaaagatggttaaaggcgtcaactatagagctgcgtgtcaaggagctttagtcgtatccactctctattccgatgatttcactcttgacgcgttgggaatttgcgatgatgtggcctggctcttggggattacgaaagttcattttgttgaagtacggagcttatgagaagcttactaaggagtttcttggaacagtcagagttgcttttgaggatgtcaagtcaccgaaaaccgcgatattatattttcgcattggtgacacagagtactctatcacgattcgagatctttgcaagcctttggtttcagtaataaggacaagattcggttcacacactgcaaaagtacttgctctaaatggacaaaatttgcatatgatacctacgaaggtggttctaaagcggtacaaatcaagcatcatgctttgcgttatgcccttcgaatgttagccaacactatgttttttggcgcagatactatcacaatcaaagaaggtgagttctatatcatgatggcaccattcatcaacgacccgtagaaggtaaaccttggagcacttctcacttgtgagttggtagaatataagcattatgcttacaaaaaaagggacacgtgagctgtttttggcattggtggagctgatctgtaatattggaggcttgtgggattgatctgaaagattgatcttgctttccttgggcgtaagcactacttgggaggatgggttgataaccctctacaacttgcttaccgcttcacagcatcttatgaaaatgagcaaatatctttgttatccagccagcatcttccatcgattaagtcgaacagtacaccatttccgccttcagaaagttccttctatgtagctactagcaacagaccgctaagcaaatattacacaaagaagcgaaagtcaatgcaaattgacaccaagtagctctccagtgagaacccttctatctatccaccatttcaccaacctgtaaatgctccactgcgcaccgagacggacaagtggttctactcttctatcagtaggctggagaacaaccaagcacgccttgacaggaaactagcatgtcagggtttgatcatcactaaactgacgcgcgccgtgaagaagtacgctcctccacatattttctagcattcaaccaaggaaaaaatccgcgccaacaccattctgacggggatttaagcgatacgagtctcaaccttgcttctagtctcaagttgcatgaccttgacacaaatgatatcactagtgaaccactagctccagctacgccagcaactcctaatgacgacgagtcggcttcctctgatgacgagttttagctaaagaatcactatcatgatcatctctaatatattaaaaattatggatcgcataaacgtgatataacacatataattattggttgttttaaaaaacagagaattatggatgatttatcttacatatttttggaaacaaatgttaagagggaagcgagaacaaagaacaaatctatctctttttttttgtcaaacaagatcttcattcattcaatcctcaaaagaaggaggttcatacacaaagacataagataatacaatgaaattaaagataggggcttcatgagtttttcaaagagatgtgtacttttaaaaaaagcttacaaggattgaaagattcgaccatgaagtcgggcttggcgaaatccttgcaaacaatgcatccgagcttttgatcatgtgctccacggaggaggatgttgggttggtgaggttgaaaaggaaacggtaaccaactctaaaagacatggtcataatgccgtacttttccaaacaaacagaaggttgcaaattatccaagcaaaagattaatacatgactgaccttgataattggtgtatgggtagatagagagttgtagaggcttcggtaacacctactccgtagaaatagggtcataatgccggtactcttaactctaaaaagcaaatgactatggttgggtaaactagtctcggaaagggtccaaaggaaaccaagcaaatgactatggttgggtaaattagcgtggcgtccataaccagccatatcagagacaaagggtgctaaagggagggaacctgacaggatattagcgatacttcacacgggcaacaacaatctaggacacttccaaagagaaactacttccaaactacttgagatcagactcggacaatcacgcaaacggaccacacgataagaactagcaaccaggttttgtgaaagatagcaactaatccaaactaaatccatcatcaccattacaggaaggcgtccataacaatccctaaacgatgacagtttcagaaaatttgggctgttcagaatagaattaaaacaagaccagggccttagaagacgtgggcataagtcagcagaagtctttgtgggcttcaaagctttgggtaaaggacaggagggagggcaaaggaggcttgggcttggcccaaaccgaagacccattaggtttagccaggttcttctcttcctcaccaaaagcggcggtggcacaactgaatgcaacattctggtgaccgaattgagggcttctaagactaaaacgaccacatcgagaggtgcgagtgatgaatctcggtctgcagaagaagattcttttgtgatttgaagcctccacagtttccacgtcgaggccgagctctcatccattgaggaccaaagagttgctgatcttgactttaaggaaagccgaggagagggatccacgagaatcgcgaacaaggtaagagaagagctaataccagatgggagtagtttcgaaggttgtgcggtaatgaagctttatggatctaataggagggaaaagagacgaaacaacacgaaacaaaaaacagagaaaccgatgagagagcttatgggaggaaaccggtgagaagaagctagctcctggcaccgacgagctaacgctctaccggtgccagaaaaaattgatgaaaaggctgtctcaaaaatcacgtctgggagagaagctcttgaatcttcctatctatttagaaataggaagtaatgcttaattaagatgtagaagccgagtatttccttacatctataggagatctattcaacatggactcagttagttttttttcttttttgggtattaattatattgttgttattttgtgagctaatttttcttctttctttcttttttgtgtgtgaatatcttttagtcgtctgcgtttttttctctaatttaaattgtaaaatctcttaaaaatataattagatttcgtgaaaatactaaacaatttcacatccggctagttattttatcctcagcgggaattaatttcttttgtataaattaactacaacaaattattggatttagggtctctagggaaaactggtagagagcaattttagagaatcaggattgattatctcaaggtcacttaaactggttttcaaatttaaagtttgttttatgaatctgttaatattacgtattctgcaaatcggttttcaattttgtagtactaacgtttttttttctagtctaggatcaatcatggatccatggattcagaggcaccttgatgaatcaccatctttggaagatcacaacgcctcctccacttgctccagaatgtaaaagcttcaaatggaaagtataagtcataggtaataattattttcattaaaattgttgtagtagcttgaacatgattgttgatatggttcaaatttccctagaactactctctcaaataagagatcaattgcagtatttaaggatcgatttccacaaagttctttgtcaaacaatgaattgaatgtcgagattaagctagcaggtgatgattgaaattttaagaaaacaaagtaagaaaacagcaggttgattgtgttgtaaacgattaaataaactattggttagtagatctaatgaaagctaggttgttatcaaaccattcttaaactcaaactctaattatggaatgaccggtggcgttccgcgaaacttcatatatctatagctaagaataaccggagaagccgagaaattattaacctaaatatgcattcttaacgagttcgattgttcaccttggtagataggccgattcttattacacacctacaaaccaggctcatcaaataatatatccaactacagatacctatggcgggcatatctattgtctggattcaagatctagttagctattctagatctagcattaaacacagttaaagatgaataattttacagataacctagcaaagggggcaatctactaaaccatatgaatccctaatgagaaaccctattcctaacaagcagactactcagacatattgattgaagcaaacaacatctttgagtatgaaagcataaacacagtaaatagagaagggaaaagaagggatctcttcaatgtattaagaactgtatgaatctctggaaaacaagggatgaatagcttatatctctcagtaacagggtttgcaaaaaggttgataaaaacttgatcgatgaaacttaggtctaaaacaaagtatatgaaaccctaaaaacgtccagggactaataatgcaaatagagaagtcttctggggtaaatttcctcttatgtaaacttgaaagcgtcttggacttttgttggcccaaaactggtgtcgatcgacaccaagagtgtgtcgatcgacactcctcttgattcctgagtccaaaatcgtccttagcttccttttccttagcttttgctccaaaatgttttcttatctccattgctgtcccactgcatagaatacctgaaaagacactaaaaagactcgagaaacaacataaagactcaaaattctaaccctaaatcatatataaaatcagtgaaaatagggatatatcacttatcgttttacatacttgaaatctaaacatttgatggtagtgtttatttataggcatagctcttcttttgtttttagtcctcaaagtaatcctatatattaatttaatttactattatactaatcgaattccttctggtgtttgtgtttatcaacaagataatgatggacgcatagaaggcaaaatggtgacatgtaaagatgtctggaatttctaaacgacaaagtgattgtgcatttcaacgaagatagcggtcatccaattggagattcttgtggtttacttggatcatggataggtcaattaagtcatgatctgaatttgctacccatcaactacagcaattggaggctggttaatcctcacactaaaaaaaggcatgggatgtgattgaggtaacttttaccatctatttgtttctaaagatatttataaatcgagggatgttctaagacagtattctggtttgatgatagctgtatgtgatttcatttaagcctaaattcttgtttgatgatccggcactgagaaaaggatatgtgatgggcgctctaggtagcagatgcaaggatgtaaaactacgtctttggaaagcatacaaacgaagtaatctaagtgaaacgttggagaatcgacccactggtgttcctgaagatcaatgggatcattttgctcacatgaggtttgttgaaaagtggaaggtgtagattattcattgaatatttatgtataattctatctcttcatatcaaatgaacgtaagttcttttaaatgtgagctctttcaaaatatgcaagagcagaatagaagaaaccaatatatatatatatatatatatatatatatatatatatatatatatattatgcctcacgtgtgttgaagaaagagcttttcaaggaaaagagatgagattgtaagtaacttagttgtataataaaacttgtttacaatattgatattaacgtatactagtgatgcatgtatctcttatgaagaaaatcaagactggaaaaaaccatgtcgagcggagtttttcattgagactcgcatgaaaccgatggaaattttgtatgtgaagaggctaaaacatgcgctgttagttttgataagtcaaaatccccacagcacaaacaatgttgcagatagcttggatgatgaattttcgcaagtgtttggtccagagcgtcttagacgagtttgttgtgttggtcggggatccacaccttcacagttagtgaaacgcttaactacatctagagcagagatagaaaattctgaattggtcgttgggctgaatacacaagtgaagcaattatcagatcaagttagaggactgactatctttgtccaacaaataattggtacttcaactgctgatcatgtattaatataaagatagtttctaagttaaattgcatcattatactttgatatataaaacaaatacattaatatatatttaggcaagagcatgggctacaagttttgctatagcttttgcgaacatacctaatccaatttttgcaaacaccctaaatccttctaatgctaatcaggtatatgatttttatatactaatttcgtaaaaaacctttttaatgagattgagttcgatactacgccattttctcgctttctgtagcaaattctaagtttcatacactaatatgttttttttctcgagcaataagtgatgatgctaatgttaattcaaacggtggaaacacttctaatgatcatgatcaacattagtatagcaatatttcttatcaactttcgtttatttttgttttatggatttgcattatggataaattatgtaatctattttctaatttatgtattagataaagtttatttttaattacgtttttgtttctaaaaaaggcaaccaaataggcttttttaatagaaatagatataatttcacatatgtgaataaaaataatattttcatcagtttttaaccgaaacaggtattattttacatcgccaacttaaataatataatttgtaaaatcaattagcaaaattgacacttattgatttagcttaatctcgattatttaactttttgtgtgaaaaagagctttgtgaatttgatccctaagtactacaactgacctcttatttgagaaagcggtcgagggtaatttgatccatatcatttttcttctgtcttagaaggatagtcggatgcattggatcaacaacgaggaagatcattcttctacaagtggttgggtgttcttacttaaaggaggtgccatttcatgggcatcaaagaaacaaacttgtattacaaattcgaatatggaatcggaatttgtatcattagcagctgcggggagagaggcagaatggttaagaaacttagtctccgagattcttgtggctgaaatcggtttcactcatttctatccactgtgatagtcaagctactttggctaaggcttatagccagtgtataacggtaagtcgcgatacctaggcgttagacatagcgcaatacgtgagttaatcatccattgggtgattactatagaatttgttcggagcctacaaaatctagcggatcacttaaaaaaaaggattagctagagacatggtgatcaagtaggctaaaggagtgggattaaagtccatttagactttttaattgtggaatacccaattcccctctaatacaacgttagaggctaagttcaattcggaaagcccatacttagagattgaagcactggtttatatcatcccaaagtaagtgcttcgatctccaagaaaatgttaggttaaacttttcttcttaatagatcttttgaaaaattacattttgcaggtgcaaaagattaaaagatctacctatatgagtttgaagtgtagcggcttcaaaaagctcggacttatctttgtatacactcaaaaaaggataaggacacataacttataatagtgtcaaggctaaacgcttagactagtgggtgaattcgtgtgtgttttatcttcatgtgttcaaatgagtcgaaggattcaatccgtaagatgcacatcgtcaattaagtttggatgtgtaatattactaatatgtaaattctatatatttatatttatgcatgagtttggtttatgtgtttatgtgttggatatttaagtgtaaactacttaaatcaacggttatttatttaaccattgcaattgttcattttatggttatattataaatgtacggtttcaaacatacgttataactttccgaccatatataactctgttttcttgtgttaaaaacaaagtaaacaagagagaacaagagagattcaggaaactaaagattgagagaatctttagtgaaacacacaaaacttttatttatttctcttgtatctagcctagaacaatataaagtactttgattgtcatatcttaggagatatttcgtgtaacccaaagtttgagaaggataatactcttaaagaaaaatgcttccaaacacgttttaatcattgattatcaaagttcacgttcattacatccccgagatacaatgtcgatctacaataaatgtcacaaagatatcaaaaataaaacaataatataccgttggcatgatttaaattgttggtatattttttcacttggacaatcgttcctctactgttcatttctctctctctttctgaagcttttttcaatttcttagatctactttgtttttcaccttcgttcttcatggtaggtcctagatttgcaagatgatgcaggagtgaggcaagcttacttctccgacattggagtggtgtggtttttccgtttagcgtggcagcggtggccctttcttggcggacgagaggcttctcttccaagtcttcctggttatggatgtcagtgaagatcggtggagtctttcttggctcaaccgatcggatagaagctgtagttgtggcggaagacgctgcggataggtgggtttccggtgcgtgtttgatgtttaacggcagatccagttttggatctgagatggcttatgcgggatttggttgtggaggggttgtctgagccttcacccttccctaaccgccgtgtttttgtctccatcggacgagattgaagattgctttgcttctggaagattttcagagctacggttttggaggtcagaggcttggaaatgagtggtcattttgctaggttgggggatcgaccaaattgggtggccgagagtcggaaactggatttattccgtaaagcttggtgcaggtccggtcattgataagagatttgcgtcaggattcatatgctccggtccttgttgtcgctctggtggctgtgttgcaaagtagtgggctttgtatacgacagtattattagatctgttcgctgcctccgtttcactgcccaaatccaactatgccttctctttttccggtaaccggaattttttctgttttgtaactgttgaatattgtcgaaccgcttcacgttacttatgtaaacaatttcccacatttttggttagtcttagctctaaataatatctgatataaaatagaaaaaaaaaaaaaagaatattgtatttgctaggcctatgtccaattggaagtgtgctttatatattttttttaaaaatgatttaaattgttttttttttttcgaggaaaggcttccattcaatttgttgatacgcaaaggaagaaaaagaagagaaattctcattattatcccgtgttttatactaaacttttaaatcaagtcatttctactttttcatggaaccatacgaatcgtagttaattgcttcaccaaacatcaaaataaataactgaaaactaaaaaaacaaaaagagtgacaatattacgtcttgccacaacacaacaaaacacaacctcgctcacatcaaaactctcttgtcacttctatgtcctaagaaactgagcttcaaagttagtttctcaatgcattttctcttttctttccctttccatgattttcaacaaaattataagtaaacaaatgtccacagatatttctttgtgggtggattctttgcttgtatgtagtggatttgtgttatgattctctgcctcattttcagaccagctggttaaaaggctttttgttctttctctctttataatccaagtgtcattttttcatcgaaattcataattccctttgtttttaatggaaaatagattttaaatacagttcaaaaatgtttttaaaataattgaggtctagatacgctcaacggttatgctcttctctcctttaatatctccataattgtataacaatccgtttcataggtttctcctctctcttcttcttttctccttgttaaataatattcaaatttttttccttattcagctagaaagactgataattgtactaaggttcatcagattttgaaggtgtttttttttttcctttatggcattatggtttgatctattttaatgagaatttttatttaccttttgttattttctctgttgcaggaaatgaagaaaatggaccactgatgaaagtaggaaacaaacttaatttgatagaaccatcttgatctttctttttttccacaaaagatatatttttgtcttagaaaagaaacaaaaagttggagaaatatcatgtgatttctggttgatagttggtaaaagtgtggctacaaaagaaagcattttccgagaaaatcttttgttttcttaagaaaaaatttcagttacaaaatagaaggagaagaaattgggtttggttatttagtgaccaatatagagaaaaactagagttagtatgagcatgaagtcattagaaagagtggtttcagagagagcattaaaacttggaaattcatttccatgtcaaatatgtgtagttgggtttctatgtggaatctgtctcacttcactcttcttagctgctctcacttctcttggcaccttcgaattcgccgccttctccttcacctcctcttcctctgtttttcctccttgcaattcctccacctctcacatcatcagtgagtctcaaagattttgatttttggtaacttcttatgtatgtttttttttttggtttttggtaatgaaaatttgttgatatgtagatatggttgcaagtatagaccggaaactgaaatggaagaacaaagttgagatagaagaagaagatgaagtgaaacttttggtctctgcttgggataatttattactaaatgaagaagacttcttgaagaaggtaggtattaacaaatccgatgtaccaaatggtccacatttggagaattgtgaggagaaggctcgagttagggagcgtttggatacacgtttggcgaactggacacttcctccttgggtatgcttcttctttttcttgttctttgtcatcaagcaattagtatggtgaatgaacaatcaaaagcttgtgttttagatcagtggaggagatgaagagaattatccgttaacgaggagagtgcaaagagatatatggattcatcagcatcctttggattgcggaaacaagagtctcaagttccttgtagctgattgggaaacacttcctggttttggaataggagctcagatagctggaatgactggtctactcgcgatagctataaatgaaaaccgagtgcttgttgcaaattactacaaccgagcagatcatgatggttgcaaaggtacataaaggctttaatcctttgagtcttcactctaacatatagcagcaactatcacaaattacatcttcttggttaatcttcttatcaagatgttttagacgctgaaaagtgtatataagaaccaaactttggatttgatttggtgtttctcttttgttttgatgcaggttcttttcgtggaaactggtcttgctattttctacaggaaacgtcagaagagtgtcgaaaacgagcctttgcgattgtgaagaagagagaagcgtgggagagtgggattgttacagggaaacaaaattatagcacaaaggagatttgggctggggctataccaaagcaatggggtaagccttggagttatatgaagccaactacagaaatcaacggaagtttaatctccaatcatcggaaaatggatcggagatggtggagagcacaagcagtgagatacttgatgagatatcaaacagaatacacttgcggtttgatgaacattgctcgaaattccgcgtttggaaaagaagctgccaagattgttctttcagctggagattggagaaagaagaataagaagatgaggacagagattgaggaacaggtgtggtcggatcacaagccgtggcttccaaggccaatgctgagtgttcacgtacggatgggagacaaagcatgcgagatgagagtcgcagctttagaagagtacatgcatttagctgatcggatcagagatcggtttccagagctcaacaggatctggctctctacagagatgaaggaagtggtggacagaagtaaagattatgctcactggagattctattacacggaagtggcaagacaagtcggtaataagtcgatggctgagtatgaagcgagcctcgggagagagatgagcacaaactatcctctggttaacttcttaatggcgtcagaagctgatttcttcgtcggagcattgggttccacttggtgtttcctcatcgatggtatgaggaatacgggtgggaaagtcatgtctggttatctcagtgtcaataaagatcggttctggtaactttgcgagttccacactatgtacataataagactcctctccttttttcttcatctgttgcacaaagagttttcagtataataaagggaggtttggttgacaaacagttcagagcaaccgcaaaccaactaaaccgattccgatgtgaagatttgaagatcaactgaacagagcaaagtggcttttccttaagaatttcacaaataaaaagacatcacttcaagatcaatagtaataacacaaccaacctcttctcatctcagtgacatcctgtgtcttcaggaaccaaccaaaaattaaaggaactatagcattgaaattcacaagtctcaacatctggagatgatgaagtaacacccagagatagaaacatcagagcaaagtgaatgcaatacaggtgaagaagactgtaaaatctagacgattgttaataaatataactgtagaatcagctaacaaataaagagaagttagaaaacaaatccaagctaagtatggtattcaacagaggatactaccggcttttcgtttgtttttcactttccttcctcaacaaagctccaaatgttcttctcagggactttacatttctcttctgcatgattaagttatattatgaaataataacatttgcacaagcatcaacatcaaagttttttcagtttcttttttttctaatccttttccactagttttatcttctagacactacggttttccgttgacttacctttatgaactcaaaagggagcctccagcgacgactcatcccaaacctcagcacttccattagatgcatcttcaacatcttcttccattgatagcctaatatactctctatgtgcaaaacggtcccaatctgtcaatgtagggttctctcgctcctgtttccgtttgacattagaaatgttataagacgcatgtggtggtgtgaagaagtagcaaggtaaattagatgattagtacctgacgaatgaggaatggatcccgggtttcaaatgccataaatttgttgagattaaataggatgttgaagacgtttccagagagctttgagcctttcaggtcatgcagcgttatatggctttcgttctgtggaaggaaataaaaaacaatcaaacacaaaacaaaatcacaagactcagaaagaaaactgggaacacaaactacttctgtgactatactaaatatagaaagaagaaaacaagagatatattgttgaacctcaggtccgatcatatcaatcatctgacataagatatcctcgaaaagaacagcctcttgcgccatgcactccattctatgcaactgctcttcataaaagaattgcatctcatttcgcgtaataatcccatttgcatccaagtctatgcacttaaacctagtccaacgtatacttgtgtcagataaaagacttaaaatggtatctgtctgcaactttcggacccttctatcacaacttaccaatattctaggctaggcactgacgatttatcttcttccgcaagaatgaaatagacaaagtcctcataccccatcttcccttcaactttgttagtgaacttcctagcaacctgagaagaaaccaatgcatcttaagagcaataataactttgaacgaggaaagaactcttaaaatagaagcaatataaataaaatcttcaagtagtaggcattaaagagcaaggttttttagacagaacctgggagaatattctgtcgacaatccggtaggtaagagcatggtttccatatcgcataagattttctttgtcaatcaggaaatcgtgatccgtatccagctcccagaacttgcagtatatgacatagaaatgctcatacgagaagtatctaattgccaaagtgaatagaaaagtgatgttaaatgagcaaaaacaatactataaatacaacaatagcacgcaaatatttttgtcagtacctcaacactttgttaatatcttcttcttcatcagcatgtagcatagcatcaattaagtttccccgtttaagctccctaaatgtaattcgaccattgccagatctatttatgtaataaaatattcggtaggtgacagtttcagctgtttcagcaaaatacaaattgtatcagacagaaaagcatccttaaaaatttagctttgataccggtagcagcaaataccaaagaatatggactccagatatctagaaagcaatcaaagtgttctcgggaattcattactaactgacgcatgattcataaacaagctccagaatttattttttctgatattgattatatctgcaggattcatagactgaagatgattcattccgtgcttgaaagctttatggatttgcaagttataagatgatgtctaacacaacaaaacaaagaaaccgtatcttataaaaattttaaaatccatacagagtaatgccacatttattactgtatctcgatgcatcaattatcaaaattatttatttcactagaaatattattgatgtggtaaccattcgacagatttagataagtacatggcaaacttattcactcattcttctcaactagggctgtagctaccaatatacttcgaagaataaaatgtacaatcaaactcaattactaaacaccattactcaagcaatatcaagaagaaatactattgatctggtaaccatctgacagatttagataagtacatcataccaaagtggcaaacttattcactcattcttctcaactagggctgtagctaccaatatacttcaaagaataaaatgcacaaccaaactcaattactaaacaccattactcaagcaataccaagcggaaaaagaaaacatgagataacttaggatactaaaaatgtaaataaagttgagacctaaccatatctttcttggaattc

SEQ ID NO: 198 - DNA, 86585 bp, Arabidopsis thaliana
aagcttgtagtgtctcatatatttcagcgccagtttgtatcctattggcattcccttcctcaacagtgttatcaaaccaagcttttctatatctgtaacgatggccaggcggtagtctctttctattccccatatagacaaacttacggctaaacttaagccatctggaaggtgtatcttttttccacatacattgcaagcttgtttccccttcactttacatcgagacaatgttcctagggctggatagtcactaatactccatagcagcatggctctaagtgtgaaattctccttcgcaaatgagtcatatacttcaatacccacaaatcttttaaatcgtctatcagtggtgccaagtaaacatctatgttattaccaggagctgttggaccagggatcagcaaagacaacattatattctcagccttcatacacatagtcggagccgtgttatatttcaccaacaatactggccatgtgtgctgtgattggtgttttgcatggagaaagggttcaacccatctgttgaaattccaagtcgaagattccttggttcagcagcaaagtctggccatttatcattcacttgtgcccaagatatagaatcaacggggtgtctcattataccatcttcagtgccatttatatagtgccaacgtaaatcttcaaccatcttttttgatctaaacattctcctaaatctgtccttgattggaaaatatctaaggaccttggctggaatcccaacctttatctcattactgtgcttatccatttcccatcttgaaactttgcatcttggacagctatctaacttctcaaactccttcctatatagcatgcaatcattcttgcaagcatagatattttcatattcgaaaccaaatatcttcaggattcttttgattgcagctaaactcttcggaagtacattgtcttcaggtagcatgtcttgaattaaatccaacagctgatcaaagtagttcttcgacacaccacttttaaccttgaatctgtaaagtcccataattgctgaaacctttgtgtatttgatacaatcagagtacaatggagtttcaacttctcttaacttctgcctaaactcagtttcctctactgcttcatcgtcgtttccctgatcatcattcgtctgatttggttcaccttcacccatagagaatgctgtcttaaacaagtcaaatgcctctgtttcatattgaggaccaccgtcttctgtagatgctcttttttcaccatgagtactccaacaagaagtgttatacttcttatccataccccttatcactagatgctcaacaatttctttgatagactgatggcataaattgcgacaatctctacacgggcatagcatttcagacagattgcccaatcttcttgctgatgaattggcgaagtttgttgctccttctaagtactcaaaactattcctacgttgtaaatttgaaaagaacttagctagatttctttcaatcggttaataagctcagaaagaatttagtgtataccttggcagcgaaatccacatcttatccatttggttacgatggagatggatccgttctgaaattgctgaaccctaaaacatctgaatgaaccctaaagcgacttggagagattttggtaaaccctaaacacgagttgtgtgtgttctgattttttcgtttcaccgcgaaatcagacactaaagaatgaacggctcagatcaaaagaagtgaaacgaatcgaacgatgtagattgcaatctcggaggttagtcaccattggctaataacacgaacggctcagatcaaaactagagtgacagatcaacggtctacattaatcacgtctacaataagaaaggacggctgagatcaaagttggcgatacatatctaacggtgtggattgcaatctcggaggttagtcactattggctaataacaagaacggctcagatcaaagttagcgagacagatcaacggtctaggattcgtcccccaatctaggaggttacttttcattggcaaagaataatttttttgtttcaaatccaaaattagcatatacaatttttttattaatcaaaaaatataaattattttttaaataatttcaatataataatttcaatttttaaaatatatttcttataaatataaaattttaaaattaagaacaattaatataagatagtattccaactatctaagttatatgttcataaacactaaggcttagtttaaggtttagggtttaaactttgggatttatgttttgcactttaggatttagaagttttacttcaatgtttgagattaagatttttaactttaggatttaattagagttttcactttagggtatagggtaactttagggtttagggtaaatttggggtttaggcgttttaacattggggtttagtgttttaatttggggtttaaagttcaaatttggggtttaaagttcaacttttaattagtgttcaaatttggggtttagagtttaaatttggtgtttaaaaacacaatccaaaatattacacaatctggtttaccaataccataatattacacaatcttataatacaatatcggtttttggtacaaaaacacaaactgaacctattacacagtctaagtttcacacgaactttattttatcatttggccatgctacaactgaacctattgcatcagaaatgtattcgatctctggatttggcctccagaccattgcattaccaatcttagccacttcaacccagactttgcttgcattaggacctaggggtacattatggcaagcatcgttcgggtctgttgaaagtactcttccttcagctaccttatgtccagaattgctgcaatctaaaagaaaacacttctgctttggactttttgtggaactgttgctgcctgaactctacaactcaaagccaataataaaagcaagttccaacatcaatgaaagttccaacatcaaccagcagacaaacaaatgaattaacaaggttacaataacaaacctggactttaggtagtgctgcatctgtagtggtggcagccgtgacgtcaatctttaggactggccatgcgattttctcgttaattgcatcacccattaaacaaatatcagtagttggcctccacaaatgagcattaccattgaacaccttcacaacttgaatactaacagcacttggttctagaggtatattgttaaccttctctttggagttagatgagcacacaacaccttcagcaataacctcatcgtcttcattagtccaatcatatattttgaatcttcgagtttcaccttccttggtttgctaaaatgtaagaagctaatgattagagatatatcatggacccttatacaaaagcactttaagaagcggttggacccttatacaaatgtaagaagctaatgattgggaaacttgaccatggatacatcttcagaagcggctggacccttatacaaaagcactttgtctattggccaaggtattttgcatcccacagcttcttcaagatataacacatctgttgtaggcctccacagagaagcttctaagcttagtgcagacttaacaaggacaaccattgcattaggaccaattggtatacgaccaattttgtacatcggttcagcagaacacaattctccttcacctacaactacatctcctgaatgaatccaatctaatatttgtactctaactccttctttgaatccaccaaaactctcagatgtttcagtatcattgtaacttttctgagataaggaacaagaattattaaaaccaatccaattaaccattccagatgtttcagtatcatcattccctttaactgagataaggaacaaggacagtttaccttttttccagctaagtctcggaccattccctttaactcctgaatctcactttgcatttctgccatctttgcgtctctagcttgcagaaatgctaacttagtagccgtaatccctctaccaaacccccttactcgtccaggtttgtcttttcccaaaatcttgctcacagcatcttcccttatgttttcacaagctgatgtagagtccatttgactatcaagtgaatgtatttgttcctgatcatacaaacatttaaaccaaaaaaaactaatttatcataatccattacttatacacaggccataacaagttccagaattctcaccatagtctcagcaaattgaggcttcacaggtctaccatcagcatgagtgtgtcccgcaatccataccttactcctagtcaccttacttgggtctgtactctttttttttctatataaagtacatatatatcttagtaccaatttgttctaacaagaatacaatatatatagatatttgacaactattattaccatatcatgagctaaacaaagcattcctttacggctggtggtgtgaggaatctgattttgtctcatcttcctgtatttgttacttatttcctacatgataaatatcaacacattaaatctatcagccatgacatataaacaagaaagttgttagttgtagataactaaccgtgaaagctgcgttagtcttgctcctaacccaagagttccacacttgaatggatgggatgttgctgggttttaaatctattctctcagcaatagtcttcgcagcacgtacttctgaaactagccttgacttccaagccctccagatatttccaatttgcttaaaaataacaactctctaccattcttcttgcaagttaaacctcccctacatcacatacaacaatcaaaagtcacacctgtttcatttatgttcaaccaaattttttttccatataaatatatacatgaatttcttcccacattgcttgtttagccactgcatcaattttcctccaatcagctagtgtaaccggaacgtgttccctcacaaggacacaaagaaaagatgataatgttattgaaccaggtccaacatgatcaccaaagtcagtgaaagtaactgaaaccttttcattaggattttcatccactttacgcatctttgttggtcctctcttctttctttctttcactctttcctccgctactttacttccttcaccatcttcttccatattggcagcttcttccatattggcagcttcttccatattggcagcttcttccatattggcagcttcttcattctcctgctgttcttgtccagtcaaacaagcttctccttctatctcagaatcttctttctcatcttcagacatttgctttctcagtctgatcagcctccggtactgttacatctttgtcattacccttctcttcttccacaacatccggtgtaacatcttctacctcatcatcttgcggtgtcacatcttctacctcatcatctacaggtgtaacatcttctacctcatcatctcgagcagccattttcttgcttcttcttgtagccactttctttgcttttcttttcttattcacctttaatgttgttgcaggagcaacttgtggtgttatatcttctacctccaagccttggttacgtctactacgacgagaaccaactttacctccacctcttgtcttcaccatttctgaaactgataaatgaagaacagtttcaaccgaaacccaaaaatcataatcgaaacccaaaaaaacataatccaaacaagacatgcatgttctccgaaactaagaatcaaaactaacaaatcaaaattgatacccaaaatcacaaacttccgcatccatgttcacacaagccaagaatcggaaccacaaatcaaaattgttttccattccaaagaacaaagaagctatgattgaatgagaacatacctattgaagattgtagggagattgtgataaatcgagttgagagactgagaaatcgaattcagagactgataaatcgagtgaaataaagtgcgaattagatggagagacagagaaagcgagtgagattgagagaaatcgagtgagagttgcagattttgtgctcaataactcaagaaattcgaatgatacctcaagagagaaaatgagagatcgagaatgaaaagttgattttttagatccaacaaaaatgagaaagttattttttaggattttgtttattttgccttagccaaaatttcactttttcctcatacaattttcaatagcgggatactaaagattagaaccacaaaattgccccgcgtcaatttcattatcccgctttaataatttatagcgtttacaatatacaaaacgctatctttaaaacacgattaagtcaattatagcacatagataaaaaaaaacgctatcttattatgctatcaatacccacatttcctgtagtggtcattactcgcaatttgtacaagaaaacctgattgatttcataagtataaatattacacaacatgttaccaaacatttataagtttcatggccagggcctagtgccaaaagcacgatacatattagaaacatacttgttttacaaaaggcacaaaactactgggtttcctaatgtccaccacgccctctatttcccactacgggtttcctgcaaaacaagtagaatcatgagtaatctaagattactcagtgagcttgggattccctgcaacagacatttgtttaccccaacccaaatacccaacatgaaacacgcaacatagaatggcaacgaaaggtagcttgtcgaagcaactacataaatatgcaatgcattaagactccagttttattaaatcttttaaatagggccggatatgctgccaaacccaacaccaaacacacactcccgtgatctcccgcattacaaccacaaaggtatgcaatcggagcatcactaccaaacgctacaccgtcgtgtagacactcggccaaggtaacaacgttacaagaccccaaaaatagcacggttcactacgaaggccagacttatcacgatcttggcacgcttatagtctttgcctcctaccacaagcaccacgtaccaagaccccaaattttaagatattatgaaacatatgattaaatcaacacatagaatcatcaatatctcagcacaacctctcaaccataagcaatagcataagaatctaaagatcacatatgcaatcgaatataaccattcaaacaattcatataactcatgaaatcaatcaagaatgcatgaggatatgattatgaaacttaaacaattatccagaactcactcagtaaccaacggaaagcttctaatgattcaggcagagttctcggctatgggaccctaacttggatcgaacagacgggttaaactcggcagcctctcactcccacctcaatttctcttcacaaatcaaatgtggtcgagttgggcttttataggcaagggattggcgagtcagcatgtccacgtgtcatgagtatgggcgagtcaccaatccacgtgtcatctacccgcgatgacacgttcgctactcaagcggatgagtgacacgtggccacctaaatttcggctccaagctactaatattcgattccaaacaacttttcttgggccccaagttagccgagccacgcatccttggcgcggtcaacagtcggtcaacgcttggcaaggcaaactttcgcccgtggcacgcccgttcttgcccaaacttgcccatttgtgcccattcttgcccaaacttgccctttgatattctatggtgttttgggcacctaaggtcaattggccatgcattcgggcaactttcgaaaattcggactcttgcccgtggtcgatgtccttacgcgggtcactacactatccgtttgagattatgtgtgatgcatcagattacacagtaggaactgtactaggccagataatagagaagaagcttcatgtcatatattacgccagccggacgttagatgaagctcaaggaagatatgcaacaactgagaaggagcttctaggtgttgtattcgcatttgagaagttcaaaagctatttggttggatctaaggtccctgtctatacagaccatgcagctttgaggcatttgtatgccaagaaggatactaaaccaagactgttgaggatgatacttctgttgcaagagtttgacatggaaacaatagacaagaaaggcattgaaaatggtgcagtcgaccatctgtcaaggatgagaattgaagaacctattccgataaacgactcaatactagaagaccaactcatggttgtagaattcttcagtgggagctacaacatgaaagagttccaccaactaaatgctgttgagggaagatctccatggtatgctgatcacgtcaattatttgacatacaagaaagtgtcaaatattctgcaagcaggcttttggtggccaacaatgtttaaggacgctcacgagtttgtcccaaaatgtgattcatgctggagaaatgagatgcctcataacccaatcttggaagtggagatctttgataagtgtgcattttacatgttttgagcatccatttgttatcactattgcatcatatcaccactgttttataccatttctcatcatttgtcatcactttgcatggttaggatagttttgcatgcatgttgcatatatgtgttgatttcaggtaatttggagctgttgactagctaattggaagaagcggaaaggaatcatgtcaaaccactcgaccagtcaagatctcaacagaccactcgaccccctggtcgagtagaagacctcagcactccacgtcacaacttgacccacatggtcgagtacgaccaggactaccactcgatcacattactcgaccccctggtcgagtatcatcccgtccaccacatcaccttcactcgatcacactactcgaccacctggtcgagtaccttcatcaccttcactcgatcactctaccaccaagccgagtaccaccatccctatcactagactacatactcgattgccagcttcagagtcttcttcattccgcactcaaccagacactcgagcacaaggaagaaaagaagactctagcttatcactcgacctctcactcgaccacctgggtcgagtgccgttcttaatctgtcccaagactgcgtcgttttgagtattagggtttcacaaatattttgctataagtagcatgtactttacatttttgtttatctaagttttattccgcagacattgtgttcttgacgtttttgaatccgggtttctcttaatctattcagtattcagtatttgttcttgatttcgtttactaagttgttcatcctgttatcatcttggtattactctgttgttatcatgctttcattctattcaacgtttatgttctctgcaatgatgtctgggtagtgaataggtttctgaggatgggttagagtagtttagaattctcagtatgctaggtggttgagtttgatttatagatcccttctggattagttgttcttaatgcctattgttttctgatcaactgaaatttgagccaagacatttctgcgcccgaaaggtgttcgatgaaatgtcttaaccacttattccagagattcgtggctctgtaccaaggtattggttgcatggagcgctttggctttaacttgttgattcgtaatgcctgttaggttagctctcgtcaatggtgattgagtctgggactggtttaacttgagggtctctattgcggtggcacttagacttggttatcaaacttgttgtctagggataatttattgaccatgtcaatcacctgtaaattgaggaaacgaaactactcaattaccccatcctcgggaatttctttatctaattgatttctttgtttactttgctattgtttattgcatcttgttacatgttacctagtttttgcatttcttgcttgttactggactagatattcgaccacccagttgtttgggaacagactgtgcagtcgagtatctctgttacattttttgtttgctactcgacctgtcacttgaccacattcagtgctctgcaacgagctgtgttggtcgagtgttttattgtttctgcttgattttctgtttccttcatgttcacttatgactgctagaacacaccaaaacctgttattgcttggcttgactctgtgaactctgattgcatcttgattgttagcatcacgcccatttggattgacaacctaaaatactacaacgacatgaatggtgttttaggataattgacttaaaacctattatcaatctttgatgtatggggaatttattttacgggtccattcccatcttcatacggtaacaagtatatactggtcgccgtagattatgtatcaaagtgggtcgaagctattgtcagtcctactaacgatgcaaaagttatgctaaagctgttcaagaccataatcttccagagatttggagtttccaaggtagtaatcagcgatgggggaaagcatttcattaacaatatttttgagaacctcctcaagaagcatggagtaaagtacacggtcgccaccccttatcacccacagacaagcgggcaggttaagatcttcaacaaggagataaaaataattttggaaaagactttagggattacaaggaaagactggtctgcaaagctcgatgacgcactctgggcttacatgacagctttcaagacccccattggtacaactcccttcaatcttctctatggaaaatcatgtcacctacctgttgagctcgagttgaaagctatgtgggcggttgatccaggaactttgacataaaaacagttgaggagaaacggttgatccaactaagtgaccttgatgagatacgtttagaagcttatgagagttccaaaatctacaaggagaggactaagcttttccatgataagaagatcatcaccaaggatttccaggttggaaatcaggtgctgctattcaattctcgcctaaaactctttccaagaaagctcaagtctagatggtttggccccttctgtgtcacttaagtccgcccttatagagcagtcactctagctggtaagagtggagattttacagtgaatggtcaaaggctcaagaaatacttaacagatcaaatccttccagaggtgacgtcggttcatctccaggaacttcttgatgattaaagaagtaagggagtcaagctaatgacttcaaacaagctcacttgggaggtgacgtcggttcatctccagaggtgacgtcggttcatctccaggaacttctctgtacatatgtttgttttgtttgttatttttgatgcgttttacaagtgttttcaagagataaccgccaatgtttaagtgcaatggatccaatctcagagattcactcgactgcatgctgtagagatcgagtgtctgtgtgcaatcaagtataaacatggtttcagttggagctccaagatgtcactcgatcacactggtcacatgctgatgaggatctgtagtcgagtaagtttgatgattcagatcctttatactggaccgtgtactcgacaaacagagatttacagaggatttcatgatttcctgaggttttgccgagtcaacagggaactgagattaaagacaaaacaacagagcgtggaccacaagcgttttctccctaaagataagatggcgagagaatcacaaattcaatctccaccacaccctttgaaatcgccctcatcctaataaaaagtaaagtttactcgacccatctctcttcatctatccaccgacaccacaaatcgccctctctctctctctctctcgtccaacgaattacttgaccgctgtgaaaagaatcatctactcgaccacccttgcgccgccgcagtcgagttccccatctcattaactgtcaaagcctcaagaaccacttgatttcagccgagaactactcgatttcaaccacttgacttgaacgcctcaccaccattaccaagttcaccatctctactactcgacagtcgattcgtgattctgtccctgccaattctgcctcaccaacgaagtactcgaccgcctgatttcacccactttacatgacttcctcagctttactcgacctctgttctgttctacttgattcaaatcgtgaaagaagaactcgggaacggttcagtttactcgagtactaggttgtactcgaccaacttggtctattttgttgactgttgacctctgttctgtactcgactacctcagctttactcgacctctgttttgctcattgttttctcttagactaacttattaacttttgagctttgagttctaaatcttttcaggactatcatgagtaattacagtgacattttgtcaatggatcctgaatatcacatggatgaggctgagtcttaatcttcaagaccagaaagagaacatagagagtatgataatttcatgagaaaagctgagattgctcgagggaagagagcaatgacagagaggtatgagctgatagatgaggagctggaggtcgagtatatgcatgagcattctcacagagccacaaaacttctccacaagcctgatgtattgccagctgaggagtatatcaggctcttctagctgaatgagttctgcagcacaagatatcactgcttgactacgcgggtacagcttgaattactagaggatgttcagcacatgtaccagagttgtcacctggagactcatatggcttacccatatgtagcttatggggaagaaacgatttagttcctctccacactaaaagtggagctttaccaaggtatgacttcttatgatttggaaagtgaaggattgggattcttgcgattctctgtgtatggccaggattatatgctatcaatcacgcgcttggaaggactgtttggtttccccagtggaacggggactaagcccaaatttgatagagaagagttgaaagatttatggatcaccattggcagctctgtaccactgaattcttctagatccaagagcaatcagatacgcagtcctatcatcaggtacttctagcgttctgtagccaatgtcctctactcccgagagataacagggactgtcaccaatacttatatggagatgatcgttatggctctcaaaggcactctccgacaaaccaagaaaaagatgtctctccaaggtgaaaccaatgacacacctctctatacttcttcttatccacctgttaggatacaagagttgggctgttagcaataaccacaagagagcacgaggcgctatttgcatagggtgtgttgtgacaccgattctgatcgcttgtggagtcccaatcacatctgatggacttgagccacggacaatggatatcgagcatctacatcactgggaaatcctagagttcgcaatgattggcgacagacatcgtttcaggcttgagctctctacagataagaaatccaacatccttctccctagacctgaggttacatgcataatacagggagataacattgatttcaggcctgagcttgaaaacctctattatgagaacactcaaccaacagatgaggatgttcatacagaagaagttactaaggatgagatggatgaggacagagaagtggagtatgacacgagaatgtatcattttagtgagcatgtacctccagcgggggagaccaagagtttgagtgaagctcatagaaacaacagcaagttgcagaagtggtgcaaggaacaagataagttactcattaagtgcttcaagactatcaagtttctcaaggagaagctaagttgctcctcttctactacagctattccacagggacagccccctcaggacaagccatcgaggtgatttaagtctcacatgtccctgctagacattcatcattcgaatcctgggagcacaataggaggaagagggctatgctcgttcgctctagtagtagatcacgccttatccactcgaggagatcactcgatcgcggtggtggccgcagcagaaaaagaggtcgagtacactcagggcggtggtggccgccacataggcaatgaggtcgagtacccacacgctggagctgagacagaacaaggcgactcttcaatggcctgggagcaggcagagacagccattgccgaccaactcgattcattcttagacttaggtaagcgcctcacttcaccattgtactatatcatctcttgtttatattgtgttgctgtgacgtgttttatcctgaatactctcttccaaatttggtcacatagtggactgtgtgatttaagtttgggggagggctcaggaggtgtgtgttgcattgtatatactcttgagtgtgcattcatctaaggcatagaaaaaccaaaaaaaattgaaaaatatcagaaaatgatttcacaaaaacagagtgttcatatagttgcattgcatttaggatcgagtctagagtgtttcgtttaggattgttgcatatgcatagggcataactcagtgccctcgttattagttgtctgatgcgcagtcaatgaaattaaagtaaaattgtaccatgcctagattgctctactcgatcacactgtcatgatttgataccattccctatcaatttgaacctaaatctgattttcaattatcatgtctacgtcaatttgaactcatggataccctaaaatacttggattttcttattcattttaaccactcttgttaatctaagtagctgactctccttattagtgcagttaatccgaacccaaacctaaactttctttcaagccctatatcacttgttagtgtttgtgaggtcttattccgattaagcttggtagaaagtattaggtttgtagcgacatagatagtgtctcatgtagttctagttcgcgttatccgaattatatagaactaggtgggcgcttatactctgggttgggatgtgtctaaaagaaagaaaagggtggattcattggtaaggaaaggtaaaagactctagggtgaagtaagctaaagaagcagaaaaaatctagtaaaggttttgggatttgtaaagaaaagaaaaggattcttgttagctaatgaagaagggcaaaagccctcagttttaaaattttttaacaggaaccttagttgttaaagaaattcaaatccgctagatatatcaaagtgttgagaaagcttctcctagagttaagagaaaagaaaagaatgattagcaaaagggcttaaaagattcatgaatgcaaagggtagatttaagttcttaatttgggactaggatgggattaccattagagcttcattggttatactctgggtaaatgggatcttatctctgtatgcatagcttgagacttacctttagcattctactaaagcttaatcatttttgagagatcccctgttactgaagcctattctgtaagggaccatctttgtctcttgacctataccttagcctaatgagtttattgatgatgcattgcttgattcacgttccagaactaataaatgttaaaggcatgggtagatttgaaaacatgtgtaggtcgagcataatagtcggattgattaataacaaggcatggctaacgtttttttgagtagaattcaatcatatcgcagcttagaactaccaacttggacattgatttcatctgatttatctggtgtttggctttgagtccccgctttcaaacctcacctccagcttgttcttaattgtttgcttgagggcaaccaaagactaaatctgggggagttgataagtgtgcatttttcatgttttaagcatccatttgtcatcattttagcatcatatgaagattgttttataccatttctcatcatttatcatcactttgcatgtttaggatagttttgcatgcatgttgcatatttgtgttgtttaaggtgatttggagttgttggcgagctaattggaagaagtggacctggtcatattttttatattaaaaagtaatactttgatttcgagcttcttcctctgccgtcttcttcccccgatgagctttattctgctgcatttgttgccgttttttctcctccttcaaggtgcgtcaagctacgaagtccaggtacgtgcatcgagttagagagagtttcaaaagctttcaattaggaattacatattttgagattcagtccaattagatttggattattgtgttttagtacatacattagaagtttaaatatagtttcacggtcgatttgctctataaatgggtaaaatatgatttcacatgctgattcgtactgaattgaactcgaatccaatctttgttcttgtcgcaaatataatactggtagaactaggtatagttgtaccgaaacaaatggtttttatatagatagtatgttttaatagcattagtattacttacacatgtagtacttcatttatgtattagtattagtgacacatgtagtatttcagaattaggactagtattactgaaaatgtagtagaaccggtaatactagtaatattgactgagtataggtattgttttggcaggatacaatgagagagaacgtgatcatatattttaaactcgaaggttgtatgtatagttgtatgatgaagacattaggggagaagataactctctccatgttagaatatagaatattgacgaagcttggattagatgaaaataaggttaaattccatataaggtacactccatcgttgttcagagtagaggaagagatgaacattcatgatgatgaggatgtccttattaatataacatccgcaaaaaataaccggagaagtgttttggttgtggaggagatctctaaaccgctcgagcaattgccaaagcaattgtctagagttgagaaaagttatgttggtaagaactatgcggagttgaattcagcggaggatgaaatgagagtggataatgctgccctcatcgtctgcttagaagaggaacaatgaactacccaacaacttgaggaaatagtggaggaggatcactagactcaagaagatgaaacacgtgatgaaaccgttgatgagtctaggaataattatgatagggggaacaatatgttgagccgccgcctgctgtagaaccggtcagtttaaaagaatgagaagacgaaattggtttgaccttatctcaagtatttccaaacaatgcaacattgcacgaggtggtggatagagctgcatttgttaacaattttggttaggtgattaagaagtcggataaggagaagtatgccctaaagtgtgccaaagaaacatgtttttggcgtttacgagcgtcaaatatccgtaatacagatatcttatggattagaaggtacaataagatgcatagttgcactcggctaagtaaagttactagtaggatcagaaaaaggaaagacaacccacaattagttgtagctcttcttcatgatcattttctgggacatggaaactctagttccaagggttatcgtggagctggttcaaacaaaattaggtgtgaaagtatcatactcgacaacactaagggggaactataatgcaatttgtgatttaaaaggtagcccagaagaaagttacaaggatatcaatagttatttgtacatgttgaagaaggtaaatgatggtataataacttatctaaaattggatgagaatgataaattttagtacatattcatagctatgggagctagcattgaaggctatagagtaatgaggaaagttattattgtggatgcaaaacatttgaagaacggatatggtggtgtgatagtatttgcctcggctcaagaccctaatctttaccattacatcatagcgtttgaagtactcagcggtgagaatgatgctagttgggattggttttttgagaagctaaaaacggttgtacccgatacttctgaattggttttcatgagcgacataaatgcaagcctcataaagggcatacagaacgtgtataccgtagctcatcacgggtaatgtatttggcatttgtcccaaaatgtgaaagggcatgctactaacactaacaaagacgtactcgcatggaagttcatggagttaagtcagatttacaccgtggctaagttcaattgggagtatagattgtttaagttgagatatccttcggcgaccaagtatttcagggatacaaccgtgaaagaaaaataggcaatgtgttgtttccccagagaaagatacaacttagatacaagcaattgtgtggaatttttgaacaattccggatggtcgggtgtggcggtttctgttatgatgtgctatagacttgattgctttacttgattacgatatgtttattgtggcctagtgagacgggacgaccgctctcactatgcaatgcttgcttatgcctcctttgtgatgcaggaaaagagggtaatgtgcgtggctaaccagttcgcgggactagggcaaggaaaagaggatgatggattttctgttatgttttattttgggtaacttatgttgttggttagactggtaataaattgtggtgaatatcaacttgtctaagaacctcatttgcttaataaaacgaatcgatttaagttatttccgcttgtgcatgaatttgacttgtttaataatcagattatcgcttaaactatgtctatcgaattggtaaaaatgtttaacacggttagtccgtttggctggcggttaatcggccttaggcaaatcgggttagggcatttcaatttccctcaagaaatttcatgttttggccataacttctctctacatttccgtgtaattcaaccataatttcaccctatctcttcatacaaatagttttaaaacctattccgagcttttaatcagtttagaatttaaattctctcggttataaacttgattctcttccactttgatctacgttggcttgtgtttataactatcctacagaaactcatcgccagacacatggattctgaagaagcaaagagaaggtgattttacgcgagctatagcaagaggatttgcaatcatcaacgaaaggattccagtccgcaatgctaatgccatgaatgaacgttgtgcttgactataacgctgagaagaaaggccgagcacagcctcaccgttttatatgagtcgtcgttcggctagggagagagaggagatcgccagagcaaagaggatctttgaagctgcacaagaaagggaagaacatccagtcttagaggtggaagcatctgaagaagatgttgaggttattgaaaataactcgccagccccaacatgaagaaagaataggccaaggaggaggatagaacccaccttagaggagcactatcagtacttgatggaacttaagtttgaaggcaccagatacctccacaggccaacaatgcaagcacttggaatctgcagagatgtggagtatctgatggagaaggccaacctcgaaaccttctagacttacaagtttgaagggtacaagaaggagagttccaactccttacaaccatcaaggtccatttctcttctggtgaaagtgaaagagaaaaaggaaggttatgatgcataacctttatcgtggagaggaaccacttttccttaaccatcagaaaacttgaggttgtgtttggatttcctacgaaactcggaatcctccaaaactttgacaaggacgatgtagtgaccctcgttaaggggtaagcggtttagcggaaaacatcgaggaacgtgtgaggaagaactagaagagaaaggaactagttaaagggaagaaagccaaagagatgggcaaggcaaaaatgagtgtggtcaaatctagtttgaaatggggtcatccggggcaaacccaaaacgagagaaagttgtcccaaatacatggccgattgaccatatgtgcccaaaaggtgataacccatcaaagggcaaaagaaataactatttgggcaagaatgagcaagaataggaaagaaagggcaagaatggtcaacacgggtgtgccgcgggcaaagattgtcccgccaggtgttgaccgcgccatggactctcgggccagattacttggaggccaagcaaagtttcttagagccgaatttaggtggagtggagccgaatccaccacccttacatctgaagtttccccttccacgtgtccacatcccgttaaggtcgtatatatgtcatcacgggaggatgacacatgtacctgatgacgcgcccttgccagccctatataaacccattcaacctcgaaaatgttcgaagaggaaaaaagagggaaaccatgaggatgctgatatagctcaaattgccttaagcttactttattaaataagagatcgtcgttagcacttaagggtcgaattccactgagctctcgatgttcacacaatagacttatgatgatttcaattaagctagacaaattttacgaatgtaaaagatagtaaaaatgagttgtagattcaggagattaaagtgtcgggtctaaggaattatctcgggatatagataaattgcatatctagctaatattaggattgttatcgcaccgttctcaaactcaaactatgattttagaataaccggtggcgtttcgcaaaaatctgtatgcctagagctaagattatcagagaagccgagaaatcctattctaaagcatgcattattatcacgtttgattagttcacctagtatctaaaccagagcccttctatgagcctacctgttctttcttaaatacttaggctcatctatgatagttctgataacaagtacctatggcgggtatacctattatctaatattaagttctaggtgatcatctaaaactagaagaaagaacaatcaagaagaagaactctaagaataatcgtaaggggttttcgatctactaatccatctaaatcccgattgagactccctaaacccaacaaagtgattactcacacatgattaaagtaacacacatcaaagtatgaataaaaaatcaatactagcaagaagggagtaaggaatatcttttcgaacgggagtctccacatggttttgcacctaaagtacaaaagagataaggagattagcctctccaagcttaggtctaaacattgacctttaaaactagggaatattaggcaatgaagcactttttgagtttcaattaggcaatggagcacttagaagggagtaggcacttttttaagtttttttaccataaccccccagatttcagttaaccatagttactttcctcttatttacaaataaaatattatttttcttccttctcttctctttcttccttcttcctctctcccaaatgatgtgacatctctctcaaatctcaattacacttctcttctccttcttcctctctcccaacactgactccatttatggcccacgaaattggaatctcatacttcctctacttttgattctcttttctgggtttgtcgttttatgggttgattttgtatagtcaaaactgagaaaacaagaagacttcttttggttttcttattttgaagaagataagtctagggtttctaaattttctgggttttctggggttttgtgtgttctttgattggatttgattattgggtaatttccttggtggaagaggtggaagagggataatgatgatggtggtaataatggtgatggttttgatgaatcaaagaagacatggtggttgaatacactacaagaaaacaggagataaacgacttacaagtcagtcgtttcgtagtcgtaaatgatgataatgtgactaatccgcgactaaagacagtagtcaatattccatagtcgctaagtcatgtagtcgttaattagtcgtcgaccaacgacaatattacgagtacagcctaaacagtataaattcgtgattatgtagtcgtattaattgggcacctatttggcgaccattttacgattaatagtactatacagagcgtgtgaaacatggagtcgttaagtagtcgttaatgttttacgtcaaaattacgactactatgcgattaaatattctgaaccctgggtatgtttctagttgtcgtaaaatagtcgtaaaacgtgttacgataattcgatgactgttggacgattaattgtactgtaccagggatacgattcttttagtcatataatagtcgtataaatgtatacgactattatatgtctctttcacgattaggttatgactaatttggttagtctatgactaatttggttagtctgataatagtcggtaatttttgtgactattttacgactactgtacgactaagttgctacttatttactactattttgcgactactagtttggtccgaataagaatttggtcatctattgttgggtttcttgtttgttgtttaaagtcattgattgttctcgtttgttatctaaaatgctataaaatatgaaaagacatatacacatatattgaaaatcaagttcaaatacataaaattatcttgtttctaaacaaacaacttattcaaagaaagttaagttcaactagtgtttggaaacctaaaactatggatcattagatggtggagtacttgggatacgctctgtggctgtggaagagtgagtggccatgaagtccaagaactgcggatcagtttggcggagatacttctcgactaaggacaagtgctcgagcttttccttttgatcagctgtaactcgggctgaatcggcttctcgggcagcaatctcaacatctcgcttctcattatatgcagcctgctcttcaatttgctgctgagcttcctgcagccgttcttctaaggctttaaaggatgagtcttcggggagttgttggcggttggcactgcctagagtgtctttaagacatccaagtccataaggattgcctcttgaatccctttctgtggaatgcaagaaatagagaggaagataattagtgacagaacgcaacattggactctaagactctgaattagactgcaacatcttacctcgagaaagatggctgtatactcatctagtgtgagatcccgaggacgtgaagagccatcagacacagcagaagcagccgcctctcgttcagacaacttctctctcacattatgctcataagttagagcaatcttctccgccttccgatcaacataagtgccatccgaattagtgtgtgtttggatgaacacctcactaagagggacctcttcctgcaaacacagatcacaatcttcataagtcaacagactatagaacttcataacatcacacacagtaaaacgaacatcactaatagacatgagattttgcagaaacacttaccaattcatcttggatttcttggaaaaactttggcctggagtagtggatgtgaggaccgagactgttacggtcagatagacgagctttggaataggtctaactcattttctgtgcttcttctatgtcccattaagcatacattgttccccacagagtttctccaatccatggaggctactctcgacttctccttgcggtgctaaccatgtcctttaagcgcctcttaacaatctcattgaagtagtattggactgtccatgttattaagggatcacagtggtgagttttctacaaaaaaagtgagaagttagtgaacacttgaaagattaaatagtaaagtctaaagaaagttggcgatatacaagaagcttaccgcaaactctaaaaaaaatctttctcttttatccaatggcgaacaagaccaattatagtagggagcactgaacttttgagtaaaaatctgtgtgatctttctaaccaatttagatcctctgtcgcgagtaaacctccaaacacatgcaacaatgaaagaattaaacatgttaaaaatccaaaacactacaactagagcagactatataactgaacaagagtttatctacacagacaaagaacacgagtaacaagagaacatgattcacaacagaacctattagttcatgtcaccaaatgctaagttaaacaatcaacaaatgttccacaatagttcatgattcacaacagaacaccatatagaacataacaagagcacacacagtatagatattaacaagattctacacaagtacaagaaatgcagatcctaaatgtctaaaccgaaaacatgctaagttgaacaatcaacaaatgttccagaatagttcatgattcacaacagaacacaatatagaacataacaagagcacagacagtatagaacttaacaagattctacacgagtatagaacaaaggcagatcctaaatgtctaagctgaaaatttgctaagtgcaacagtcaattatgagagcatgattctacacaattatagaactgaacaaggtcattctgaaaacatgcaaagacatctaagtctactatgttccgacaacccataacaaacattcaattccaaaaaccatcattcacaactatgttccacaacaagccattctttataacagaacacgagttatacattacacaggctaagaacacgagaagaaattagaggaagagaacataccactcgttttttggtgtgggaatcggagacaagacacaacaccattgttccctgtttggcactgagagtatcacttgcagagccaccgccgagtcttcttgtagctccagcaacgtcccaagaacttcctcttagaagttgttcccttgagacaaagggtggctgttagctggagtgtctggatttggcgactgaggagaaccttgctgagcaggctctgttggcagtggattgtagtggacctcttcagatagaggcggtggatagttgtatacgtgcggggggggggggggggggcagacgttgaagggccttgttgttgagccggctccatcgcaggaacttgaaccgttggcgccggagtgaagttgtattgctgaggaagattagcaggtcttgcggtcgtggattcgccatttctctgagtgacgttcggcgtcgtcttacgctttcgggagaaaccttgaccggtgttaggcatgatagatcgacggagggattgaagagatcaaagagatgaagaagagatccaaagatcgagtgagagaagattgaagagaagaagaagaagaagaagaagcagatcgaagagaagaagaagatgaagttgcagatcgaagaaaaagaagatgagagatcgaagaagatcgatcgatcttagtagaagaagaagattgagtagcagatcgaagaagaagaagaagagcgatcgaagaagatcgatcgatcttagaagaagaagaagaagagcgatcgaagaagatcgatcgatcttagaagaagaagaagaagaaggagaagaagatcgagataaaatggggattagggtttgagagaagaagaagaagaagatagatcgaaaatgactaagtgtttggatcgaagagaaatgactcgatttagggttttcaacactaaagtagtcgcaaactagtcgcataatagtcgcctaatcatttgggtttgggcctcaaaatttaaaagcccaataaaacaaaccgtagtcgctaagtagtcgcatttttgtcacatttaataatggatttgggcttcgaaatataaaagcccaacaaatcaaattgatgtcggtaagtagtcacatttttgtcacctataataatgggtttgggatttgaaatttaaaagcccaacaaatcaaatcggcgtcggtaagtagtcgcatttttgtcacctttcttaatgggtttgggcttcaaaatttaaaagcccaacaaatcatattcgtgtcgctaagtagtcgcatttttgtcacctatattaatgggtttgggcttcgaaatataaaagctcaacaaatcaaattggtgtcaataagtagtcgcatttttgtcaacaaatcttacttttgtcgcgcattagtcgcataagagtcaccttttacctttgaaattaaaataattctacatatgaaataaatatgcatatatcataaaatcattcaaatatttattcaaataattatacatatattcacacatttatacatcttcatcttctacttcatcttcgtccgaggacgataaattacatcggaattcgtcttctggttcagcatccccgacatcgtaatcaaggattattgggtttaagccgcctaccggattttctagtacaagatcttcaattgtagtgagcaaaacatcatcatcattttctgtttgcaaaagagttggatcattgttttcatattctccagaaatgtttcccctcggatagacttttaaaacattgagccaaatgttctttggtttcttcgtatatggataaggaatataacaaacttgatctgcttgagatgctatatacatatatcaaacaagattattaataattaacaaagaaccgtattttggacttcaaaattacataccaagaataaatggctcgtatttattgtattttctcgtagatagaacgtctacaacgccaccatggcttcgtcgagtgcctctcccgatatttgggtcataccacttacatttaaaaagtgtgatcctcaaattgacgatgccctcatactcgagttctatgatatcagttaaggtaccgtagaaatccgcttcatcagatgaatcagcataattttcacctttaacacatatcccatagttacatgtcttttgtccagcgccgtgattttgcgtatgaaacaaatatcctcttgtgaaatacattggccaagttttaaccttgttcaaaggtccttgcacaatctcttgaacccaagtaagaaatgaagaagtagtgttctaatatgttacctacataatagataaacaatatcaattagtataaattaaatgatcacttttcgaaagaaccaaaattgatgtagacttacatattctttaacccatagatgatattattcaggtcttctcgcgtagagttctttttcgggcaagcatggatatttcgcagaaagataatcctcgaacatactatatttacaaacgaagaaaaataagtcaaagtgatcttagtgcaaatttacaaacaacaagtgattaaaaatacctctcaaatggtttaaaatagtcacaatttcttaaaacatatgcattgcgcgttggtagtctttctctgaaagccattttacatgcatttcaccacttggacgaccgacgtgcataaatatattagatactccagggacatgatatacaggaacttcaccttcattgaatattgttaacctgatccatgtaagtgaattaatatcgaagtataacaaatcgttaaataattaaatatatttaccttgattttgtttttatatgatcggcaaagtagtgatctgaaaaataagcaatctcgtcattgatatatgactcaacaattgagcctgtagcatatcttttatttttttgcttttcctttcaactttttgaagaaccttttaaatgggtacatccacctatatgggacagggccacccaattcagcttcgtatgggagatggataggtaagtgttccataatatcaaaaaatgatggtggaaagatcttttccaagttacagatgattaaaactatgttctgtttgagaatttgaacgcgacttgtctgtaaagttctcaaacatagatcccggaaaaatgctccaattcataaaatatatgtgcaagttaaataattagattaaaaaatgttggaataataaatagtaagtattgtacctgatagtgcaaggtggacattccggtcttggagttcagcaaagataaatggaagtagtcgctccataaatacatgacaatcatgactcttcatgcctgaaaacttttcattctccatatctacacaactagccaaatctgaagaataaccatctggaaatctaatatcatgtttcacacattgtaataaactttgtttggcttcttctgtcaatgtatacgctggaaatggagctttacccttactataaatatgtaagcctagccgtaaacaaaaattttcaatatccaatcttgacatgatattgtcttttgatttacccttaaaactcatgagagtgttcatgatgttgtcaagaaatttcttctctgtatgcatcacatcaatattatgtcgaagattgaggtccttccagtaagacaactcctacaagatgctttccttgtgacaattatgttccttcccatagcctcgcatcttcttttcatgaccgttcccaccaacatccttcgtttttggtggatttacactagccaaccgctcataataaacttgctcccctgtcaaagactcaggtggatactcgctagaagcatctattccttttagaaagtcttttctgttcctacgggatggatgaccatgaggaagaaatctacggtgacaatcaaaccagcatgtcttccgtccattgggtagataaaaagactttgtactttccatgcacactggacaagacaatttaccatgagtagtccatcctgataacatgctatacgccggaaagtcgctaatcgtccacagtagtactgcttttagattaaaattctgactcaatgaaacatcgtacacatcgactccagtagaccacaactattttaactcctcaataagaggttagaggaagacatcaagactagctcgaggatgatttggaccagaattcagaatggtaagaaataagtactctgtattcatgcacataccagagggtaaattaaatggagttaggatcaaaggccacaacgaatgattacgagacatgccaaacggattgaacccatcagtacacaacccgagataaactttacggggttcttcggcaaactggggatgtaactcttggaaatatctctactctgttgcatctgaaggatgattcatttctccctcctttgattggtgctcagcatgccatcgcattgacgcagctgtcttatggctctgatacattctcttcaaccggtccccaataggtagataccacatacaactatatggtactttggttcttcgatggtcgtctttaggcttccatctttgtgccccacaaaattgacattgatcttctttttcatcttctttccaaaaaagcatacaattgttctgacaaacatcaatcgtatgatatggaagtcctaaattgcgcatcgacttatcggtctggtaatgtgaagtggtagcctggtttccttttggtaaaaaatctgtaaacatttcgcaaacggagtccaccaacttttcactcatattatactccgccttgttgtgcatgggtcgagatgctaaggataactgtgattgcccttcacgacaaccatcgtacaaaggattatttgcaccttctaacaagtcgtagaacttatttgaatggttacggaccggttcttccacattctgataactatcatcatgatgatagttatcatcataccccacgttaaaattaaatgcatcgttcaccatatccacatatggatcttctacaacattacccacttcttcatgattttcactaaaatatgtcctatacgtgtaactcgttcctatatccatattcatttcttctccatgcttataccaaacataataatcaggcttaaatccttgactaaacaaatgagtactaactcttctactcgagatgatgtgtttttcattcttgcatacactacaaggacaatgaaattttcctcgactactctatactattggctgactattagcgaatgtcatgaattgctcaacccatgcgacatattcgctgataaattccccgtcacttcatcaaatctcttgtacatccaatcttgatagaaaccgccactaccgccataattgtagtttcccaccattatacaataaactaactaaattttttttttataataaatcgtttttttctttgatgttgttgttgttttgatttgttggtgaaagaagagtttcgtgaatatttattatataggcgaatatttatgaataatttacgactacaactaattaattaggtgtacctacttgccaatgtgaaacacgttttccaactactttttgcgacgcctatgcgactcttatacgactacaggttgattaagaattgtagtcgtcaattagtcgctaaattagcgactaaattatttagtcggtaagatagtcgtcaattagcaactacgtaacaactaacatctcccttcaataatagaatcgtcaaatagtcgttaatggacaactatgttccgacaaattgagttagtcgtaaaataacgactatgttactactaattttcgtgttgtcgcattgtagtcgtcaaaccgttgccaaatggtcgcttgataatacgactatgttgattgtcgctcttcgtaattgtcttttacctgttttcttgtagtgataggttaatgggtcggaggaagaagatgatagcagaatgataggcggctagggtttcaaggaaagcatgatatgtatacaaattacttttttgcccttctcatttgtatgccaaccatgttgtcagagtttggtgaatgtgcatggatgatcgataattcgaaatgattgaaatgaccacacacaaaatggattcaaacatcaatcactccaagtctccaaatattacatgatatcattagcacacactacaagaaaactgggttttggcgactacaccaaaagtcgttaaatagtcgttaagtggtcatttacgactaaatagcgactaaatcatgtagtcgtaaatcgagagtcgctaaaatgtatagtcgtaaaaatagtcgccaattagcgactactttacgactaatatttgtagtcgtaagtatagtcgtaacgtagtcgtcaaatttagtgactaattaatgactaatttacgattaaatttcacaaatataaatagatgtagtgtagtgatagaatagtcgttaatttaagtgactaactgaagactatgttgcggctacagtcgtaattatgtattcatacaatatttatgtatttatgcagtatttatattaataataatatttatatttgttaataattgttttaaatatatttttggaaagtactgaaactacatttagttattgtgaaacgatatttaaaaaagaactgtattacaaaataaaattaaaaagataattaaaaaatatcttaacagagcttgtcttaacagaacataatacatcatcatcctaaaaacataacatcttaatagaacacaccaacaatcttcaagaaagaacttggcttaattaactcttccttgtctttcatttcttttaatgcttttgtttctctaaacgctgcctcctagttattggtttcgtggatatcctctacctgagaaggcaatgatataacatcttaaaagaacacacgccaacagtgtctaattatccaactctagtctgcttactcaaacacgctgtttccacatttgcaagttaaaaaaagaattttgataataaaaaaaagcaggttttaacttacctaagttgatttgcaggtttcaacatgccaccggacctccgccaagccaagggttcagaaacacccaatgtgaatcatgtttcctatttactctatttcatcaaagtcaaaaaagcaggtttttaagctcttcaataaaggaatggtgactatacttgatcaattattaaccaaccttgcaggagaaacaatatctcatatcgcctggatattgaccttgcgcttgaagaagacagccacataaaggaacgaaaacacttgccatccgtccctaaaagattgaggcggaaaattgacatcataagccatctttgatgctttgaccacaacgttggacacattgaatgcatacttttctgaaaatagattaccatatgagtagtacccgacttttgatacaataagcaaaaaaccgaaatgctaagtgttgaagcgttgaacatacctttctatcgtttccataccagagaaagtgttgctttgataaatgaacagaggcgttctcgtcgtgtcggaacgttacatgtaaccttctgaagaattccttaaccatcatattcaatccagcgccaaaatcaacaccagcttgatcaatattttagtcacttagaaaaaaaacagttaaaattcagagaacttacccaatcaaacaacactttccagcaagattgcaactccacaggataaatcgagcatcaaccacagagaacaccggtatccgtcctcaagaggtcatatctaggaacgagaatcaagtgagataaactcttaccgacccaaggggatcaacaaattggagtgccatcttccttaatcacgaaccaatctgataacccttgaagattatcgagagtttggaaagagaagagaaaagaggaaaggggagagaagagatgattagatctgaaattgaatctgtcgataatgaaccctagaattcggcagtattaaattttagttttagagtatattactatacataacattatagtagttagccattaaaaattcgtacattatagtagctaccaattaggcacatacaacataggaatgcaatagatttgtaactataattagctactaatgttttggttttgaattgtgtttgtatgaacgaggactagaatggggtgaactttttgattatatagacatttatgctgactaaatggcgactacaatgttaacaaatagtgactacggtttgtaatcgcataatagtcgcctaattagcgactattttgcgactaatttttccagtatgcaatttagtcataaagtagtcgctaatttacgactattttaccgactagtgtttttggtcgcacaaaagtgactgatttacgacttaatatttttagtcgcccaacagtcgtttaatagtgactaattagtcgtcaattttggcgactaagtatttggtggatgtgtgtgattttgtgcagtttccatctcttaaaacaatgagcaaatgattaaaaaatggaaaaaatacaaaaaaatcatatccaaaaaaatgcaaagtgataggccgctaggttttcacgaaaaggatgatctgtaagcaaattactattttgtccttctcatttgtatgcaaattactattatgcaaactatgtggtcaaagtttggtgaatttgcatggatggtcgataattcgaaatgattaaaaattaccacatggttagagtttagtggatgtgtgtggacggtcgataatttgaaatgattgcgttttaataatattattcataaaacaagtgttacgttatgtaaaagatgttgataaaatatgatgaaataagttctataattatttttgggtttatggtcatatgggtttagggtttagggtatatgtatatggtttagggttaatgtctatcggtttaagtttaggggtttagggtttagggtttagactttagggttaagggatttatgcttaacatttaagggcaacaataagaaggtttaaagtttagggcttggagtttagggtttatggtatatggtgtaggatatatgtacagtaaaacctctataaattaataatattgggactgcaaaattttattaatttatcgataaattaatatttatcaatttatagagagattttcctaatttggtaacttttaaaatttttttataagatttccttcattatagaaaatatctttctagaaccagttacaagtaaaacataataatattgtctagataacaacaccaaaagttttgatacagttaaatataaaaactataatcaaacaaagaacaaatatgaatttaagcaacaaaatattataaatatattataaagaattttcttacatctaatatatatatatatagttgatacatttatataattattaatttatgatattaatgggaccatagatttacataggactttcaaaaaaattattatcttattaatttatcgatttatgtcattttttacactgatcccaactcgggaccggaagaatttattaatttataaaggttattaatttatagagtattaatttatagaggttatactgtatatggttaatggtttagcgtctatgtgttaaagtttagggtttagggtttgaatttaggaattaagatttaatgttttagagtttagtatctaatgtttagggtttaatgtttagagtttagtatctaatgtttagggtttaggatttagtgttaaggaactatgattgtttacaatgattttagagtttatagttacatggttctcattaaagattatatatttcattgttatccatatggattagatcatatggatttgttgttttctgaatctgtttatatttaggtgaatacaattaataataatatgaaaaaatatagtaatatggatttcaaaatgaaggaactaatgttattattatatattttaaaaaaaaatggttaaagatttttaataaaatagagaatgtgacaaattaaagagaaattaaataacaaaaaggaagagagagaaaaaaatcattagatatattttattaattttaatttgatggtcaagattaaaagagacattaactttacattttaatccgacggacgagatcatttcgtgaaaacattaactcttctcttaataataaccgttagatcgattctctctccaaaataaacgaacggctgagattaaaaacatgttagcggagcagctgacgtcatcaggggtagaattgtattgatttttattaaacagtagaaaatctccaaaaaagtgtctactcccttcaaagtgctctaaatgtgcttaaaaacttggaaagttccccaacatagaagaaacccttaaaactatatgtctgacctaaaaacgtgatgggccttcattagaaataagggaaagttctgggccgaatttggaaatcttcaaacatcaataagttgcgtcttcgaattgccgtcaagtaattgtgtcgctcgacaccagggatggtgttgtttgacacctacgctgtttttagtcgtcggattttctttagcagcataagttctctgttttcctctagaatgctccattatctccaaatgaatcccaaacatgtaaagacctgaaaagactagaaaagactctagaaataacaaatagactctaaaacatggttaaaatagggatatatcaactcccccagacttagcttttgcttgccctcaagcaaaatacaaaagccgaacccgtggaagaggtttgaaaacaaaagaactcccaacattctctagcctattgccttgatcattctaaccaaacccatatgcatggcaagtctaatcaaatcctaaccaacatgtacttctctacaagcttacacaacattctagattccatacctaagttccacaactatatccaccaaggtttcatcgctgggtctcatcaaacaagctaacaatcaagatccctctaaactcattcatgtactatacctcgataaatcgaccattcttttcttctttggtattttttctctcccccagacttattctttttagagagtaaacaaaggggaactcgcatactggatccacaccctcggcatttttttccaacctttgtaattgatcattcctaataatgtataaattatgggctaacccaccccatttatacccaccccatttataatccaccccatttattctaaacatatttaactctatttaaatttatacctgataatttgtttatagtcaattatcctaaaacaccaatcatgtagttgtaatattttaggtgtcaatccaaatgggtgtgatgcaaactgatgagatgtgatcagaagtcactaagtcaagccaagcaataacagttttggggtttctaacaatcctaagcgaacatgcagaaaacagaaacaataacagaattactaaattcactcgaccacaacaggctaatgcgagaagtgggatgtggtcgtgtaacaggtcgagtaacaaacaggatatgaaacagctatactcgactgcacattctgttgccagacactagatgtggtcgagtatgctggtcgagtaacagacaggaaacgagacaactgtactcgactgcacagtctgttgccagacactgggtgtggtcgagtaagttggtcgagtaagtgcaaaaactaagaaacagacaatgagaacgattaagtgataacgttaaaacagagaaatcagatggacgagaaattcctaaggatggggtaatcgaatagagtggtatcctagcctattcgaatggttaacaagcgcaatcaagctatctctagacaacaggttcaacaacagatcaattcactcccgtgatagaaatcctcaagcaaagctagcccagactaattcccattaacggaatctaactatgcaggcaataagaacagactgataaagtcaataaacgctctaaacggccaatcccttgggatagagacgaatatctcatgaactagtggatcaagcattccatcgaacaccttatgggtgcgggaatgcttgggatcgaattccagttgatcagatagaaataagcagtaaacacaacttgtcctgaagggattcaatcaattctaaaacttaaccattgtacagactacggattctacaactactctatcccatccttaagaattctaagtcactactcagacaacatgcttaaagacataaacgcacgtaaatgataatattgaataagtaaagagataaagagtagagaaacaagatgatagatgaaatcaaatgcggaatctgaataacttggaaaaatcttgaattacaggttgcagaagcggcgcagctagagtaaaatagaaaataaaactgaagcaaaaactcaatgtcgactagatgtctcaggacagaaccctaagacatttatttatacaaaacgaaataaaatgatagtagacgggccaataacctaatcgccaggcccatagaatgataatgggccgagatgggcttcgtgatccgatggaggtccaggccgcttccaaacacttcgtcttctcctcttctcttccttgtgctcaactaatctggttaagtgcagatttgagtagactatgaagatgtgatcgagtgcccggtcgagtgatggtgttggtggtgagtgatgatactcgaccagggggtcgagtaacgtggtagagtgaacggccgagtgtggtcaggtggtgtggcgaagtgatattcgaccagcgggtcgagtggcgtcatcgagtggcctgagctgaggttactcgacctgggggtccagtagatgggaagaatggctccaaagtcactcgaccagggggtcgagtatgatgctggatgcacacgacctagtggtcaagtatgtcttctggttctggctcgtttctttcaatttgctcgcaaacagctccaaatcacttgaaaacaactcagaaatgcaatatgtatgcaaagctatcctaatcatgcaaagtatgcaagaatgatgagaaatgatataaaacagtgatgaatgatacgaaactggactcaaaacgatgatgaatggacactgaaaacatgcaaattacagacatatcaactcccctaaacttagtctttgcttgccgtcaagcaaataagaagacatagttgaaggagaggtttgaaggtggggactcagaaccaaagcatctgatagagcaaataaaatcaatgtccaagttggtagttctaagatgcgatatgattgaattttactcaaaaacgttagccatgccttgttatcaatcaatccgtctcttatactcgacctacacatgctttcaaatctaccaatccctttaacattcattagttctggaacgtgaatcaagcaatgcatcatcaatgaactcatttggctaaggtgaaggtcaagagacaaagatggtccttacagaataagcttaggtaacagggatctctcaagaatgattgagctttagtagaatactaaaggtaagtcccaagttatgcatacattgataagatcccatctacccagagtataacaatgaagctctaatggtaatcccaactccaatcccaatacaagaacttaactctaccctttgcactcgtgaatcttccaaactctttttcatatcattcttttcttttctcttaactctaggagaagctttcccaacactctgatacatctagcggatctggatttctttaacaactaaggttcctgtttttaatctttaaaaccaaaggcttttaacccttcttctttagctaacaagaacctcattcttttctttaacattcccaaaacctttactagatttttttttctaacttctttagcttacttcccctagaattttttccctttccttatcaacaatgaattcacccttttcttttaaacacataccaacccatgatataagcgcccacctagtcctatccagtccgaaaaatgcgaactagaactacatgaaacactatctttgtcgttacgaacctaacactttctaccaagctcaatcgaaataagacctcacaaacactcacaagtgacatagggcttgaaagaaagtttaggtttgggttcgggttaactgctctaataaggagagtcacctacttggattaacaagagtggttaaaatgagtaagaaaatccaagtattttagggtatccatgagttcaaattcgatgccaagacatgataattctaaatcagattcaagttcaaattgatagggaatggtatcatatcctaacagtgtggtcgagtagagcaatctaggcatggtgcagttttacttcaatttcattgactacgcatcagacaactaacaacgagggcactaagcttatctggtgaaccaaaatgcttacaaggctatctcatcattatcccctatgcatatacaacaatcctaaacgaaacactctagactcgatcctaaatgcaatgcaactacatgaacactatttttgtgaaatcattttttgaaaattttcaattttttttgttttttcaatgccttagatgaatgcagactcaaaattatatacaatgcaacacacacttcctgagccctcccccaaacttaaatcacacagtccactgtgtgaccaaatttggaagagagtactcaggacaaaacacatcacagaaacaaaataaaaacaggagatggtatattacaatggtggagtgagttgcttacctcagtggaagaaggagcggagttggtcgtcaatggctgcctgtgattgctcccaggacatagacgagccgccatgttctgtgtcagctccagcatgtgggtactcaacctcttctccttcgtggctgccagcactgcggtcgagtgaattttggatatagagaagttgtgactggcatcaactatattcgatcgcagcttcattcgctccccgtagggtgtggtcgagtatactgctctcttcttctactgcggtcagcaccgctttgtgtatactcgatctcactcttctactgcggccaccaccgcggtcgagtgatctcctggcgtggagaagccaaaacaaggtcgagtgtctttgattgctcaatggtcgtgagtagttgttccctcagacccagaatctacttcattcagctcttcatacttatctcctgaaaacactactagaatgcattaaaaacaacaaggaaaaataatgatatttacgaagatagacatgggacttcctgccaagtgagcttgttttaagtctctagcttgactcctcacactcattaggcttatggagggtgatagagaagaattgaaatcttctcttcttccttagcagatacaacatcggacttagcatgctctcttgacaggtctgtaattgagtactcaatggccctttccttataagcttcttttatttcttgtgaatagtcttcgtcttcagaccattctaaaacaaatttcttctttgatatagcttcaatgccgagttgaggttgaatagcttccctttgcatccgactcactttatccctaaatttctcaacactgcaagctagcttctggatggtttcttcgtggagatcagacttccctttaagttctagccaatcaactacacagagcgtactagattgagtggttgagcttgaaggtcgtgttggagctaaacttggttcctttactcttttagtctcaaatccatcttctgtaaccactccttggacccaaaggttcgtccctctatggttgatcttcttggagctttgttgatgtcaaacagtaaccttatatccttcccaagattgagatcaatctttccatctttgacgtctatcaccgctccaactgaggccaagaaaggtcttcctaggatcagaggatccttaggttcttcatccatctcaagcaccacaaagtctgtaggcacgtctactccattaatcttgataggcatatcttctggtagcccatagggttttcttatggtcctatcagcaaggatcaaagataagtcgcacgatttatatttgacaaatcccagcttccttgccacagaaagtggcattaggctgactgaagctcctagatcacatagagagttgctaaaagccagttgcctaatagagcatggtagagtaaaagatcccggatcttccaacttttcttgaacaatgttcttcttgatgattgcactacactcgtgagttaacgccaccgttccttgaacttctttgatcctctctgtaatcatgtcttttatacgtttgtgtgagtgcggtattagcgcaagacagtctactagaggcattgtgatttcaaggtctttcaattgtttttccaagagagcttcatatttgtttatcagttgcttcttgaatctccctggaaatggtagtggaggcttgtagggtggaggaacaaagactttatccttggttttagcagcggcaggctttttaacaaaagaaaatactgcttgagcttgggatcgagtactgcgatcgagtatgggctcctctatttctatttcagctgaaatttcattctgaacaaaatcctctccttcttaaacttcactgtccctagtgatagaggtagaggcatgtcgagttggcaactctcgatcatggcagatactgatggcgtgagcagtggcatactccttagggttctggattgctttccctggaagctggcctgggttgttgttaacagatggtgtagtgaggatgctttccacatatctcatcctagtgctcaatgattcgaacttgctgttaagtttgatgccttatcggtcaactttgttgtttaattcagccagcttcttagcgatttccattcctcctgtggcttgtccttgaatgagctgctggagcatagtcattatatatgaattctgagacgcatgtgcttgttgttgatttggtgtgaaaccaggtggtggctgttgttgttgatatcctccttgaaactgctgctttaaaacgaacccttggctttggttgtaaggaacaaatggtttgggttggttatgctgctgttgagggtagacttggtccttagggttggcaatattggtgcttctgtatgacagaggtgggttgggtctgtaattgttgtaccccttgttgtagccacattgattctgaacatagctatcagcacactgatctttcaccctctcttgtacttggaatggttcatcttttgccaagaaggcctttttacagtcatcccaggtcgtgattgatacctggggtagcatcttttcccacagatgggctttttctccaagtgagaatggaaacaagcgaagcttaaaaccatcttcactaactccattgattttagtaaggctacagagcctttcaaactcgtctagatgatctagcggatcctccattggcaagccatgaaacttgtttccctgcaccattgcaatgagactgctttttacctcaaagttgtggttctgtactagaggtggaacaatgccatgacgatggttgtggttgtgagggaagtcactggcaccaatgttgttaggttgctcttgctcatctactatgtcattcattgtgtctgttgctgtctgttctctcagttggcgagcaatacggtcgatgttatcgttgaataggaagttctgattcccttttgaccgtgtatgcatgcaacatgtagaacctggctataagagacgaataaagttggttgctaagtacctgaaatacaaagtctgaaaagacacaatgttagtatcttttataacaaaaacgaacttgatcttaacaattctaaaatctcaaatatagcaaacaagcacccaattggcaatggcgccaaattgataatttgtttttagtcaattatcctaaaacaccaatcatgtcgttgtagtattttaggtgtcaatccaaatgggtgtcatgcaagcagatgagatgtgatcagaagtcactaagtcaagccaagcaataacagttttggggtttctaacaatcctaagcgaacatgcagaaaacagaaacaataacagaattactaaattgattaagtgataacgttaaaacagagaaatcagatggatgagaaattcctaaggatggggtaatcgaatagagtggtatcctagcctattcgaatggttaacaagcgcaatcaagctatccctagacaaaggttcaacaacagatcaattcactcccgtgatagaaatcctcaagcccagactaattcccattaacggaatctaactatgcaggcaataagaacagactgataaagtcaataaacgctctaaacggccaatcccttgggatagagacgaatatctcaggaactagtagatcaagcattccatcgaacaccttctgggtgcgggaatgcttgggatcgaattccagttgatcagaaagaaataagcagtaaacacaactagtcctaaagggattcaatcaattctaaaacttaaccattctagagactacggattccataactactctatcccatccttaagaattctaagtcactactcagacaacatgctcaaagacataaacgcaggtaaatgataatattgcataagtaaagagataaagagtagagaaacaagatgatagatgaaatcgaatgcagaatctgaataacttggaaaaatctcgaattataggttacagaagcaaaagcggcgtagctagagtaaaaccaaaaataaaactgaagcaaaaactcaatgtcgactagatgtctcaggacagaaccctaagacatctatttatacaaaacgaagtaaaatgatagtagacatgccaataactaatcgcccggcccatagaatgataatgggccgaggtgggcttcatgatccgatggaggtccaggccgtttccaaacactttgtcttctcctcttctcttccttgtgctcagcttgtctggttgagtgcgaatttgagtagactatgatgatgtgatcgagggcccggtcgagtgatggtgttggtggtgagtgatgatactcgacgagggggtcgagtaacgtggtagagtgaacggccgagtgtggtcaggtggtaagtcgaagtgatattcgacctgggggtcgagtggcgtcatcgagtggcctgagctgaggttactcgacctgggggtcgagtagatgggaagaatggctccaaagtcactcgactagggggtcgagtatggtgctggatgcacacgacctggtggtcgagtttgtcttctggttctggctcgtttcttccaatttgctcgcaaacagctccaaatcacttgaaaacaactcagaaatgcaatatgtatgcaaagctatcctaatcatgcaaagtctgcaagaatgatgagaaatgatataaaacagtgatgaatgatacgaaactggactcaaaacgatgatgaataccccattatgagtgaatatattttttttttgcaaaaacacaattttggccagaaaatacgggtttcggattttggagagaaaacacttttggcggaaaacatgattttcaatttcggcgaaaaacatgattttcaattttgacggaaaacacttctttgtgattttggcgggaaaatgtcattttatgggaaaatgttttcttggtaataaaatgcaatttcacgattttggatgaaaacatgattttgcaattttagcagaaaatgtcactttacagttttggcgggaaacatgattttcaattttggcggaaaatacttttttgtgattttggcggaaaaaagtgattttatgatttttataggaaaatatcgtttacagtgtttgtgggaatacgtgattttacggtttggcggaaaacactttgtgatttttgtgatttttgtgggagaacgtgattttacggttttggcgggagtacgtgattttacggatttggcgagaaaaacgtgattttacgattttggcgggagaacgtcggtttactattttggtgggaaaacgtgattttcaattttggctgaaaacgtgattttacggttttggcgggaaaatgtgattttacggtttggacgggaaaaacgtgattttacgattttggcgaaaaaacatccgtttacgattttggtgggaaaacgttattttcaattttggctgaaaaggttattttggtgaaaaaacatgattttacgttttgttttcaatatatataatattttgctctttattttatttaaaattaagttatttacattttaataaaattaattaatataaataaacataaatgggcttgaatgggaacccatttgtttgtaggtaaaccccattaaatatttttctctaaatgggtttaaatgggttaatttttttttgcatgtacccatttaataaatgggtattccatgcccaagttaacatcactatgtataataatgaggttataggaaacatttatacccctatacactatatgaaaatcctatcaatctctcattttcttatttttttattatagggagacgaacactttctttttatcacattggtctcaatatcatgtatgaacaaggagtcaatatctatgaatactaaccgtttaaagaggtaaaaggaagagtagtgagattagctcaagccttagtggttgtgttggaaaccacaatatcctcaagtttgttggtttcctatctggattttccaatagtcggattgaatcgaacctacaacattaatcaaccagacaataatctaaagaatagagatcataattcctaacaaaattttgactcaataaaacgactcaaaataaataaaataagaataagactgaaaaagaaaaacgtagttagtaactgcttcccccagacttaaacgtcacggtccccagtagcattcaaatctagagtaagcgagaaaaataaaagaaaaaacgtaaaataaaaaaaataagaagaaaaccataacagtgagttgcctcacactaagcgcttatttagagtcaatagcttgactttcttggagtttgcggatcaggtggatcagatggaggaaataaatacttcctagtagaacctcgaatcatccaacgtggcgtataagcagtcagtgtttgcggtctaccaaggaagtgagcaatgtcagaagggcaaaacaaaggtatgggttgtcgactccttttaccttcacaatcatcaaaagaaaaaacaagccctcgacgagaaactcgtggcttggtgaaccgtaaaacagtttctagatatttcaaagtcttattgatgatatctggaggtttaggaggaggagatgagtaccattgccgtttcagaggtggatcaaggagtaatggtgttgtgggtgacgtgactatagtgcttggagtttcagcagggaactcaacccgaaaaccagctctaacaacgaaatctggctcggcctgtatggggtatctatcgacacatgtggtggtgtcgatcaacaccattactgcagatcgattctcagcaattagatcgtgacttgctttctatagttgcgagcttgtaccatgaaccagatctatctcaacgcagtgtctatgaaatgctctgatacagagaggtgcatgaccatctatggtgggtgcttcttcagcctgtccatgtcaagagtcataaccatatcacactcattcaaagcaattggactgtcggtagatatagggctatcgagtatacaacttcctggattaggcatcattgcattgattattgtagagataggcacttccagcttgtctttcatcttcaatggagcatcatacatcagaagtgcaatgatttcggcgttaagcaagctcgcgtccttaacactgatacctttctatatcatctccaagatataatcataaagtacatactccaggttcataaagtcaacataaggtaactctgatagaagcagtctacacagcgtgaaacatctataacatctagcttcaaggataagctgctcggccattacaaccattggaatctcaacataatatggcgtagtccttgtccattgttcacatacgctatcatctgatgctgacgcttaggtgccgagctctctcgatttctctccgtcaaacgctgaatcatagtctgttcctgaagagtgtccatcgacatcgaggtcgtgtcgatcgacattgagatttgatatcaatggttctacaaattagtgtggcaagtgatatgtttataatttgcatgttttctatatttatacatcatcgttttgagtctagtttcatatcattcatcattgttttaaataattcctcatcattcttgcatactttgcatgattaggatagctttgcatacatattgcatttttgagttgttttcaggtgatttggagttgttggcgagcaaataggaaaaaccatgtcggaaccagaagacatactcgacccccaggttgagtacatccagtaccatactcgacccattggtcgagtgaaattggagccattcttcccatctactagaccccgtggtcgagtaacagcagccccggccactcgatgacaccactcgaccacgtggtcgagtaacactacgtcacaccacctgaccaccactcggccattcactctaccacattactcgacccccaggtcgagtatcatcactcaccaccaatcgaccattcactctacaatgttactcgaccccctggtcgagtatatcagtcaacacccagcgccatcactcgaccaagcagttgatcacatcttcatagtctactcaaatccgcactcaaccagacaagctgtgctcaaggaagagaagaggggaagaagaagtgtttggaagcggtctggagcttcatttgatcatgaagcccatcttggcccattatcactctatgggccagacgatagggttcccggtctatctactatcattttatttcgttttgtataaaataggtgtttgagggttttgtcctcggacatctaatcgacattgagtttttacttcagtttttatttctattttacctagtttactttggctgcgccgctttgcttctacaacctgtaatacgagatttttggtttttattcagattctgcatttgatttcgtctatcaccttgtttctctactctttatctctttacttatgcaatatacttatttacctatgattatgttttttagcatgttgtctaagtaatgacatttagttcttaaggatgggatagaatggttgtggaatctgtagtctatagaatagttaagttttagaattgattgaatcccttctagactagttgtgtttactgcttatttctgtctgatcaactggaattcgatcaacaacactatcgcacccagaaggtgttcgatggaatgcttgatccactagttcttgagatatgcgtctctatcccaagggattggccgtttagagcgtttattaacttcatcagtcggttcttattgcctgcatagtgagattccgttaatgggaattaagctaggctagctttgcttgaggatttctatcacgggagtgaattaatctgttgttgaacatgttgtctagggatagcttgattgtgcttgttaaccatccgaataggctaggataccactcattgcctgtttcatcgttgatcccttaatcgttctcattgcttgtttcttagtttttgcattcactagaccaacttactcgaccacacctagtgtctggcaacagtctgtgcagtcgagtatagttgtttcattttctgtctgttactcgaccacatcctgcttctagcatcagccagttgtggtcgagtgatttgtgttaaaaaccccaaaacctgttatttttggcttgacttagtgacttctgatcacatctcatctgtttgcatcacacccatttggattgacaccctaagtactacaacgacatgatagtgctataggattaattgactaaaaacctattatcaatttggcgacgttgccaattgggtgtttgtttgttatatttgagatcattagaattgttaagatcaagttcgtttttgtaacaagagatactaacattgtcttttcagtatttgtatttcaggtacttagcaacctgatttacagactcatctctaattcgtctgttatagttgggttgctacttgttgcatgcatacacggtcacaagggaatcataacctcctattcaacgataacatcgaccgtattgttcgacaactaagagaatagacaacaacagaaacaatggctgaccttgtagatgagcaaatacaacctaacaacattggtgctggtgactttccacacaatcacaaccagcgtcatggcattgttccacctctagtacaaaacaataactttgagatcaagagcagcctcattgcaatggttcaagggaacaagtttcatggcttgccaatggaggattcgcttgatcatctagacgagtttggaaggctctatagccttactaaaattaatggagtcagtgaagatggtttcaagcttcgcttgtttcccttctgatgcggacatcaaccttatttcacaaactgctgaactacaagttgtaccacatcttgtactacatcctgtaccagaagtcccggagggtatcatgacacgttcaaaagctaaacaactgaagaaaaggttcaacttagctgtgcaagatattttgagctccctagagctaggagtaaactggtccttagcaccccataccagatatgatctaatagccgaagaagagcttgctgaagcattcacccaaatgagtcttgaacgaactactcccccaggtatgaaatatcgtttgacaggttcaaggacctctagaaaccaagagaaaactttggagcttcaagagacggacgattcaagtgtcatctctgaaagtgatcgagagagtcaagatcaagaacaagatatcaaggacatggaaaagctcaaagacattgatcaaaatactcaagaggaactccacaaagacccctacttcaaggaacaagccaacaaacaagcacaagacttgattccagaagtacctcaagaagtactacaagaaatgactcaggcgacatctattaggcctaaaacgcatctaggtaaggtttattcagtttatattatctttgcaggtccacacagcccagacaacggctagagtcgccctcaatcgtgctccgcaagagaacttaattagtttccttattttagcttattttctttctaaaaacaatggtttttgtgttttgattttatttgcttccttgttgcgtttttacatttaatttcggccttagggctagctgaaggactcttataaggtccccatacagcagttgtacgatttttacctttgattatcaataaagaaccgcattttctcacttcttctctttaagtgttcttaagagaataagcttgttctttgtcttgtgtgtgtgattcaccaaggccaagttcatgtactgtatcagagacttatcacatctctgtggtgtacttcaatccgccagcacttcccctccattagatcccacacgagagaagcgatcgtcatcgtgttagatctccatcatcgaccatctttccttcacaagagagaagcgaccgccagcttgtgaagccaccatctctatcagatacaaagctcaccaccgagtcttgtatcatcttggtataagagcgcagttgtgcttcctttgcgaggtttcatcattttgttttgtctgccctactttctgaatcagtttttgcattagtctagtttctgttttatttaaattaaaaaaaaaagtatttcagtttcattttatttcgtgttaagtatttgtttttgagtttcgtaatattaattaaaaaaaaaataaaaaattattgttaactttgtactacattagcaagtgtgtcaggaagtgattcaacaagtcttaggtttcttgttttttatctttcttttctagtgctgtggtacattgatttctttgttgtttttgtctaatcccatgtcagttttaggcatatactatgggagaagcagcagaaattccccaaaacgccgtaatgcaaatgatggctactttgacggaggagttaagaggattaaggcaacggctaggtcgtttggagcagccccatcctagggttgaaatggggcaagaccaggctcgtgggaatgcccgcgaagaggtagaggagtttcctgacttggatgatgatgatgatcaaccacccgaccctttgaggcgccaacataaacggagagaagatccattgacgagaaaccgtgcacgaggagtagaaccgcgtgaacagaaccgagatatcaaactaacacctcctactttttgcaggaaaatctaatccagaggtgtacatggattgggagcgatagatgaagtacataagcacttggggagaatctcggaaggtgtccttagcagtcgctcagctcaccaaaaatgctttatcttggtgggataggacagtagctgataggaggagataaagatttggtcccataagcacttggggagacatgaagtacctcttaaggttgaggtatgtccctgaccattatcatagagacttacaaaaacgttttagaaaattgtctcagggaacaaggaccgtagatgagtactttgaagagtttgagaagctcatgaacgccttggacctagaggaatccaacgaagctctcatggctcaattcatagacggattacaagagaggattcagcgaaaggtggagagagcccaatataatggactccatgagttgctacacctagcggtacaagtcgagcagcaaatcaggcgtaaggcatccttaagcaaccgatccagaaacaacacaccttggaatgcaagcaacaaccgagccatggacaaaggcaaggccgtagagagtgatcctaggtacaagaacaagtctaatgaggcacctaaaacctctaggcccgaaccaggtaagttctctagtactaatccatctccttctcgtgacattacttgtttcaaatgtcaaggtaggggacacatggtgagagaatgtccgaaccaaagggtgatgatcctcactcctagtggtgactatgagtcacaagatgagcaagaggattctaatgagcatgaggacgttgagtatccggatgtaggagaactccttgtgattcgcaggacattgagtgtgtttgttaaccccgaagaaaaagtgcaacgagaaaacatcttccacactagatgcaccataaagaacaaggtatgtaacttgattattgatggaggttcatgtactaatgttgctagcaagtacatggtagacaggctaggtcttcagaaaacaaagcactcgagaccatacaagcttaggtggctcaatgacaatactgaacttaaaatcgattaacaagtgattgtatcattcagcgtgggaaagtaccacgatcaagtcgtttgtgacgtagtgccaatgagagctggacatcttctccttggacgaccatggcagtttgattgaattacatatcacaatgggcgcaccaaccattactcttttacctttaatgaccgtaagtacaacctcgcccctcttagtccctcagaagtttatgacttacaaattcacatgaccaaggaggacgaggtaagaagttctaatctttatttaagctctaaagatgtttgtaaaactatgagtgccaagggcaccgtgctactaatggttttcaaagaatgtcttagtacaaggataggtgatcctgagctacccactgaagtactaggtgtactagatcggtacaaagacttattcccggaggagattccacccggactaccacgtatttgtggcatagaatatcagattgatcttgtaccaggctgtggtttacctaacaagcccgcctataggatgaattcggaggagtctaaggagcttgagaagcaagtgcgtgacctaatggacaaagggtacatcagagagagcctcagcccgtgtgcagtacatgtcctattggtcccaaagaaggatgtcacgtggagaatgtgtgtagactgccgtgcaatcaacaatatcaccatcaagtaccaacaccccattccgagactagacgacatgttagatgagcttaggggtgccatcatattttccaaaattgacttgaggagtggctatcaccaggtccgaatgagagaaggagacgagtggaagacagccttcaagacaaagcaaggtctccacgagtggcttgtcatgccgttcgggctaaccaacgcgccaagcaccttcatgcgcttaatgaaccaggttctaaggtcttttattggtaaatttgttgttgttttctttgacgacatacttatttacagtaagagctattctgatctcattcaacacttagagttaattctcaaaacgcttcggaatgaaagcctttatgctaacctgaagaagtgcacattttgttctgacaagtgtgtgttcttaggttttgtagtgagtaagcagggactacaagtagatgaggagaagatcaaggcaatccgtgaatggcctactccaacatctattacacacgtccgtagtttccatggactagcgagtttctatagaaggttcgtcagagactttagtacagtggctgcgccaatgactgctgtgataaaaaagaacgtgcctttctcatggggagaagctcaagataagtctttcaacacgttgaaggagaggctcacgcaagcaccggtcttagccttaccagattttgaagtaatgttcgaagtagagtgtgatgcttctggattgggaattggagttgtactacatcagagaaagaggcccgtggctttatttagtgagaaactaagtcgagcagcattgaattacccaacatacgacaaggagctctatgctttggttcgagctcttgagacttggcaacattacttgttgtccaaggaattcatcattcataccgatcacgagactctcaagcatcttaagggtcatacttcgcttaagaggagacatgccaagtggttggagtttgtagagatcttcccatatgtgattaagtacaagaaaggaaaggagaacgtggtagctgacgctttgtctaggagacatgcccttatagctactatggaggctaaagtgatgggttttgagcatatcaagagttgtacaaagacaatcctgagttaggagaatgctaccgagagcatggtaaaggactttacaaggcattctacttgcaagatgggtttctattcaaagacaagcggttgtgcatcccttacggttcagtgcgagagttgatacttagtaaatcgcatggtggaggtttgatgggacactttggtgtagaaaagactttggccatggtaattgagcatttcttttggccccacctcaagaaagatgttgagaggttttgtgcccgttgcattgtttgcaacaaagcgaaatccaggtcacatcctcatggtctctatttaccattacctattcctaacgccccttgggtagatgtttctatggactttgttttaggattgccaaagattaaacacaaggattcaatctttgttgttgtggaccggttttctaagatggcacacttcatcccgtgtgacaagaccaatgacgcgactcaaaccgcggagttgttcttcaaggaagtggtacgcctccatggaattccaaggaccatcgtttctgatcatgacaccaagttcttgagtcacttttggaggactctttggagaaagttaggtaccaagcttctattctcaacaacttgtcatcctcaaacggatggacaaaccgaagtggtaaaccgaactctctcaactttacttagagttactcttggtaaaaatatgagcacatggcttgattgcattccttttatcgagtttgcttataatcgtgctgttcactccggtacaaaactgtctccttttgagatagtctacggaattaaccccttgtctccattggatttagtacctttgcctgagaaagaacaggtttgccaagatggtttgagacgtggtgaaatcatcaagaaaatacatgagaagccaaaagcgaacttagaaaagaaggccgccgaaaacaaacgtaaagctgatcggggaaggaaggaaatgttatttgaactaggagattgggtttggctacatatgcgacctgagaggtttcctacacaaagagcatccaagctagcaccacgaggcgatggtcccttcaagatcctcgaaaagataaccgataatgcctatcgtttagagctgccaagtgaggtaagaatttctcacacttttaatgttgctgaattgtctgcttatgatccatgagattcagttttgaggacaaaaccttttgaagagggagggaattatgcggacatcaaccttacttcacaaaccgctgaactacaagctgtaccacatcttttactacaacctgtaccagaagtcccggatggtatcatgacaagttcaaaggctaaacaactgaagaaaaggttcaacttagttgtgcaagatattttgagctaccaagagctaggagtaaactagtccgtagcaccccatacaggatatgatcttatagacgaaaaaagcttgctgaagcattcacccaaatgagtcttgaacgaactactcccccaggtatgaaatatcgtttgacaggttcgaggacctctagaaaccaagagaagactttggagcttcaatagatggatgttcaagtgtcatctctgaaagtgatcgagagagtcaagatcaagaacaagacatcaaggacatggaaaagctcgaagacattgatcaaactactcaagaggaactccagaaagacccctacttcgaggaaccagccaacaaacgagcacaagacttgattccaaaagtacctctagaagtactacaagaagtaactcaggcgacatctattgggcctaaaaaacatctaggtaaggtttattcagttcatattatctttgtaggtccacacagcccagacaacggctagagtcgccctcaatcgtgctccgcaagagaacttaattagtttccttattttagcttattttctttctaaaaacaatggtttttgtgttttgattttatttgcttccttgttgcgtttttacatttaatttcagccctagggctagctgaaggactcttataaagtcaccctacatcagttgtttaatttttacctttgattatcaataaagaaccgcattttctcacttcttctctttaagtgttcttaagagattaagctcgttctttgtcttgtgtgtgtgattcaccaagactaatttcgtgtactgtattagagacttatcacatctttgtggtgtacttcaatccgccagcacttcccctccattagatcccacacgagagaagtgatcgccatcgtgttaaatctccatcatcgaccatctttccttcacaagagagaagcgaccgccagcttgtgaagccaccatctctatcagatacaaagctcaccaccgagtcttgtatcatcttctcacttggagataaagccaatctatgggaaaaacgttaccctagaattcaatcacaacttgggatgactgcaaggaagccttcttggcaaaattcttctccaactccagaactacaagactccggaatgagatatccgaattcactcagaagcaaactgaagccttctgtgacgcttgggagcgcttgaagggttatcaaaccaaatgccctcatcacggatttaagcaggcttgtcttctcagcacactctaaagaggcgtccagcttaagataaggatgctgcttgataccgcttcaaatgggagctttctcaacaaggatgcttaagaaggataggagctagttgaaaaattggcttagtcggatggtaattacaatgatgattatgacagaagcatccacaccagctttgactctgatgacaagcaccgcaaaaagattaaaactctcaatgaaaaaatagacaaactccttcaagtgcaacagaagcatgttcacttcgcccctgaagatgaactattccaagtgcaagaaagggagaatgatcagtgtgctgaaagcagctatcttccgaaccaaggtggctacaacaaagggtacaacaattacacatccaacccgaatctgtcatatagaagcaccaatgtagctaacccacaagactaagtctacctaagcaacaccaacaacaacaacccaaaacgtttgttccttacaaccaagttcaggggtttgttccaaagcaacagttccagggaggttattgatatatccctattttcactgattttatctatgtcttagggttaggattttgagtctttatgttatatctctaatctttttagtgtctttcaggtatcttatgcattgggacaacaatggagataaggagacattttggagcaaaagcttaggaaaaggaagctaaggacgtttttggactcaggaatcaagagtgtgtcgatcgacaccagtttcggcccagcaaagtcctagacgctttcaagtttacagaataggaaatttggcccagaagacttccttatttacattattagtccgtaaatgttttatagggtttatatacattgttttagaccctagttttcatcaaaaaagttatcatcaagtttttatcacgctttttgcaaaccctgttacagagagacataagctattcatcgagtgttttcagagattgattcagttcttaattcagtgaagagatcccttctttcccttaatttatttgctgtgtttatgttttcatactcaattatattgtttacttcaatcaatatgtatgagtaatctgctttttaggaatagggtttctcattagggattcatatggtttagtagattaccccctttgctcggttatctgtaaaattcttcatctttaataatgtttaatgctagatctagagtaattaactagatcttgaatccagacaatagatatgcccaccgtaggtatctgtagttggatcgattatttaatgtgcctagtttataggtgtgtaataagaatcggcctatctactaaggtgaacaatcgaactcgttaagaatgcatatttaggttaataatctcttggcttctccggttattcttagctatagatatagggagtttcgtggaacgccaccggttattccataattaaagtttgagtttaagaattgttcgataacaacctaactttcattagatctactaaccaataatttcctgagaataccatgttcctagctcttttcctaatcgtttacaacacaatcaacttgctgttttcttactttgttctcttactatttcaatcattacctactagcttaatcttgacattcaactcattgtttgaacaaacaaactttgtgaattcgattcttaaatactgcaaattgatctcttatttgagagagtagttctagggtaatttgaaccatatcaattatgaacaacaaccaacacctggtttccaatcacatcaacatcaagcccctacacttcaggattctgacaggaagaccattctgcagaagataattcaaggccaagccacatgagcaatcaaaatcgcaaagaagttggctgaattacacaataaagttgaatgacacttcatcaaacttaacagcaagtacaaatccttgggcattagaataggatatctggaaggcatccccgcttcaccatctattaccaacaacccaggcgagcttccaaggaaagcaatccaaaaccctaaggagtatgccactgctcacgccatcactatctgccatgatcaagagctgccaactcgacatgcccctacctctatcactggggatagtgaagttcgggaaggagaggatttcgttcagagtgaagatccaactgaaatagcaatagaggagtccatactcgatcgtagtagtcgatcccgagctcaagcagtacctctttctgttaaaaagcatgtcgttgctaaaacaaggataaagtctttattcctccaccctacaagcctccactaccattttcagggagattcaagaagcaactgataaagaagtatgaagctctcttggaaaaaccattgaaggaccttgaaatcacaatgcctctagtagactgtcttgcgctaatatcggacttactcaaacgtgtgaaggacatgattatagagaggatcaaagaaattcaaggaacaatggcattaagtcacgagtgtagtgaatcatccagaagaagattgttcaagaaatgttggaagatccaggatctttcactttaccatgctctattaggcaactagctttcagcaactgtctatgtgatttaagagcttcagtcatcctggaagctgggatttgtcaaatataagccatgcgacctaaccttgattcttgctgataggagtgaaaggagacattttggcctgttagaagatctgcctataatgatcaatgaagtagaaatacatactgactttgttgtgcttgagatggatgatgaatctaaggatcctctaattttaggaagacctttcttggcctcagtaggagctgtgataaatgtcagaaatgggaaagtcgatctcaaccttgggaggcatatcaagttgaaatttgacatcaagaaaactccaagaagatcaaccatagagggacaaacctttgggatcgaaggagtgataaaggaagaaagatttaagactgaaagagtaaagcaaccaagtttagctccaacacgaccttcaagctcaaccactcgatctagtacactctctgtagttgattggctagaactcaaaaggaagtctcatctccaagaagaaaccaactagaagctagcttacactgttgaggaacttagggataaagtgagtagaatgtagagggaagatattcgacctcaactcggcattgaagctatcccaagcaagaagtttgtttcagaatggtctgaagaagaggactacccacttgaaataaaagaagcttacaaggaaagggccattgagtactcaattacatacttgtcaagagagcatgctaagtccaatgtcgtatctacaaatgaagaagagaagatttcaattcctctctatcattctccttaagcctattgagtgtgaggagtcaagctagagacttaaaacaagctcacttgggaggaagtcccatatctatctttgtatatatctttacttttccttgttgttcttgatgcattctggtagtgtactgatgggttcaatccattggcatgttttgtaatcattcgttgtggcctgtgatcctcactccatataatttaccccctggtatgtgcatgaatacatagtacttatttcttactattctgaattctggaccaaatcatcctcgagctagtcttgatgtcttcctccaacatcttattgaggagctaaaagagttgtggtctactggagtcgatgcgtacgatatttcattgagtcagaattttaatctaaaagctgtattactttggacgattaccgactttccggtgtatagcatattatcaagatggactactcatggtaaattgtcttgtccagtttgcatggaaagtacaaagtctttttatctacccaatggacggaagacatgctggttttattgtcactatagatttcttcctcatggtcatccatcctgtaggaataaaaaagactttctgaaaggaagagatgcttctcgcgagtatccacccaagtctttgacaggggagcaagtttagtacgagcggttggctagtgtaaatccaccaaaaacgaaggatgttggtgggaacggtcatgaaaagaagatgcgaggctatgggaaggaacataattggcacaaggaaagcatcttgtgggagttgccttactggaaggacctcaatcttcgacataatattgatgtgatgcataccgagaagaattttcttgacaacatcatgaacactctcatgagtgttaagggtaagtcaaaagataacatcatgtcaagattggatattaagaaattttgttctcggccaggcttacacattgatagtaagggtaaagctccaattccagcgtatacactgacagaagaagctaaacagagtttatttcaatgtgtgaaacatgatgtttgatttctagatggttattcttcagatttggttagttgtgtagatctggagaattcaaagttttcaggcatgaagagtcatgattgtcatgtttttttggagcgactacttccatttatctttgctgagctccttgattaaaatgtccaccttgcattatgaggtataatacttactattttttttccaacacttttttatctaatcatttaacttgcacatatattttaggaattgtaacatttttccgggacctatgtttgagaactttacagacaagtcgcgttcaaattctcaaacagaacatagttttaatcatctgtaacttgaaaaagatctttctaccattattttttgatgttatggaacacttacctatccatctctcatacgaagctgaattgggtggtgatataacccgattttcaccaattttatctataatttaggtataggattttgattctttatgttatttctcgagtctttttaatgtcttttcaggtattctatgcaatgggacaacaatggagataaggacacattttggagcaaaacctaaggaaaaggaagctaaggacgattttggttcaggaatcagcgaggagtgtcgaccgacacactcttggtgtcgatcgacaccagttttggccccgtaaaaaccctatatgcttttgagtttccagaagctcaagtctgccccagaagatttctctatttacattattagtccctggacgtttttagggtctatatatatatattgtttttagacctaagtttcttttatcaagtcttttatcaagttctttgcaaaaacctattgtgagagacataagctattcatcccttgttcttcagagttttcattcagatctatatacagtgaagagttcctttcttttcccctctttatttactgtgtttatgctttttaattcaaccatgttttttgcttcatccaatatgcctgagtaatctgcttgttaggaatagggtttctcattagggattcatatggtttagtagattgccccttttgctaggttatctatagaattcttcatctttagttatacctaatgctagatctagagtaattaactagatcttgaatccagacaatagatatgcccgccataggtatctgtagttggatctattatttgatgagtctggtctataggtgtgtaataaaaatcggcctatttactaagatgaacaattgaactcgttaagaatgcatacctaaaggttcttatgaaaaatggtgatttgacaaatcttcgattaaattttttggaaatcttacaatttcttgagtcacaaaagtttttgtaatatatcacagctgtatctatgaatccactttagaaagcttccatgtaaaatgttcttacgaaaaatggtgatttgacaaatcttacaatttcttgactcacaaaaaaatatgttcacctaaatgttttacgaaaatggtgatttatcatatcttattagaattcttacaatttattgactcatgaaatatatatatgtatatacactttctctacgaacattcatgtgttcttttatctcacagttttcatattgaaaatgtaaaatgtacataaaaaaaaagtaatatgtgtgtttgtaaaacataaaatttacataaaataaaaatataaaatatacatataataaaagtacaaaactataagaacacaagagaaagggaaagagatggcgcaccattgataaatttgtaagtgtattttcttaactttatatgttaactatatttttcaactttctcgttatgagatttcaacacatgtccccacctttttgttgcttgaatttttaattatcatgtcatttgcttgtaagaagagttttacgagttatatttttgtgtcacaggtgtacatcttcaaacatgtatcgagcccatcatggagatcaagaagtccttgaagaaacagaaagaaatgtattacatgatgacgagttggatgctgacattattttgttggtgctcctgatttcttttcggatgttgtatttgaggaaatgcctacgacatcgaccttaatattctattcgtcgtgcgatcacaagaggcagagaaatctttatagaaaatgtgcaaaagcaaaaccttatgcattttcgacagttgtgtcgaatatatccacaaatatttctgaagttatgtgaacaactccgggagctgacaagtttatgcgatacgaaatatattagtgttgaagaaatggttgcaactttccttctagtagtcggccaaaattcaaggtattgttatacaaaagacacttttaataggtcaacgtttgcaacaagcgtgaactttcacaaagtgttgctgactcttaatcaaattgctctaagtgtaatggctaagcccgagattgcagtgcctagaaaaattagagaaagtacgaagttttatctgtattttaaagtatatctttcataaagttatgtttttgctttttcattatctttcatgatataaaactttattgtttatttaggattgtgttggagctattgatggtacacatatccttgcaatggtatcacaaaaaaaaacaccttctttctgtaacagaaaaggtgttatattgtaaaatgtgttggcttcttgtaattttgatcttgcatgcatgtatgtgattagtggatgggaaggttcagctcatgactcaaaagtattaaatgatgctttcacaaggaacagtaatcgactaccagttctagaagataagtacatgtctttatattgtaaatatgtttttttcaacaagacaagtgctatatattattgtatcttttataagttattactatatttcaggaaagttgtatgtagtagattgtggatttctaaatcgtcgaaactttttagctccgtatcgtggtgtcagatatcatctacaagaatattctggtcaaaattcacaacaaccagatgcaaaagagttgtttaaccatcgtcatgcatccttaagaaacgtggttgaaagaatatttggtatttttaaatctcgatttctaatctttaaatctgcacctccctttccttataagacgcagacagagattgtacttgcatgtgttggtttacatgattttcttcgaaagttttgtcgaacggataattttttggaagaagacgaaagtgcagaagaagttgtcgaagaaattaataacaataatgatgaagttcttacaacccaagatcaatagagagaatatgccaattagtggagagaaacaatagcatcaaacatgtggagtgattcaattgagaattcatagatcagaacgtgacagattatttcttaaagattgtaatattttaattttataatccttttgtatgaatttaatatctgctttgtttgactttaaattccactttatttgactttcaaatcgggaaaaatgtcaaaaaaagcatgaactttcaaatttggaacgaaaaaaatatgaacttccaaaatgccactaaaatcgtaaacttttgtttgacttttgataaaatggtcaagttttgttgactttgccattttaagcatgtcgttaagttttcgttaaacaaataacaggtagagtcgaactagtgaccttttcgattctattgaaggactaaaccattgagccacatttatttttggaagtatagtaaacatatacatacatatatacgtaattaattaaaaataaccaactaaaataaatcaataatatagaaaattacctaaaatttacacaatccttctcatataaatataggattaatctatacatgcacatagaatttcattcaacttcactttatatatagttttatttataataaaacatatatttgataaattaatttgataaatatttgataaaagataaatataagatcattattccatcttcaaatcaaatttttattcataattagatggaaagtatataaaaaattattttttggtaatatatttataggttctatatttcacaagtttcatttttatataatttaagagaaatttttttaattcaatacgtttaataaaaagatttacatttttatttgggaatatatattaatggtaggtgtatttaatatttttacatgtttggttattggttttatagttcgatcaactggaattcgatccaacgcactcccgcacccagaaggtgttcgatggaatgcttgctctactagttcttgagatatgcgtctctatcccaagggattggccgtttagagtgtttattgacttcatcaatcggttcttattgcctgcatagttagatttcgttaatgggaattagtctgtgctagctttgcttgaggatttctatcacgggagtgaattaatcagttgttgaacatattgtctagggagagcttgattgtgcttgttaaccatccgaatagggtaggataccactccattcgattaccccatccttagcaatttctcgtctatatgatttctctatttcatcgttatcgcttaatcgttctcattgcttgtttcttagtttttgcatttactagactaacttactcgaccacacccagtgtctggcaacagactgtgcagtcgagtatagttgttttattttttgcctgttactcgaccacatcttgcttcttgcataagccagttgtggtcgagtgatttgtgtaattatgttttctgcatgttcacttacgactgttagaaactccaaaacctgttattcttggcttgacacccatttggattgacaccataagtactacaacgacatgatagtgctattggattaattgactaaaaacctattatgagcaagcagtcgtgagtggtttctcgaaggtctggttctgaattctactctttgactgaactacactaacatcctctttgttgatctgagcattcaagtcttgaacaacatcgtacagactatcaatctgttgatttgtcatcactgggctcttgagaatctgttcaagcatgcattccatcatactcgtagaagtgggttaagggtgggcttggtgagtagaatagctggaatgactagcatagaacatatcatgcgtgttgtagtcatcaagttgaatagcacgtccatctacaactatgtatccgccttggtgtcgatcgtcagcctcggcaaaatcaggtatcaggtttccctgctcatcgattttctgaccatcctcgttgtatgcttggctagctctgtcctttaacactcctgcagcatcaggtattactatcaacatattggtcttgcaattgaattcttgaagctcctaaaacacaagaaaaaaaaaaactgaattagtaatgaaagaaaagaaagtctagacttaaatcgacacctagtctagtggtgaagcaaagagaactttgacaacgacgtcaaatttgatgtaggtcaaattaatcctaagaccactatttcaaatagacagatcgtcgttagcacttaagggtcgaattccactgagctctcgatgttcacacaatagacttatgatgatttcaattaagctagacaaagtatatgaatgtaaaagacagtaaagcaataaaatgagttgtatattctggagattaaagtgtcgggtctaaggaattgtcttgggaaatagataaattgcagatctagctaatcttaggattgttatcgcaccgttctcgaactcaaactaagattttagaataatctctatgcctagaataatcggtggcgttccgcaaaattctctatgcctagaataatcggtggcgttccgcaaaattctctatgcctagaataatcggtaaccagagaagccgagaaatcttatacgaaagcatgcattattatcaactttgattagttcacctagtatataaacaagagcccttctatgagccgacctgttctttcttgaatacttaggcccatctatgatagttctgataacaactacctatggcgggtatacctattatctaatatcaagttctaggtgatcaatctaaaactagcagtaagaacaatcaatatgaagaagtttaagaataatcctaagggatattcgatctagtattccatctaaatccatattgagactccctaaacccaacaaggtgattacttagacgtgattaaagtaacacacaacaaagtctgaataagaaatcaataataacaacagtaagagtaaggaagatcttctccaaagggagtctccatagggttttgctccaaaagtacaaaagagataaggatattagcctctccaagcttagctctaaacaatgacctttaaaactatatatatgacctaaaaaaatgtgatggaccttctttagaaataaggaaaagttctgggccgaattttgaaatcttcaaaacatcaataacttgcgtctttgactaagttatttcttcagcagcataagttccctgttttcccccagaattctctattatcttctattatctccaaatgaatctcaaacatgtaaagacctgaaaaagactagaaaagactctaaaaataacaaatagactctaaaacgtatacctcaaacatagttaaaactggtaaaaataaggatatatcagctgtcgagtttcaaagtgaccgtccgaccgagaaatcgtgaaaagtgttaccatcgagaaactatgcccgtgatcaagatcctttgtccgtaacttattatttcctgtccgtgatcatgaaaacctgtttgtggatgagaaatccctgtccgtgaccgagaatcattgaagctaaccttaaaccttcatccgaatctctgtgagtctcgagcgtgtgatattgcacatgataggtttgggtgattgattgcttgtttagttgcatgatcatatactcttgcattcattgaatgatttcatgaattatatgagaattgattaatggtgtgaatggtgatagtaagctgcatatgagatcttttagattcttatgcttataggcttatggttgggaggttgtggtgagtaaggatattgatgattctatgtgtttcagtaaccatatgtctcataatatcttaaaatgttcggtcttgatgtgtggtgctcgtggtaggaggcagagaccataagtgtatcaaaatcgtggtatatctgaccttcgtagtgaaccgtgctatcgtggggtcttgttaacgtgttagtcgatcaccatgtagtgccaagggctcggaaagacggttttgaaacatcaataacttgcgtatttgactaagttatttcttcagcagcataagttccctgttttcctccagaattctctattatcttctattatctccaaatgaatctcaaacatgtaaagacctgaaaaagactagaaaagactctaaaaataacaaatagactctaaaacgtatacctcaaacatagttaaaactggtaaaaataaggatatatcagctgtcgagtttcaaagtgaccgtccgaccgagaaatcgtgaaaagtgttaccatcgagaaactatgcccgtgatcaagatcctttgtccgtaacttattatttcctgtccgtgatcaagaaaacctgtttgtggatgagaaatccctgtccgtgaccgagaatcattgaagctaaccttaaaccttcatccgaatctctgtgagtctcgagcgtgtgatattgcacatgataggtttgggtgattgattgcttgtttagttgcatgattatatactcttgcattcattgaatgatttcatgaattatatgagtattgattaatggtgtgaatggtgatagtaagccgcatatgagatcttttagattcttatgcttataggcttatggttgggaggttgtggtgagtaaggatattgatgattctatgtgtttcagtaaccatatgtctcataatatcttaaaatgttcggtcttgatgtgtggtgctcgtggtaggaggcagagaccataagtgtatcaaaatcgtggtatatctgactttcgtagtgaaccgtgctattgtggggtcttgttaacgtgttagtcgatcaccattcgataaaagtgggttgatatattcggagatggaccgatatcaatgaaatttggatctagtcggaacttgactaagatcgggtacagacttagtctggatttgactatttctggggttttgatcttatcaaaaattgaccaagatcatggaaaaatgacaaggtcggaaagagacctatgtcggaaatattgaccgagtccggtggggaccaaggtcggaaatattgacaaagtcggaaaaagactttagtcgagaatatgatcgagtccgggaaaggaccaggatcagaaatttgatcgaatgtcggaagagacaaagatcagaaaacgttaatcaaatccaggaaaggacaaagattggaaaacgttgatcaagtccaggaaaggacaaagatcgggaaataatgatcgagtccgggaaaggaccaggatcaaaaatttgatcgaatgtcggaagagacaaagatcagaaaacgttgatcaagtccaggaaaggacaaagattggaaaacgttgatcaagtccaagaaaggacaaagatcgcaaaacattgatcaagtccaggaaaggacaaagatcgggaaataatgatcgagtccgggagaggaccaggatcaggaatttgatcgagtgtcgtaagagacaaagatcgggaaacttgatcaaactcggaaatagagatttgatcaaatgtgatatctaaagtctcggagagactaaagatgggaaagcattaaggagtaaacaagatcttacacccgctgaattcgaggacgaattcagtttaaggggggtagacttgtaacgcccgtgtcccgagttagggagtaagcaagatcttacacacgccgaattcgaggacgaattcagtttaaggggggtagacttgtaacgaccgcgtcccgcgttcataaagaggccaggttgttttaggagaaaactataccatggtcaagaaacggactaaaatacttagtcagaagaaagagaaagttcaaagctcaaccagctaggtgagctggacaagctaggatgaactagctagctaagctaggtgagctaaaccagctggaagactagctagctcagctaggtgagctgaccgacagctcgactgagctcggtgaactgatcgtgtactgacccagctgggtggttcggtcagctgacactcgagctggtggactgtggtagctcacgggtgaagaggtgtctcgcccaaaaggtgtaaggtcgagcgggtaccaacgaacggatgcatcgcctaatagatgcaaggaacggatgcatcgcctaatagatgcaaggaacggatgtgaccttttggaaggatgcaaggaacggatgtgacctttcagaagggtgcaaggaacggatgtgatgcttcgggaagcatccattcgccccctatataagggagaacgcccaaggcctttggaataatctcacatcatctcacaataatctcatatcatcccacaacatccaaaacaccataaaacattcttaaaggagtctcaacacatcctagagttgttggtcggaaagggggtgcggctcggcgagtataactcgaccgaactgatgcgcatgctacctcccggtccaacggttcgatggagtgtagaggatggagagggtagaccattcgtcttagagacgaatcggatctggtagaccgatcgttggatcggatcggccagaccgatcgtcaaacggatcggatcggccagacggatcggacagaccgatcgtcggacgggtcggatgggacaggccgatcgtctgacggaacgggtcggacagaccgatcgtcggatgggatggatcgagaaaagtgttcgaggaagcacaaggataagtgcatccgaacacacccaagggtcacccatggatgcaatcttaccggtaaagggagaaagcaccaagaatgggtaaggaacgtgattcactatataggatcaacatcgcggccgccttcatgtatctatctcctcagccatggtgaaaccgatcagagattggtaagaccaaagggtgactcgacggataaccaacgggaaagtccatggtgggaaccgatggacaaaacggatattggacccgcgagcaaacctaaggccgacggaagaaggatttcatgggctagcctacgatgatccagtggatgaatccaaggacccttgggtgtgataaggatatagttcagatcgtatggatggatcaataagccgaaagctttatcgaccaccatagaccggacggataaatggttagtaaaccatgggcggtcgtagtaaatgaacagatcggaaacatggatggttcgataagccaagggctcaatcgtccaccatggaaccgaaggggagtacgtttggaggacggatggaccaataagccaagagcttgattcgaccatcgtgaaccaagggaatcgtacgatccccaatctctatcgttgtacttagaccagtggggttggttggttgtatggctaagtaacgatagggattggttcatcaattcacgaccgatgataagtcgttgaacgaatggagtaaggcgacaaacgggctaaggaatcaaatccgcatattggccaaggtatgtaacgatctagcttattagttaagatagacgtttggtaattgaccgtgaaagtaggataaaggaatatgcgattgtttggcttagaatggttagcgaaaatatgcatgtcttgaccgagaaaaggatcgatctaagtctaagggacaaagacgatgaaaccggtacaagagttggttagaattaaaccaaggttagaaagacttccgctgtgtaataagagagcgattatagaatttagcctcataaaggcaattctatgttgaatcgcgaaaagttaagaggttcggccacccctacagacccaaattgtgttagtaggagttccggtggttatccagtatacgatcctttcggtgaacctcttggtaatcccgatggaaaggttcgaagttatccttgggatggattggttgtcaggatatcatgcccatttggattgcgggcggagcagagtagtgttcgaactaaggaatcgaccacgactcacttactgtggaatcaatccaagtaagattgcttcgttcgtgtcagcactaaggttgagaatttactaagggaaggagaagtctaccttgtcactttaaccgccgttggtggagaagttgaaagtgactcaaggatttaagagatcccggtggtgaacaaatttgatgatgtgttcaagcccttggaaggattacctctgccgagaaatcatccgtttaccattaatcttgaacctgggatgattcgaattgcaaggacactgtaacacccccagtccgaactagaactcagccagtccggcacggcccagacacgccacaatgaaaatgaattcccatagagtagtcgaggttctgaaacacatttcgacccttagccactcaaggttacccatttccccatttgggatccatttaggcttgccaaccctaacttcacccaaatgttgtgtcgactcggacaaagtcttatcagtttgaaacccgtaaagtataaaataaatactgatttcattatcaaagagttatgaaaatacaaggaaaaaccacaacataaacattgtttttatggccaaggcatgaggcccaaaagtacactatactaaaatacatactttgagttttacaaaaggacactgaaaaactactttggattccctagtgttcaccactccctctaattccctttaaggttacctgcaaaacaagtagagtcatgagtaatctagcattactcaatgagctcggattcctcaagaaaacgttagtctaatccccacccataatccccacatgaataacatgaataatcagagtacacagagaaggtagtaaaccacacaaacacaagcaagaaataacgtttcttaaagttttaattagggcatgaatgcactcccttcctcaacacacgtgaacacccgagttataaccacaaaggcatataaccggaacatcaccttggctacaccgtcgtgaaagcgacaccggcccttgggtagctaacccagtctctctgggtccttcgaaccccttgggtagctaacccagtctctctgggtccttctgactctaggacaaaacttgctcaccaagttagctcgcccgggtggattcggctccaagttggctaaggcgtggggtcgaagttgggcttgcatggcttgggagaaaacttggtcaccaagtcagctctgcccgaatggatttggctccacgttttaaaacttgggctctactctggcttccgcggattataaattggcagcccttcttctcatttcactcaccattctctcttcttcttctcttgcccttctttcttgctcggggtcaatgagcggggtactacatgcaccatataggttggtgccagctgagcttgcagaacttcagaaacaattggaggatctactcgaaaagggatttatttgtccaagttcatcgccatggggagctccggtattgtttgttaagaagaaagatggaagtatgtagttatgtatagactaccgaggtcttaacaacatgaccattaaggataagtaccaattgccatgagttaatgagctaatggatcagttgggaggagcaagttggttctcaaaaattgatctggcctttgggtatcatcaaatttcaatctcgggatcggatgtaatgaagactgcctttcagacgaggaatgggcaatataaatttgtagtcatgccatttggacttacaaatgcgcccgcagccttcatgagacttatgaacgaggtattacacgattatctggatagcttcgttatcatatttatcgatgatatcttggtatattcacagagtgcggaagtgcatcgtgaacatttggggaaagtgttggatagacttagggaacaacggttgttcgctaagtttagcaagtgtaagttccggcaacgagaaattggatttcttggctaccgaatttcaggacaaggagttacggcggatccagaaaagattactgtaatatagcaatggccgcaacctacatccgttacagaagtacggagcttcttaggattggcaggctattatcgtaagtttgtcaagggattttcatccattactaagcctttgacccgacttactggtaaaggtgtacccttcatatggagtaaggatgttgaggaagcctttgttaagttgaaaacggaattaacaaccgccccaaatctagcattgccaaagccaaataaaccatatgatatctacacggatgcctcgcgagttggcttggtatgtgtccttatgcaagaaggaaaggtgattgcctacgcatcatggccattaagatggcatgaggagaattatcccactcatgatttagagatggccgctgtagtattttcgttgaaagcatttgagatcctacctgtatggagagacggtacgagtatttacggaccaccaaagtcttaaatacttattcacgcagccagatctgaatttacgataatgaagatggatggagttaattgccgattttgatttgaaaattcaatatcacccgggaaaggctaatgtagtagcagacgccttaagtcgccggaaaatggaagtagatgttggaaaggatctagagtcgttatctgatgagctaaagaaggtaactttgttagctctagagggtgaatctagtgagcccttgggtttacaagttgtgactcaagcaaacctacttcaccaaatccgagaggaacaagcgcaagatgaaaagttgcagaaaatcgtggaggagttaaaaacattagatggaccaaacgctagtggcaaccatctagctgatgacggcaccttattactcaatgggagaattacagtgcctgatcgtaaaggattacgataagaaattttaagggcggctcatacttctttattgagcattcatccgggaagtataaaaatgtacaaggatataaggaagtattaccattggcctgggatgaagagatcagtggcgaaatgggtaagccaatgtgagtcatgccaaagagttaaggtggaacaccaagtgccgacaggtttattgcataacctaccaattcctgcatggaaatgggagtcaatatcaatggtttttatcactgaattaccaacaagaccaggacgtagcaatgaggctatatgggtagtagtagatcgcttgaccaagacgactcatttggtatcaatgaaaagcattgatcagtcacctatcctggcagaaaagtatattgatgaaatcttaagactccatggggtaccaactaatatagtatctgatcgagatcctaagttctcatctttattttgccaagacctccatcgtgctttagggactgatgttcccatgagcacgacattccatccaaaaactgacaggcaaactgaaaggaccatccgaaccataaaagatatgatttgactatgtgcactagagtgggctggtgattgggaagactacatgcctttaattgaattttcttccaataacagctatcactcgagcatcggtatgtcgccatttgaagcaatgtatgggaggccatgtcgaactcctctttgttggactgaagtaggagagaggacgagttttaataatcggttgatcgatgagtctacggagaaaattcagttcatccgagacaatatgaagaaagctcaagattgacagaaaaagtatgctgaccgaaacaagaaggcgacatggtttatcttaaggtaaccgcgttaaaagggaatgatcgctttggaaagattggaaagctcgctgtaagatttattggtccatataaaattgagaagaaaatcggggaggtatcctaccgtttgtttatgccggaagaaatgcgattacataaagtttttcatgtgtcgcaactaaggaagcatgttccggatcctaatgctatcatacccaagccaatacaagagttgagaacgaatctcacatatcccgaaggacctcttggtattggtgaaagacgaatgcgggagctaaagaatagaaggattccgcaaattcaagtgttctggggaaggcacagttgtaaggttactacttgggaagatgaggaaaagttctggacgaaatagcctcagtttttcgaaccagggaacgcagaggatgaagacggaccgtctaatccttctggaattcgggacgaattctagtaagggggggagaatgtagtgacccgctgactcgctcaagcacttgacacgtgggcatgctgaatcgcctttcccttgcttatataagccgaactcgaccccaattgttttgtgaagagaaactgagtggaagtgagaggctgccaagttgaaaccgtccgtccgattcaagttaaggtcccatagccgaaaactctacccgaatcgttggaaactttctgttggttactgagtgagttctggataatggtttaagtttcatattcatattctcatgcattcttgattgattttgtgagttatatgaatagtgtaaatggttatattggaatgcatatgtgatctttagattcttatgctattatttatggttgggaggttttgttgggatattgatgattctatgtgtttgatttaaccatatgtttcataatatcttaaactttggggtcttggtacgtggtgcttgtggtaggaggcaaaaaccataagcgtgccaagatcgtgatgtgtctgaccttcatagtgaaccgtgctatcgtggggtcttgtaacgttgttacttgatcgccatgtagtgcgaagaacttggagagacgaggctagctatcctgcccgagtgtctacacgacggtgtagcgtttggtagtgatgctccagttgcatacctttgtggttgtaatgcgggagatcacgagagtgtgtgtgtttggtgttgggttggaaggcagcatgtcgagcccttaaaaacttaatgaaactggagtcttaatgcatgttcatgtttttgtagtttgcttcggcaagataccttatgttgccattctctgttgcgtgtttcatgttgggtattcgggttggggtaaactaatgtctgttgcagggaatcccgagctcactgagtaaccttagtaatcgcgatggccttcataaaacttttaaatgtttggtaacatgttgtgtaatatttatacttatgaaataaatcagatttcttgtacaaatttgcaagtaatgacttataatgacttagtccgggtcggcacaacacttaaatatcgagagtggtcgtcaatacgccggccaagggttgagattggttcctgaacctcgattggatgttgatgatcaatctcaatgtggcgttttcggggcgccaatgacttgtccggtcatagagcgtctcgagggcgttatagtcgatggatatcgttggactactgcactggtcaacccaaggtgtacaatatcttttggttttaactgattatttttcgaagtggattgaggccgaagcatacgtgaacatcaaagactcggcggtaaaaaccttcatttggaaaaacatcatatgccgacacggtgtcccatacgagatagttacagacaacggaccacaattcatctcacacgagtttgatgctttctgtacggattggggaatcaaagttagttactccactctgcggtatccacaaggaaataatcaagccgaagcttcaatcttaaaaagcgtctaaatcatttgaaaggaggatggtacgacgagcttcaacctgttttatgggcgtatcgcacaacttctagacgttctaccggagaaaccccattctcattggtatacgggatggaggcagtcgttccagccaaactcaacgtgcctggactacgccgaacggaggctcctttaaatgaagatgaaaattcagcaatgctcgacgattcgttagataccatcaacgagaggcgagatcaagctttaatccgaattcagaattaccaacaggcagcagctcgatattacaattccaagatcaatagtagacctttcttcatgggagattatgttctaaagcgtgtttttgacaataagaaagaagaaggagcaggcaaactcggcataaattgggaaggaccttacatcgttaccgaagtggttcggaatggtgtttttggcttaaaagatctagaagacaggccagtcaaacgtccttggaatatggtgaatttaaagaagttttatgtttaagtaacatgcgttttttgttatgtacacgaactacggtgtggctttatcccgaaatgggtatgtaggcagctcggaaacgagttcaactactaataaatttgttttattcatttgaaaaagggagttcgactgtatgaacgaacaaggcaaagaagttcggatgtgcgaacatacaaaaacaagaaacaaaactacgtttattcaaagcagtaagtaaagaagacgaagtcccaacatgcgtgcccttcgaagtaagaaactatttttgtcttgcaaaacacttggactccttcgccggcgaggtcaagaataggcatcatacagtttggtatgcgagcaaactcggagattccgagtttgatccaatccccgggaagagagttaagggtgtgaagctcccttgatatcacggtgaccgtcgccggagaggaacagagggctgccggggtgaagaagagaaacagtggaggctgcttcgttctccatttgtgtattgtttatcaagtaaatttctgaaatcatacttggagaatttggtggcagatgggacctctatttatagagggttagggtttttccttggaaccacaagtttaataactgtggcgtgtccgaatggtttaaaccatttttgggaatcaagaaaaagcaattattacctcaaaggcgtgaagctttttcttgtttctcgagaaaggagatggcaaccgtcgcattaaagacaaaaagcccattaaatataaagaaaacagttaaggcccaagcctagtaaataagctgaattgattaaacccgagttggggaattcgcgttcaaaaccgagctcggttctcgcgttttaagagaaaggtatgatcaacctaaaaatctcgaaacttagccacatggccaaaagatatataaagacggactattgcaaaatcatagttttaaaaggtttaaaagcctcctcaggcaaatacttgttcaaaaataaagcctccttaggcagcaacatatttatccaaatttaatttctagttttggaagtgtttgggaaagcccccaattaaagtagatacaaccactaggaatccgtaatcttctcggggtcaacgatagccggatcggcttcggttggttcaacaacagctgactcagttttggttggttcactggcagagagtagcttagaagagtttcccggctcagttccggcttcatgttcaacatccgggatgatcactgtctcactgttcacgaccggacagtagtatcgaccagttcactagagcctgaagcgaacgtttcaagtcagcaaaaaacacaaatacaacaactatagattataaggattcagatgtaaaagtttaccagcccaatctaagcctgattcactcaaaggcagtgattcgatgtaaaaatcctcgaagtgttgagggttaaaggacaaggtgggaagagaagcaaggtggcctcttttctcagctaaaacagcctccagtttggacctttcttgttcctcagagaaatcttcctcaagggtttggtccaacagaagcaggttactttcgtgctccttaatgtctgactccagctccgatctggccttctcagtttgaatgaagaggatagccccttgaatcaattccatcccgcgacctttcacctctcttctggcttttgacgtagacttggctaattcagcatctcaaagcttagcaattgctttgtacttagccttaagttcggtgaactgattgttcaaatcataagtggccgatttagattcagagagcctgtctcgagcagtcgagagttcatcctagagcttgtcgtatctttggtactgatcatgcaactcgccattcgatctcatgagcttagaagatagatggtcgactcgatcctctagtttctgtttaaagtcagaggaggagcggagatcggcctcgagggaagaaaacttgcctttccaagcatcaatatcctgttctatactgagcagtaatccttcatagtgctcgatcatgtcgttaagctcgttgttcgcctaagcaagagttttatatccaaaaaagtaaattagcatgcgtataaataagcgatatcggaataggcgaaaacgagactaacccgagatgaatgatgagcatggagtaaaaatcgctcgcgaattgtaggtcgccatttgtcgaaggtgggcaggatcgtgtctttccaggttttgaagcaccgaaagacgttgccctctttctccatcgctaatagggagtgaaagatgtgttactaaaagttcgaattataccgaaagcgagggaaataaaaccatcgtttgaacctataagcgattttgtttgaggaacgagaacgaccttcgactagggatgagtatctcggggctcagcatcttcttgtcgaggagtagcactttgatcagtcttctcaccactaggtcgaagagaaggagatgtgatacaggaagaggaggagaacccatcgatcaagatggaggagatgatcgaggagagcgatcagttcgagcccttgacttttccctccaaggagaagagctgttgcgagctggtctctctctctttttgcaaatcaagtcagcgattggcttgctgctcagtccatcacgggctgaagtcccgtgtggtttgggaggaagcggtggaagatgatggagttgtccaggaggactcattttgagattccatatagcttcaaaaaatcggtcgagggtaaacaaattccaaagggtttcaccttcgatgaccactttgaagaactcgatttattcttcagtcggaagagtcgcagcaatgaaagctgcacaaaaacaaaaacaaattcgggttaggaaaagaacgtgtaaacgaacagaagacaaatatgtttctgccctaatttctaccaggtttcgtggaccattttgatggaagcacttcggaaaggctctcaattgaagcaatggttttctttattaagaactaaggatggtgcgagttctcgtttttgttcgggagatgggaaatgaggtttctgttggcatttaggtatgccgagaagtaaccaactttcttcgacgaacttcttacgctaagaagctcgttcaattcgggaactccaattatgtacccagccaccaccgcgacggtgataatccctagaatagattggagaaggttggaggttaattgaggtagagcaatttcaagagcggccaagtaccgaacgagtgccttgggaagaggaaaggtcagtccgtataccgcgaggtgaatgagaagtcgggattaaaggtggttagattaaagggcctttgggctggaaggggaaagcccaggaagctcgaagtcaattcaaattcgaacgtttgaacaatgaattcgaagatcgaaacggatacatttaagatagaataattgtgtgtaaatgagaattaattgtaattcttaggtataaataatagggccaagggccataagagacacacgcatttgtttgcaaacttagtatacatattttcttacaaaactcatagctttctccataatcaatagttctttacacttatttttgtcctcaagaataatccgtctcactatacaaataaatatttgagtgtgtgaatccgacatccacaattgacaccccctataactgcatcgacatgttagtgtttaagggaattgaactaaaccacacttcagcatataactaggcgtaaaaacctagttatcaatttggcgccgttgccaattcattgttgcattgttacattcaagatatcagaaaaagttaagatcaagttcttttacattactcaagttactaactcatcttttcgtctgtttgtttttgtggtacaggtactaatatttgtgcatgcaaactcggtccaaaggttctgcacacatactacctttcaaagacaaaatagaaagaatagctcgtgagttacaagcaaaaaaaccaaaagcagactgtgatcaacaaagaccagttgctatggatcaacagaacagaccagttgatatacaagacccacctaatgttaacaaccaagatcaagattacgcaacaacataactgggcaaccaacttttaactgaagtaaatggttaggtaatccagaaatcttgattttattgagaaaatcaggcgtatatacggggtttttatctgcacgtgtgtcagaaggatcaatagaatcagaacttcgataaatcttttcttcacctgcaaagagtagtagttcattgtcatctactctattatatgtataattttgagtaatattcaaagttaattcactaacatgttagtttggaaagcatatgatcgttaattgagttaacatcatcattggttggacacaaaatagctctgtcttggaaaaactttggatctctctcttcagcaaaggatgtaccatagactgctttaatgatcgattctatagggtcgtcttcttcaagtataagaatatcatctggtatttgtatcttagttactccgtcgttaggctcatttagtttcccctcgctgactgcaaggatccatttcgaaaaatcctcaatctcacgtgcctcatttatgtctatatcttggagaagcctcatgttcttggtcaacttcaaaactttgcaatgctgccaaagataagacgaattgagtgacgatttgaagatcagttccctaccggttgcagggatgacaggaaagatttgcctaaaatcacctccgaaaagaattacttttccaccaaacggcatgtcttctggagtcgatagaatatcttttaaacttttatctaatgactcaaaacagtacttactcatcagaggagcttcatcccaaataatcaacttagctgctgttactaattgagcaagatcactaccacgctccatgttgcatgttgaggtctcatgaggagttagaggaataccaaacctagaatgtgcagttcggccaccttctaataacagagatgcaatgccacttgacgcaacgtttaaacaaatatctcctttacatcttatcgttgtggatagaaccttccacaaaaaggttttccctgctcctccaaaaccatataagaaaaaaacacctcctttgtcattaaggacagcatccataatttcatcatataccttcttttgttccctagatagcatctttaaccaatcatcatgtttttttttcaatgtttcacgattctagtagcgctcatcgagtatcaactgattaaaggaaggttcatcgccaggttcaagctgcggcaacatcttatacctccaaagatctgctccatgccgtttcaatattttttgcaactcttttaaacataaccgaatcctcaaataagatggaacctcctcagcaaccgcagccctctgctgcacctccgccactcgtggcgcaactggagtctgcactggtaccacacctggtaaccgctccaacaactgcctcagcaggcccgccaaactaacctctggaacctgggctcctctggctgcggcacccatcactcctgggccctcaacacaaccggcatgcacaccggcaccgacaccagctccaccagcccccactccggctgcaccagctatatcggcacaaagaccgtccccaaccccgagctccacaaactcaggctacgaatccacactctgctcaaccgtggcactgtggtcgtcactctcgccagtaccctcgaggactcgtcctctaccacgaccacgaccacgaccacaaccacgaccacgaccacgaccacgaccacaaccacgaccacgaccacgaactccagctccactaaccatctgcgctgctcaagaacaaaaggctaagaaactagaacaacaaatatatcacaaacaacttacaatggaatctcatttaaggctcggagaagatgatgctaggactccgacaacacacaattgactaaacactccataatcaatcctcaatatgctaacaccctagctcatcccacatcaatcatcaggaaaataattcatcaattaagttttctacacatcctagaaccgtgatccctctgataccaaattgaaacaacccgacccatttttaaaaaaaatataattaaatattcccataaatatctaattaaaccaaccaataaaataacaattaaaccgcaagttaaaaatactattttatgaataaataaataattcaaccaacaaaaccaagaataactaacaatcctaaccgggttccaataaccaaaaacacaaaaaataaaacaaacgagttcctagatcatcctctcttcattgccatgattccacgatcacactttatctttaccttcatcaacaacacaatgagatgcgtaagtattaacataaatacttagtgaggcgatcctcccatctacgagctatacacacaagcaaataaaagggtataatcacaaatacaacacaaataaatcagtcattgaacaattcacccaaaacacattcaccgcacctacttatcatcacacaaaacaaattacacaacccaatcgctcagataagctcatggtcacacactcaccttaacaaattaattctaataacaattaaacccgggagagactctcctagcgtctgaaagagtccagaaacgtcctacaacaagtcacaaccaaaagcaaccttgaagcaaactgtacatgaaaaacagaaacaatcaacctcaaagacgaaaacctaaaatacaaactaaccgttaactattaaatcgctccagtgaaacgttagccctagacgtcacgaagcttcccacaaaatattgtcccgatcggaaaacaaccgataccacgatcgcaatttcaatctccgctggtcctaattcgcgtctgagaaaacgtgtctcactaaactgcgaataactcaaattgttttaatccaaatccagttctgtaaactggagaataacgataaacgacttgggaataattctactaaatttcgttaccttttaccatgatttgatatgaccaaactgatttttcccaaaccctaacgattctgctccttttccttttctctctttttctcctttataaaacgaaaagttgctaactaaagccctaatttcgagtttccttcttttataggcacactttaggatttccaattaacccaaccaattaaaccggatgatttaaaaacaaaccctaaccgattttccggttcacgggtgttacaattctctgtatgttttatgaacaacaccctcgacggttttgatatcattatttgtttctcctacattgttttgctcggagacaacttcttttcgatgaggctctatagagacggttacacgatcaggtcccttgttaacatacttgaataagtatttaagagagacggattggttaaaccactctacattgatgtgagccctgtatttccgtaataggacatcgttatatggaacaacatactggttgtcacatggatacttattcttctcgatgaaacgaccagtatctttgcgcctatatttggataaccttcattgtcaagagacgtgtcctcaacatggttctttggataatacttggaacatttaccattttccatgcatggcgaattaggattaaccaatcggcatggtccatgaatcatacattctgagacagcttgatatagctctggatctttttctttatctggaatttcggcaaaaataatcttgtcaacatgatcagccgtaggaaacttgtatctaggatccatccaaacaattatgtgagcatgtggaagacctcttttttgaaattctactgtatacataactgtttcaacataataattatgagttaatgtcacttgtaagttaaaattcatgaaatatatgtataaaaatatgaaataatgtagtacctgatttggttttgccaaagatatgattctttgttatatcatccatcaagttgtcgagtttcattttataaatcctacaaatgatatccggcctgtcctcagcattcaacttccgctcttttacaaatcttgtgatctctggccacttaggattacatgtgaaggttataaataggtcgggaaagccgaaatgtttacaggtacccattgcatctaagtagttctgctgcatataagctggaccaccgctgaaagatggaggaataataacactttttcctttattagaaagatcattacccccagcatcagaagcatcttgaactgcctgcttgttggtactgcgcagcttcgtctgattttttttaataaatcttagccgattagactctatcattgtaaaagcgtcaactatgaattgttgaagtaaacgttttgagcaaaggaggatgtgcttctcatcttttctctcttgtaaacggtagtcaaaccactgcctcatactaacatcttcctgcttcttctttccttttgaagttttggtaggagttttttttattccaagctt

SEQ ID NO: 199 - DNA, 101786 bp, Arabidopsis thaliana
aagcttgtagagaagtacatgttggttaggatttgattagacttgttaggcatatggacttagtttggatgatcatggcaataagctagaaaatgttgggagttccttagttttcaaaacctcttccacgggttcggcttttgtgttttgcttgagggctaacaaaagctaagtctgggggagttgatataacccaattttcactgattttatctatgttttaggtataggattttgagtctttatgttatttctcgagtctttttagtgtcttttcaggtattctatgtagtgtgacaacaatggagataaggagacattttagagcaaaagctaaggaaaaggaagttaaggacgattttggattcaagaatcagagagagtgtcgatcgacacactccttgtgtcgatcaccaccagtttcagccaagcaaagtccatgacgctttcaagtttatagaagaggaaatttgccccagaagacttccctatttgcatcattagtacttggacgttttatagggttcttatacattgtttagacctaagttttcttttatcaagctttttgcaaaaccctattttgagagacataagctattcatcccctattcttcagagattcattcagcttttaatacggtgaagagatcctttctttccctaatctttattgatgtgtttatgctttctatctcaattatgttgtttgttcattcaatatgtctgagtagtttgattgttaggaatagggtttctcattaggaattcatatggtttagtagattgccccctttgctaggttatctgtataattcttcatatttgattatgcttaatgttagatctagagtaattaactagatcttgaatccagacaatagatatgcccaccataggtatctgtagttagacctattatttgatgagcctggtttataggtgtgtattaagaatcggcctatctactaaggtgaacaatcgaactcgttaagaatgcatgtttaggttaataatctttcggcttgtccagttttcttagccataggcatacggagtttcgcggaacaccaccggttattccataattagagttttgagtttaagaatggttcgataataacctagctttcattagatctactaaccaatatttttctgagaataccctgttcctagctctttatttaatcgttacaaccaatcaatctgctgtcttcttactttgttttcatattatttcaatcataccctactagcttaatcttaacattgaattcattgtgtgaataaaagaactttgtggaaatcgatccttaaattctgcaattgatctcttatttgagagagtagttcttagggaatttcagccatatcaattatctttattaaaaatgttcttattttaatcgttacgctaaaaagtaaacgattaaatacattaatactaaattccactaaatcgcaaaaccatgctttcacctaaaccgtaaacgcgcattttccgctagaatcgcaaaaccctcttttcagccaaaatttgctatttgatttcccgattttgcagtttacgcttttgcaaacaacaataaattttttaagtaagagtatcagttcagatcaaaaattattattattttattcttatcttgtttattttgttttaaaatcgtttttattttgatttgggacctactacaggaaattaattttattgatacataatatttcgtcactatgccaacaaatctgtaacaatcaaaatataatgatgaatttgagactaattgtcaacggttgcaatacattcgtcatttcttactagtgatgactaaaaaactgtcacaattatgttatttcttacgacggaactatagtcattaaatcgtcagaatcatactgttcctagtcagtctctagttataactgaaaatatgttatcactcggttctcatttccaactattttaccatcccaaatttgtcacattttagtaccacaattctatcaaaatatttcataattaagaaactatttgacacctatattagtcactatctttactacattattttcagaatttgtgatattttttcctctaaattttactaaacaaaattagaaaaataaataaactgaaagtaaattaccaaagcaacatccaatttaaaattgtctaaaaagaaataaatgtgatatggtataaaatgaaagcaaacaaaagtaaagaaaccaaatcaaagtaaaaccaaataaaaaccaaagtcaagccatattacctggtctaaaatgaaagcaaaaaaaagcaaaataaacccacttaaagtaaaaccaaatagaaaccaaattcaaaccatattacgtagcacgagaaaatgaagaaaaccctatgggaacttgtggagaagaagaacttcctacaggtggaggaggtggagctgatgcatttaactcactctaacgggcaaaagtttgaattagttgctccacatcttcgagtcgaacaagcacattatctttacgactcttttgcagttcaacttctagttatttcactcagagaattaatgctcccacttcttcagtagcttgagggggaactaggtaactatctgacatggaaaccctactttgaagtgattttagtccagatacatgaccttgttttgatattccagcaatctagaaaaaaagcataaattcatgaataatgagagattttaaaatacaaactccttcaaagctccaagaaaacaagtagattcaagtgaaaacaagtgaaagttaccttaacatagttttcattttttttcttctatggtaagagaatccattgtcaaaacctctccattggaagaatccgtttgtgtcaagctttcaagaagacattcatcatattgttgagcaattagtgttgctctttcatcaacatatgttccatcagatttttggtgtattgctctcattacagcaatgaaggaagagtcttcattatttgcttcctgagaacaaaacaataaaaaggtaaataactcttatcaaacgttttgaaagaaaacataactgttaccaaaattaaaaattaataattaccaagccatcttgaactttagcatacaaacatgaaccagttctgtgataatgtggacttaaatcatcacgactaaatagtcgtgaataacgagcattttcacttttttctttggctttaagtgtcttccagtaagctaccattactttccaacattcagccagaatccagtcaagttgtttttctttgaactttgcaagactaaccattcctttgaggagagcagctacaagggcatcaaagttggctttaactagattctcaatcgaggcatcccactcaaaccttgtctaaaatatatctatgtaagacatgtattaaacaaaaaattatttttgaaaaatagtttatatataactaacacacaccttaaacgttctaaaccatgcatctttataaaattacgacacttttctccagcaataccaaggtttcttaaaacaccgttcaatgatatttctaactcgcgttgatacttcggtgttgtttttaaacctgatacatatgtatttaaattatatttataatttattttgttacattaaacaatgaatgaaacaaaaaaggaagaacaataccatttaactccatttcttcgagaggggtgaagcactctctgaatatcatactataaaggtgcaattttgtaacgttcctgaaccaaaaaatcggttagggtttgtgtttaaatctcccggttaaataagtttggttaatggataccatagagtgtgcctataaaaaaaggaaactcaaaattagggctttagttaaccactttgtattctgtaaaggagaaaaagagagagaagaagaaggactagaatcgttagggtttggcaagaaacagtttcgacatatcaaatctttgtcaaaggtaacgaaatttggtagatttatttccaagtctttcatcgtcattctatagtttacagaaacggatttggatttaaacttcttgagttaatcgcagtttcgtaagacatgttttctcaaacgtgagttaggaccagcggagattgtaactgagatcgtggtcttgtctcgtttttgatcggcacgagagttcgtgatcgtggaatcatggcaaggaagagaggatgatctaggaactcttttgagctcatttaaaagtgatgcttacagtgccacaattgagcagagtgtgggttcgcagcctgagtttgtggaggccggagctgggaacggtcttggtgccgatatagctggtgcagcccgagtggcgctagtggagctagtgtcggtgcatgtgtgcatgccgttggtgctcaggtcccaggagtgatgggtaccgcagccggaggagcccaagttccagagattggcttggcgggagtactaaggcagttgttggagcgtttaccaagtgtagtaccagtgcaggctccagttgtgccacaagtggtggaggtgcagcaaagggctgcggttgctgagaaagttccatcttatttgaggataatggagcagttgtaaaggattggcaccgggtatttctctggtggtgctagtcctgaagaggccgacagttggcggtcgcgagttaagcggaacttcagttcgagcagatgcctgatggagtatcgggtggacctggcagtgcattttctagaggaggatgcacatttgtggtggaagagtgtgactgccaggaggaggcaggcggatatgtcttgggcagattttgtggttgagtttaatgcaaagtactttctgcaggacgagctcgaccgtatggaggtgcgttttcttgagctaacactggttgagcggtcggtttgggagtatgaccgggagtttaaccgagtcttggtgtatgcgggttggggcatgaaggatggtcaagccgagttaaggaggttcatgaggggacttcgaccggatctgagagtgcggtgtagaatgtcacagtatgccctgaaggcagcattggtggagacggctgctgaggtataggaggatcttcagaggtaggttgtggcagtgagtccagcggtacagccgaagaagactcagcagtaggtggcacctagaaaaggcggcaagcctatgcaggggaagaagaggagctggaatcatctttctagagctggacagggtggtcgtgcgggatgtttttcttgtgggaaccttgcccacaaggtggcagattgcaagtagcgagttgagacgagagagtgctaccattgttgggggaggggacatctcatgccgaattgtcctaagctccagtggatggcaatggcagtagtatagccaccggtgtagcggggagtgcaacagaatgtgcagcagttggcacatattccagcggcaccacaatgctacaatacgtttgaggcaggcggtaccagcaccggagtgatcactggtatgatttctgagactcaaactttgtgaatgatttcttttgttttggatatcattgcttaatgatgaatgttagggttcttagcacatgagatatgtgtaggtaccttattggtgggcggtgtagaggctcatgtgttgtttcactcaggaacatcgcattgctccattaccctggagagtgcctcgcacagcaacatccgtggagatcctggtgagcagtttggagccgttaagggtaccaaaggacattttctagcggttctaggagagttaagggtgtggaaattcatattgcggtggagtcgatgccagcaaatctgattatcagccatgtagaactatattatgttattttggggatggattggttggatcattacagagtacatcttgactgcccccgtgggagagtttcttttgagcggcgagagggaggttggtttatcagggagtgagacctacctcagggagtctagtcatctcaatagtgcaggtagacaagatgatcgagaagggctatgaggcttacctgctgacaatatttatgcaggtagcagtgagcaacattcgggttgtttaggagttcgaggatgtatttcagtcggcgccaaatttgatatagctccaattggcttaagcttactccctcaaataagagatcgtcgttagcacttaagggtcgaattccacaaagctgtcgatgttcacgcaataaacttatgaagattttagttaagctatacaaactataataatttaaaaatcatcaaagcaagtaaataagttgtagattcaagtgattaaagcgtcgggtctaaggaattgtcttgggagatagataaattgtagatctagctaatattaggactattatcgcaccgctcttgaactcaaactatgattttagagtaaccggtgatgctccacgaaactctctttacttagagcttaagatatccgaagaagccgagaaatcctatactaaagcatgcatttttatcaagtttgattagttcaccgagtatctaaaccagagcccttctatgagcctacctgttctttcttaaatacctagactcatgtatgatagttcaaataacaagtacttatggtgggcatacctattatctaatatcaagttctaggtgatcaatctaagaataatcaagatgaagaactctaagaataattctaaggggttttcgatctactaatccatctaaatccctattaagacaccttaaacccaacaaggtgattactgagacatgataacagaaacacaaatcataatctgaatagattgcattgatgaattaagaataagagtaaaaggagttcaaaatcatctctctgcatggattggattcttctctccaaaataaaacaaagctgaggtcttacaaatgaccaaataattaggtatataagtgactaaaaacgtgcagggactactttacaaataagtaaaactttagggcttctcaaagacttggcagaaatcagaaattccctcagccgaaataagggtgtcgatcgacaccatcgcgtgaaaaacgtctttgataatcttcattgctgaaaagctcccaaaattccttattatgcttcatagctcccaaatgtgtaattgcacctgatatgactcaaaacatacgaaaaggactagaaagactctaaaaaccattatgaaattatattagaaatcagtaaaaaccaggacatatcaactcccctagacttagcttttgcttgccctcaagcaaaactaaatattgaatatgtgaaagaagtttaaaaacatagaaactcccaatctctctagcttattaccctgatcatacaaaccaaatccacgcactaaatagttctattcaaatccagaccaccatgtaattctccgctagcttacacaacatcctagattccatactaaagcactcaactatatccattaggctctcatcgttgggtcttatcaatcaagttaatgttaagaaccttctagagtcattcctgtactataacataacaaatcgaccattcattttctttatatttctggtattcttcctcttcccaagacttatttctttttaaagagtaaacaaaggggaactcgcatactggattgacatcctcggcatttttccaacctttgtaattgatcattttaaacaatatataataatggggtcataggaaacattcatacccctatacactatatgaaaatcctatcaatctcccatgtattatattattatttttttatcaagggagaggaaatactttctttttatcgcattagtcgacttataaggtaataacaaggagtcaagcattttctacttttttcaggtctttacatgtttgggatgcatttggagattatggagcattctggagcaacaaagacaacttaagctgcacaagcaattcggagacggaaattgacgtaggtgtcgatcgacacaacccctggtgtcgagcgataccaatacctgacggtaattcaattgcgcaacttattcatgttttgaagatttccaaatttggcccagaactttctcttatttccaaagaaggcccaaacgtttttagggcttatgtattgatttttatggtcattgtttagacctaactcttattatctcttttattcttgggagcaaaaccctttggagactccctttagagaagattcttctaaactcttttctcttcttaatttcatcattgatttcttattcaatcatattttattcttctatgatcatgcttgagtagttctcttgttgggtttagggattctcattagggatttggatgaattagtaaatcgaaaaccctgttaggataatatatttagaattcttcatcttaaattgttcttaatgctagttttagggtaactaactagaacttgattttaggataataggtatgcccatcatagttatctattactggaaataccttagatgagcctagtatttagatgcgtgctagcgtccattacttaggtgaacttatcaaacctgtttataatgcttgcttagttctagggatttacaagagagttgggatcaatactattaaacatagtgaggtttgcggaacaccaccggtcactctatattagtgatttgtgttctagaatggttcaataataaccctaatttactgctagatctactattctgatattttctgagaatttccttaaacctgacaccttaatcatctgaatctaaaaccaacttttaattgctttcttgtcttttacttttataatatttttcagtttagctttattcaaaacagttagcctattttgtgatccgagaactttgtggaattcgatccctaagtgctataacaacctctttatttgagagagtagtcattagggtaatttgactcatatcaaatttggcgtcattaccgaagttctctttgattcaccattagattaggtgtagaatttagtctaagcttttcttttcttttgatactcatgtatttttatttcttcttcttcttgtttttcaagagtttaaggaattcaaatgcaactacaagatgctgatagtaataccagatgttgctggagtgttacgcgacagagctggtcaggcatacaacgaagagggtcagaaaatagatgaacagggaaacttgatacaagaaatcgccgaaggtgttgatcgacaccaagaagaaatcatagcagctggttgtccgatgactcttggtgactacaattgaccggatctcttctattccaatcggtctgcaatccgaccacctacattcgaaagaagcaatttcgagataaaccctgctttctatactcttgtgagtacccacccacctttgcgaattcagctcaatgttgtagagcttgggttagtgttttcacattgatcctctagttagactgataaatcactaaaatacacatcaataggtccaacaaagcataagatattaagtgcaacaagtttcaaaacaaatagcaaatagtatgaaataaagcaaaaacagggttagaaaacaaagcaagatagggaggatggctaatcctcatggtccgagctggaggtgggtgcgggaaagcgacgactgcgacgagtaggagacacacaaccgcagtgagagagtgtagctatggcgttccaaacgctcttaaagctgtcaacgacgtactgctgaaagaccagtggctccatcgggataggaggagaagaaggcagctgatatggtagagctgaagaagaagagctaactcaaggaaccccagcagggtcaatgaactcatcctcagtctgtgtaggcgtagatcctgaagctgaacctctctttcttttggtgcgtggtgcggactgcagaagggaaggatcgggacaaaaaccaagctcctcatgctctcctgtaatctatgtaagcgcagggcaaggtaaatgaatcatatggtgccctttatcatctcttaaacaccaaagtaagttgcccttcagccagtgagagttcttcagataagtctcatccctagtgaatctcgtggtgttgacctcctctccctcaaatctgatgcgacagtgctgaaatataggagtgagaagactgccaactctctcagatttcttccctttacctgtaaagggcttggtattgagagagaccaagtgatgagcaaacacaacgccaaagttgacattgcggtcaacctcctcaaatcgcaagctatctggaaagaaatcatgaacagcatgataaagcaacaacaacttggaaagtctcatcttgccaggttccatcttgcacaagagcgtgttgctaattagcctaactaaatatcgtagaacaggatgacgaatctcttattgtactgcgtctttggaatcataaatttcattgccaaacctgctccagaatatttgagtatccctatactgtccaggaagtgaaatcccagtgctatcattctcaaagccgtagatgtcacataagtctctgagttgtagactgtatctaacaccgcggatgaagaagataacactacaaaaaaaactgaatattcttacggaaaaattacgaccattattttcgtcagaacattgtgaccattttcatacaaaattgtgacgtatttatttggtcataaaaacgttactatttcgttataatattatgacttaattgaatgtaactaatgtttgtcactaattatgtcaaatttgttacaaattatatagtcataaatataagtacggatttgtgaccaaatatggtaactaaattatacgataattgtgactgaatttatgtcatgtatagttacgagaattttgtaacaacgatgacacaatttgtcactgttttagtgacttttgcgtttggtcatagattgtgacataagtgttaccaattttaatacaaaaataaaaacttgtgaacaaaaaattaaataaaaaaacttcttcagttttggaaacaatgtttttgataatacaaaaaaagctgtaaaaagtccaaatgaaaaaaaaaattattcggattcgtcactagttaattcgatatcagaatttccatcttcagcatctgatccatcttcggcttctactactggatcatcaagatcttctggttgggcatctagatatgatagtgtctcgatttgtaatgaatcaacttcaataatagaatcatcgttatcatgctgcattgcagtgaaatccagatttttgtttatcaatactttccctctcggttgtatcataattgctgcttcccattgttgatcttttctcggctgagtcatccgtggatatgaaacataacatacctgatctgcttgtgaagccaaaacaaaaggatcatactcttcataatgccttttagaattaatatcaataatccctgacttgtttcttcgtatacctctcccaacttttgaatcataccaatcacacttgaagaccacgaccttgagatcaacatgtccaggataatgaagctcataaatttctctcaatattccgtagaaatcagcttcttcatttgagctagaagatgttgtacctttgacacaaactccataattggcattctttttgttctttccatgatcatatgtatgaaatatgtatccacgacaaaaatacattggccaacaagtaactttaaccattggaccatgaacgatactcaacaaccactctggatatgaattatccttccaagtatcctccacctgattcaatataaaaaaacacatactatattataagctatcaagtatttatctcatataaaaaaaaatatcttacatgtttttttaaccagcttgaatattgcttttctctaagctcatttagatctttttcacttatcccaggattagccgcgatcaagctctcatcaaacaacctatatatacatatataaccatgaaaaatatttataatgtcttttactaattctacaaaaaaaacaaaatccatacagatgtccaaattattttgtcatacctttcaaatggtctaattgatcgcagttccgcaaaatatatctatgtgcgatatggtaatctttatcttggagccatatctcactttctttcccactgcctcttcctgcctgagaaaatatatctggaactccatcaaactcatgtgtatcttcttgattaccaccatcatagtgtcgatctcctgctcgattttttgtcttgatgtgtcgatcaaaataataagtacaaaaagtagaaatttcttcattgatgtattgctcaacgatcgaaccttctacttttgccttatttttcacctttttttttagatgtcccatgtatcgttcaaaacaatacatccatctaaactgcacaggtcctccaagactagcttcgtgtggcaagtgaattagcaagtgctccatgacatcaaaaaaagaaggaggaaatattttctcgaggttacaaagaaccatacaaatatttttttgcaacatttcaataccatctttgtgtatagttcttgcgcataggtcccgaaaaaataagctaacacctacacatataaaaaataactgttatatgaagaaatagtaaatgttctcaaaacaatatgaacaaaaaagttaatgataatttaaaaatattctcatatctatatgtttttttatctctatgagctatataattatgatttttttttaaaaattaaatgcaaaaaattacaatcatgctcagcttccaattaaaaaattaatagattcacataaataaaaatatcgctatcaacggtcttaattaaaaactaaaaaaataacataaaaatgcagagagattaaaataaattaatcgaatgttgaaacttactagatagcgcatcgtgtacagatttatccataagctcagcaaaagctattggaaagagtctttgcattaaaacatgacaatcatgacttttcatccctgtcaattttcttcctggtagatcaacacagttagctaaacttgatgaatatccatctgaaaatttaacatctttttcgagccatcatagaaatatctctttggcatcaggttttagtctaaactttgggattggtgccttgccctcaggtgttaagtgcaaatctttgcgattacagtgctcctgcaaatcaagtcgtgatttgatgttatctttcgtttttccctgcacattcagtaacgtcttgatgaaattatccaaaacgtttttttctatgtgcatcatatcaagattgtgtcgaagttttagatctttccaataagatagctcccaaagaatgctttgcttatgccaattatgcgttttaccgtatccttctaatcgtccatggtttcccccgcaatcaactgtttttggtaaacaacaaacttcattataaagctcctcgcctgttagtatctccggtggactatcttccacaacctttccttttttgaagtctttcttattccctcgatagctatgattaaccggtagaaaacatcgatgacaatcaaaccaacatgtttttctaccattctttaaccaaaatgcaccggtttgatccgaacaataaggacatgccaaccgaccatgagttgtccatccagaaagcataccatatgcaggaaagtcgcttattgtccacatgagcacagcttttaagagaaaattctgcttagtagaaatatcatatgcttcaacaccgttaacccacaaatctttcagctcttctatcaatggttggagaaatatatctaaacttctcttaggatgatttggaccaggaactagtgtcgttagaaacataaattcttgtttcatacacatctcaggtaataaataggcttgcttaattagtttttgtttattaatttcatgctgaataagtttttctagattgcatgaaatagaaaaacaagtttttattgtgatttaataatcatatcaatattcaggttttattgtagtcgaactacgcctaagtgtatgctggtccggggagctattaccatagttattatagccataaaaccttccactcgtctaatatttaataagaaagcaaaacgaattctcgataaattattcatcaaaatttacataataaatgtgtatttgtttttagaacttataaatggacataacaactatagtagattcattatagttaccgatggaacatcatgtaggtgaaagaacggagaagaacagtaaggacaatgatattgtgattgacgacaacatggacaaccatggtactgagaatttactataggttacagggtaaaaaaaaattaaagaatcaaccattagtgatacaacaatttgaatatatgttaagtcattagaaaatatgtttgaaatttttgattgaatgtttttaattcacattttaaaaacaaaagaaagtttattaaatatttattaacaaactatatattaaaaacacacatcttatctcaaaattggctctaatacaccttaattttacttaaacaaaaataatggtttagaaaaaagaagtaaaaattttaaattacaaaatctatggactcaccggaggaagtagcggtggtggaggaggaggaggatgaggaggaggaggaggaggaggaggaggaaaggtgagatgctaagctcgaagcctaacttagaacagaaatggaattcgatgagaagagaataaggtaagagacggaagaaagttagagtaggagaataatatgattttcataagataaggaaaccctaaagtttgggatccatttaaatacaactgagtttaataaacgatatcgtttaacacaaataaacgacattgtaaaactctacttgaaacagaggcttctcgacacttcttctttattttttttttttttttttttttttgttcaaagtctctacacttcttcttttcttcacttctagccacttttcaccctctgtttcttctcccatttacgagccctccttccactggttctcatcttcttcttcatgaaagctaagggtatcttcaacctatcagagtcgaattggtttatctcggatccgttcagctccagctacttggattgaaaccctactcgaagaagatgaagaagaaggtttaaaacctaacctttgtttaacatagcttcttagagtgtgaacgagtcgtgactcgttcgagttcccaatttctgttgattgtacgattatagtttaattgggtgtttgaattgggttttgaattcacgattatagtttaattggatagattgagtgatatctcttataagagctccttcctgagcattgcgcttcctgtcattcacatagtagaccctaacagaagccatgaagtgcctaactagctaaggatacaaatcgtactgcctaaaacagatggttcccaaacttatgccgtttagcaatcctaaaacagatttctctatcttcaaacgctgcatcaaaccgaaatccgcaatccgagtaggcaaaatttccacattcatctaggcattatagaacatagtatcataatcatctcaatctggagaaaaagggcgattgatatagtcacttttaatgaattctttgttgatatccctttcccaaactctttgagaaagaatccactcactaggcaattttggccatggaaatcggaaatcggaggttgatctaggtattataaaacatagtatcataatcatctcaatctagaaaaagggcgattgatatagtcacttttaatgaattctttgttgatatccctttcccaaactctttgagaaggaatccacgcgcttcctgtcatttacatagtagaccctaacagaagccatgaagtgcctaactagctaaagatacaaatcgtactgcctaaaacagatggttcccaaacttatgccgtttagcaatcctaaaacagatttctctatcttcaaacgctgcatcaaaccgaaatccgtaatccgagtaggcaaaatttccacattcatctaggcattatagaacatagtatcataatcatctcaatctggagaaaaagggcgattgatatagtcacttttaatgaattctttgttgatatccctttcccaaactctttgagaaggaatccactcactaggcaattttggccatggaaatcggaaaattggaggttgaggagctgcagctgatgattctagtggtggaggacgagcgccggcggtggtggagatgctccagcaaggatgagcggcggagaaagaaggtggtccgacgttcttccttgccttcttttctgttcagccatattgcagatggatgaaatggagactttgagaagatagagggtgaaattctaatgagattagagcctgaaatcacaagaaacggtgaagaatcaaagaatctagagaagaagtaaacgcaaaaaacctttaaaatttgaccattgattacgaaagatcatccacgtttctaaagttaatttgaatactcataacttatgtataaatgatgttaatttaagcattgaacccatatccaataaataagtatgtataagaaaattaaaatatttaaactcatttaggggaaaaaggttaaatggggttaaattggtttgtctaattaaatctatttattaattggggtttaacagaaataattgaatacacaattaaacctttttcatagttatctttattaaacaaattaatatctctatcgctaaaataaaagagtaaatgattaaataaattaaaaccaaattccgctaaaatcgcaaaaccatattttcagcccaatagtaaacccgcatttttccgttaaaatcgcaaaactatattttcagccaaaatctgagatttgatttcccgattttgcagtttatacatgtaccatcgacaatggatttctagggtaagagtataagttcggttctaaattattcattttttcttcttatcttgtttattttatttttaaattcattcttttatttcgatttgggatatgtgacttatctgataaagaactcgttcatttttttgtcttaattttttttattaggagtggaagtgaacaaaaaaaaaatcgctaaaatcgcaaaaccatattttcagctttatagtaaacccgcattttccgctaaaatggcaaaactatattttcagccaaaatctgagatttgatttcccaattttgtagtttaaacatgtaccatcaacaatggatttctggggtaagaatataagttcacttctaaaattattcattttttattcttatcgtgtttattttgttttttaaaatcattattttatttcgatttgggacatgtgacttatttgataaagaacacgttgatttttctgttttaatttttttttattagaagtagaagtgaacaaaataaaaccttcaaaacttcagcgtagagtcaacaagtcatccatgtttctaagattagttttgatattcatattttatatataactgatgttaatttcggcagtcaacaaaaaaattagaacccacatataataaatgggtgtgtataagagacattgttccatttaaactcatttaagcaaaaaagttgtaacgcccgtgaaccggaaaatcggttaggatttgtatttaaatcgtccggtttaatcagttgggtttattggaaaccctagagtgtgcctacagaagaagaaaactcaaaattagggctttagttcgccacttttcgttttataaaggagaaaaagagagagaaggagaagaaccagaatcgttagggtatgggaagaaacggtttcgacatatcaaatcgtggttaaaggtaacgaaatttggttgagtgatttccaagtcttttatcgttagtatccagtttacagaagtagatttgaattaaaattggttgagttatttgcagtttcgtgagacacgttttttcggacgcgaattaggaccagcggagattgtaactgagatcgttgtttcatctggtttccgatcggcgcaagtttttgtggggagctttgtgacgtctacggctaacgtttcaccggagggattgattagttaaccgttggtttgtattttagggtttcgtctttgagaatgtttgtttctatttttcatgtccagtttctttcaaagttgcttttggttgtgacttgttgtaggacgtttctggactatttcagacgcaaggagagtctttcctgggtttaattgttgttagaatcaattcgttaaggtgagtgtgtgaccatgagcttatccgagcgtttgggttgtatgatttgttttgtgtgatgatatgtaggtgtggtgaatgtgtttttaggtgaattgtttaatgagtggtttgtttatttttaatgactaacaatcgtatatgggaggatcgcctcactaagtatttgtgataatacttacgcatctctttctttttggtgcaggtaaagataaagtatgatcgttgaatcattgcaaggaagagaggatgatctaggaactcatttggtttatttgtgttttggttattgaaccggttagggttgtgttaggattgttaatcattcttggttttgttggttgaattatttatttattcataaaatagtatttttgacttgcggtttaattgttgctttattggttggtgtaattgagtatttatggaaatatttaattatgtttttttaaaaaacaacgggtcaggttgtttcaatttggtatcagagcgatcacggttctaggatgtgtaaaaaaattaattgatgaattattttcctgatgattgatgtgggatgagctaggatgttagtatactaaggattaattatagagtgtttagtcaattgtgtgttgttggagtcctagcatcatcttcctcgagctttaaatgagattccacggtaagttgtttgtgatatattcttctgttctagtttcttagccttttgttcttgagtagcgcagatggttagaggagttggagattatggtcgtggtcgcggtagaagacgagtccttgagggtaccggcgagagtgatggccacaatgcaacagttgggcagagtgtggattcgcatcctgagtttatggagcccggggctggagacggtttggtgccgatatagccggtgcagccggagtgggggctggtggagctggtgtcaaggccggtgtgcatgccgttggtgctaaggacccaggaatgatgggtaccgcagccggaggagcccaagttccagaggttggtttggcgggcctgctgaagcagttgttaaagtggttaccaggtgttgtaccagtgcacgctccacttgtgagtccagcggtacagacgaagaagactcagtagcaggtggcacctagcaagggcggcaagcctgcgtaggggcagaagaggaggtaggatcatccttccagagttggacagggtagtcgtgcaggatgtttttcttgtgggagccttgactaaaaggtaacggattgcacgcagcaagctgagacgagggagtgctaccactgcagggagaagggacatctcaggccgaattgtcctaagttgcagcggattgcagtggctgtagtacagccggcagtgcaccagggaacgcaggtgcagtaggaagtgcagcagttagcacatattgctgccggcaccgtagggttacactacgcgcgagataggcggtaccagcaacaaagcaatcactggtatgatttctgagactcagactttgtgaattatttcttttgtttttggatatcattgttttgtgatgaatgttggggttcttagcacatgaggtttgtgtagggaccttattagtgggcggtttagaagaccatgtgttgtttgactttggagcatcgcattgcttcattaccctggagagtgcctcgcgcggcaacatctgtggggatcctggtgagcagtgtggagccgtcaaggttgctggagggcagtttctagcggttctggggagagctaagggtgtggatattcaaattgcaggggaatcgatgccagtagatctgattatcaagcctatagagttgtatgatgttattctgggaatggattggttggatcattacagagtacatcttgactaccaccgtgggagagtttcttttgagtggccagaagggaggttggtttatcagggagtgagacctacctcagggagtctcgtcatctcagcagtgcaggtagagaaaatgatcgagaaagactgcgaggcttacctgttgacgatatctatgccggagtctgtggggcaggtagcagtgagcgacattcaggttattgaggagttcgaggatgtgtttcaatcgttgcagggattaccaccatcacggtttgatccattcacaattgagttggaaccagggacagcgccgttgtctaaggcaccctacaaaatggctccagcagagatgacagagctgaagaagcagatagaggatttgttgggtaagggattcattcatcctagtacttcaccttggggagagccggtgttatttgtgaagaagaaggacgagagtttccacttatgtattgactgccgggggttgaaccgggtaactgtgaagaacaagtaccctttgccaaggatcgatgagttgttggatcagttgagaggtgccacttgtttctcaaaaatcgatttgacgtcgggttatcaccagatcctgatagcggaggcagatattcacaagactgctttcaggacgagatatggacattttgagttcgttgtgatgcctttcggtttgactaatgcacctgcaacgttcatgcggttgatgaacagcatgttccaggagtttttggatgagtttgtgatcatctttattgatgacatttggtgtattctaagagtcttgaggagcatgaagtagatcttagaagagtgatggagaagctacgggagcagaagctgttcgctaagttgagcaaatgcagtttctggcagagagagatgggttttttgggtcacattgtttctgtagagggagtttcagtggatctagagaagattgaggctattgagactggcctagaccgatgaatgccactgagatcaggagttttcttgagttggcagggtattacaggaggttcgtcaaggggtttgcgagtatggcacagccgatgattaagctgacagggaaggatgttctttttgtgtggtcaccagagtgcgaggagtgtttcgtgagcctgaaggagatgttgacgagtatacaacgttagcattgccagagcatggtgagccttacatggtgtatactgatgcctcgagagttggtttgggttgtgttctgatgcagcgtgggaaggatattgcctatgcttcgtggcagttgaggaagcatgagggcaactatcctactcacgatttggagatggctgcggtaatctttgccttgaagattttgaggtcttatctttatggcgggaaagtgtaggtgttcacgaatcataagagtctgaagtatatcttcactcagccagagctgaacctgatgcagaggcgatggatggagctggtggctaattatgatctggagatagcctaccatcttggtaaggctaatgtggttgcagacgcgttgagccgtaagcgcgtggggtgcagcaccacggcagagtgttgaggccttggtgagtgagattagtgctttgcgattgtgtgttgtggcacggtagccattggaattggaagttgtggatcgagcagatcttctaagtagagttcgattggctcaggagaaggatgagcagctgattgcggcttctaaggcagagggctctgagtatcagttcgcagctaatgggactatctttgtgcatgggcgagtttgtgtgcctaaggatgaggagttgcgactggagatctttagtgaggctcatgcgagcatgttttccattcatccaggagcgactaagatgtactgagacctcaagcagtactatcattgggccgggatgaagaggaatgtagctaactgggtcgtagagtgcgatgtttgccagatagttaagactgagcatcaggagtcgggtggccttttgcagagtttacacattcctgagtggaagtgggattttatcacgatggatttcgtggttggtatgcctgtgtcgcgaaccaaagatgctatttgggtgatcgtggagcgtctgactaagtcggcatattttctggccataaaaaaaacgatgaagcgacggtgttggctagaaatatgtgagcgagatcgtgaagttgcatggagtacctatgagtattgtgtcagacagggatttcaagtttacttctgcgttttggagagcctttcaggcagagatgggcactaaggtgcagatgagcacggcttatcatcttcagacagatgggcaatctgagagtactatccagacacttgaggatatgttgcggatgtgtttcttggattaaggtgatcattgggcggatcacttgagtctggtagagtttgcttataacaacaactatcaggcgagtattgggatggctcattttgaggcgttgtacgggaggccatgcaagacatcgttatgctggacccaagtgggggagaggagcatatagggtgcagattatgttcaggagaccacggagagaatccgggttcttaagctgaacatgaaggaagctcaggatcgaaagcggagttatactaacaagaggaggagagtttgagtttgaggttggggactatacaaatcttattagattttttctaaatctatacaaatcttcaatattttaaccaaccgataatcaaaaatttgattatttttagaatctaaactaatccatcgttagtttgttcacttttcatcttcttaactcactatattgctacaatcaaagtctttcatctatgaacaaaaacgaaaatatatgtacataaagaatgaaacgagaaagcaaatcacaagatgttcaacccattagcttgataaatcctcaaattaaataaaccatgttatgacgaagaataggttcatcccaaggttgagctgttacaaaaagaaaacaaatcagaaaatctccaatctatcaacaagacaatttctagcaccaatcgtaattttgatctcaacaagccatattatgaggaagaagacttgtatcttcctaatctactgaaaagaatgctggagcttttgctccctaattattataaagtttggggtgagcccatgggtgcaagagaggatgtggggcccaccggtagaggcgttacaagaaaaatgtttatctctagagacgtccctagtagtatttgaacagaatgttccagcagtaccctgatactacaattcaggatgatgcagctgataaaaatcaattgaggagaaagaggaaggggaaagttgttgacgattgccccgagaaagtcttgacgtatcccgaacaagaaaaaaacagttggagtttggtcaagtttcaattttaattaacttaagatttttggtgttgaatgagtcagaacatgttgaagaagacctggaaaatgacaaaagagaggacaatatataaggtttggaagaagaggatcaactagaagataaagtaaacgataaaaaaaggacgggtgatgtaacagagatggagaaggctaataaggatgcatagataactctgaagatgaaaatcaaaaaggaaaagtcgctccatcaagaccatcactacaccttaactctaaaataatcacgagtccgatcgagtttgatatttaataagaaaatgtgacagtagaagcaaaacgaaattctttattaaaaccatttccacaaaaaaacttgtaaactcaattctttcctgagagaaataatcaatagtatttatataaatgcaaatctaaaataaaaaatattattcaccttccgtattagttagttcgaaatcagaaaatccatcaaattcatcatttgatccaaactcttgtttttctatatcatcaagatcttctgcttgaccatgttgatatgttagtgactcaacttgcaaagaatcaacaagaacaattggatcatcactttcatgttgcattgtagtaaaatatgaatttgaactgagtaatactttccctcttgcttttatcataattgatgtccattgttgattcctttttggagtcatccatggatatggcacataactgacttgatctgcttgtgaagctaaaataaaaggatcgtattttccataacgttttgcgacgttaacatcaataatcccagatttgattgctcgtatgcctcctccaacggttaaatcatactagtcacagttaaacaccacaaaattaagatcatctggtcctggataatggatctctaaaatctctttcaatactccatagatatcatgttcttgatttgaactagaagatgaagtgcctctcacacaaactgcataattggcattctttttgtcttttccatgattatatgtgtgaaatatgaatccacgacaaaactacataggccaaaaagtaacttttgtcattggaccatggacgagtgactgcaaccattttgagaatgaattagtgttcaaattcttctccccctgaattttgataatgcatataaaaaattaacaactaaaaatatatatgaaagatttaaataaggttaaaagaaataataatttcttatacagttttgtgaccagcttgcaaaatatttttctttaagtaaggttaggttgtctcgagttatcccatggtgagtagtatccacgttctcatcaaacaacctacgtaattttttttaagaatcataacaacgtcttatacatataaatcatccaaattatacaagggtaagttatgtattttacgtacctttcaaatgggctcaattcttcacaattcaaaagaatatatgttcatgcaacatggtagtcttcatctttaaaccatatctcctttgctttaccactacacctccctgcttgagtaaaaatatatgggacattatcaaactgttgtgtattgtgatcatctccatcataatgtcgatctccaactctagttttcgtctttatgtgtggtttaaaataataagttcaaaatgtattgatgtattgttaaacaatcattccttctactttagccttattttttaacttttctttttgaaatggcctatgtatcattcaaactgatacatccatctaaattgtaaaggtcctccaagtcgagctttctttggcaaatgagtaggcaaatgttccataacctaaaaaacaagattgtggaaatattttctccaaattacagaaaacaataacattgcaacactatctccgtataatatgttcttgaacaaatatttccaaaaaagaagctaatgcctacaaaaagaaaaagttatttaattattaagttgtgaccatatagactaggttaaaagtctcaaactaagaagtcaagaaaagggtcattgaattaattaaaagaattttttagagtaacccacttattgagttttaattgcaggttttggcaaagtggggaatggcttccaccgtttagccattaaggcaaattctgacgaaaatgccgttaaacatgaactggattgcgactattcactttcggttttcatttttttgtgtggttatgtttttataaaaaaaaattctatgaaaaagtgaaacaaagaaagaaattcgaagaatcagaaaacgaaagaaacaaaaatctgagttcatgtgtaaataaaaacgaaagaaacgaaagtgaatatgtcatagaagaagagaaacaagattcgtgtgagagaacaagtgttcttccgaagtaattgacttaaccactggacaattaaaataaactcaaactctttagtttttgaacttaaaatatgttagatgtacaatatttatatataataagcattctaaacgtaaatataaaagaaaacaatatttctgagataactgttaacaatcggctacaaaattagggtttaagaggttgtagacgagtctaacattacaattatacctttattaaatttcttatgtgtacgtgtatgtaatttacggtgtgcgtacatgtgtacatgcaaatatgttagagtatgatttattataaaagcggcatacaaaattatttattgagtttgtacattagaaatctttggttatttagattagatgggatctatttatgcgggttttcccataaaatctatgcttatataataattaaataaaaacatatggtcaaagtatagttgttcctcatacttttgaaaaatgttatgtacgtacatgtataataatgtacgtacatctttgttgatgagttaaaattgttgagatatattgattgatataataataaatcaatattggcgatgggggaggtatattctacggtagtcctactggagatgaagacattgttatttgcaggaaaaaaattgtttgtaaacatactcacaacttacaatgtctctcatgccatactaatttatattttttaattgtcatcttcaacgccctcttcgtcatccccaccctcattatgttcgtcctctttattgtcctcgacttcttcttcctcatctaatcctcattgttttcaaatacattaggtacctaaaatatgtttttgttgtattttcacctccaacccacggttagtttcatcaacaaggtcccacatcatgcacataatattcacacttatcagattggacaaagaaaacaaaaatgtttacacttagatctctactatgaataaaaaaaaatgttcgcattggtgttgtatagatgagaacctatcaacacagaaggattaaggacttggtatattataataaaattatatgtggttttgtcgaagagaattatggtccttttacgaatctttgtaatgtttggtatctacgatggtgcataccgcgagttagccaaatgttatgtatttagtaggaaacgcgtttccatgacgttttttgtgtttccaacctcagagcgaatttccatgcaaccttggctatcgtctttggaatctgctccaccgtcgattaagatcccatgcattcttggtgggaatcaatgtccaagcaattactgtgcattatatcttgcatcattatcctctttggagattctcactcttaagatgacgacctaaatccgatgataattttttctcttaatttattttaattatattttatttgtattttgcatagtaaacagattgttagatttgttttgttttgcggaataatataaagatatttagaaaatctgtgtatttttgttagtttgatgtatatacaaattaattgttttttatatttgatcaattagacgatataatgtgaaatttactctgcggtacaccgttggtcaaatatttgtatctaataatttgaattttaaggtatagttgttttgttcatgttatgttgtttgttttgtttagtgtttaagattatatgattgtattctaattgctaattctaagatttcactcgtactatattatcccgtattaatatagacccaaactcgttccaccatataaccttgtctggtaaaattaaatattattttgttatttttaattttttttattgttatatattaaaaattgggggattgacccatggtatatctcaaattaatatttttaaaactgatttgtgatttacaaatttataatattgtagtatgtaaaaccgatatatactgtatatctttcaataagatgtaactcttataattaaagtgtagtagaatttggttttatatggataaatatttatacaaatgagatcatgttattaagttacaatcatgaagtttaaaattaagtaagttgtaaaaacttaattcatttcttatttaatctaaaactactaaagttttcctttctcataattgttaaaataattgtatattttagaagtcaaagtttttataaattgatatttgcaacctcttgaaactatggatttacacatagtgcaccatggtttaatttttattttattttcttataaactgataaatttgttgattttagttaaaaatgaaaacattgaattaagttttatttgttttgtttatattttaagatgatataattatatttgattgttaattttatgatttcatatgtggtataatatcgaccaacacccggctcagcatttaacccgtcccttaaaaataaacatcattttgttatttttctttttattgatacttttatttaaaagacatataatttaattcaatttaaaagtttgcattcaaatgggtctatatatatatatatatatatatatatattcatatacattgttaatatcataaacatttatagattggtaacattgttaataaatatttctcatcgcgaaattgaaaatatcgtggataaatatctataattttagtatttaccaactcgcaaatattaaaatttattttaaaacgtattatttcttgaacagtaaaacgaaaataatttattgatacaactaaaagttagtaatgtgataatgaagagaaattatgcaattgtgaaataatgacaaaagtggatccagccattatttaaagtggggaaaaggtttcggttttttagggttagatgcacaataactagggttagttgcactatatttgaaacaaatatatcgatgttgaatattcatatatcatttaatatttaatgttttttttgtaggccgattcttattacacacctataaaccagcttcatcaaatagtagttctggtaatatcttgtaaaacgcgtctttgaattgctgttaggtattggtttttggtctccagatttcttttgcaacataagttctcttttttccaccaaaatgttctgttatctgcaaatgcatcccaaacatgtaaaacctgaaaatgactataaaagactcaacaaataacaagtagactccaaaactaatacttaaatcatacttaaaacgggtacatacagaggtatatcaactcgctagacttagcttttgcttgccctcaaccaaaacacaaaagtagaacccgtggaagaggtttgaaaggaattcccaacattctctagcctattgccatgatcattctaaccaaatccatatgcctagcaagtttaatcaaatctgaaccaacatgtaattctccgcaagcttacacaacactctagattccatacctaagtttcacaactatatccaacatgctttcattgatgggtttcatcaagcaagctaatattcaagaaccttctagactcattcttgtactataccatgataactcgaccattatcttctgttttttattgtttctctccacatgcttaattcttttcagagataggacaaagaagtattcagagataggacaaagaagtactcgcttcatcgaatagatattgtaatgcccttgaccaagactaggacttggccgaggaatggctatcgaggaaaacttgatcgtgagcgatgagaaataattttggagctgagccaaggtattctaggacaataccaaggttttgatcaagaaaaattaaagatggacagagaaaaacagttttagtacgacgggacagtagacggtctacagagcagttatcggcagttcacgggttactacggacatttcccgcgaatgaacgagtagataaagacgtttaagcctctccttaatggattagctccttcaagcatatccatttggtgaagataagatcgtctgagtttatccgtagatggataagatcgtctgatcctatccgcatgaggataagaccgatcttgtctatccgtgcgtttggataacgttccggataataatgatcatgcctatcccgccacctctagcttatccaaaccaaccttccaacactataaataccccccttccgcctcatttgttttctcacaccgaaaatgacttaaaacccgaaactttagcttagtacgtccgagagagttcccgggagtgcttttgagcgggtagtcgagagtctaggggtccgatagtccttagttgcttagccaaggtaagtttcagtcatatgaagtagcatatcgttaggaactagatttagttaattaattactagaattatgaggttaagtaggattagtaattgttaagtatgattagtaatggttaagtaggattaataataattaattagtatttcccaagcatgatcagggttagctaaaccatgattagcgggactaatcatgattagagtaatgattaattatgcttagtgtaattaatcggtaagtagttccgcccttagtattagaatatttcttaagaggtcggttcgatccaatgcttagatccattacttcggagaaagcttggtcggatcgtaatctgtatagggattcgagagtagtcgtttcctgagagctaagccaaggtgagttcaggttatgcgtgttgcatgtggttgcatgttgttcgatgaacacatgtaaaccaacttgtttgtttaattgtttgatgagaactagaatggattaggtgttaattatgcattgattacttggatcctcggttatacgttaagtcggttaatctggttattgttgtgattaaatcttgcttgtatgattgcttgatttattgtggttgattgttgataaaccatgtgaggttaagtccccatggtttatatgtgcttgtgcatgattgattgttgcatgagttagtttcatacatattagtatagtttgcgtatgtgatgcttccctaaggccgtatcctagtagtgtgcatagtggctagtttcctacacacgaatggtacgaagactcggagatgaagggctcgcaaccaatggccgagtgttgcatgacgatgtagcctgagtttccaccacaatatgggactcagaacttagtgatgttctatacatgtttagcctttgtggctacgtgtataagtgttcacaactaagggaagggaatatccatacgcggggccctaggtttagtggttgagtagatagttgcatacatatttaatttctatactcgtttagcgtttgtggctacgtgtatatgtgttcacgactaagggaagggaagatcaatacgcggggccctaggtttagtggtcatacatatttaatttcgttgcgcattgtttgtgtatactgcgtggagtatatacaatttgattgttgcattgcttggttgcttgttattttgggtttgggtggggaaatattgcatgtttaggagaacccgaattcactgagcgattagcgctcatcccttattctcttttgcaggcaaccattatgtaagactcaatttaccgataagtaataaagctctgattttataaaaccatgtgtctcccatgatataattagtcatgtccagactatcataactcacgtatcgcagtacaggttgcaaagccttaagccacgttcgtgaggaacggcactcccggtcggcacactcgggcgaacggatttgttccgagagcctaggttggctgactacgggcgtccacgtgacgctctcgttccgtcctgggcctaggaagggataggggtgcactagatcattctttagaatgtaaactaataggatccaaggaaatattcttagccctttacactacaggaaatcatctcatataccaggtatgaacaaggagtcaagttctataaatactaaccattttgacgaggtaaaaggtagagcagtgagattagctccaaccttaatggattgtgttgtaaatcaggatattctcaagtctattggtttacaatctggattttccaatagtcggattgaatcgaaacaacagcaataatcaaccaggcaataatctaaagaatatagatcataattcgtaactagactctacaaaaaacgctgattttttttttacgataactataaaaacgaaaaataaaaagaataaaaaaataaaagcatcattagtaagcatctcctcgagacttaaacgtcactgtccccactataaaagactctaaaaataacaaatagactccaaaactaatacctaaatcatacttaaaaccggtaaaaatagaggtatatcagtagaaaaattgatatagctcaaattacgttaagcttactccctctaatgatcgttgttagcacttaagggtctaattctactaatgatgattaatattaagctagacaaagtagatgaaagtaaaagaatattaaacagtaaattaagttgtagattaaggagattaaacgtgaggtctagggatagtctcacgaagtagataaattgtagatttatctattattaggattgttatcaaaccgttcttaaaaacaaaccctaataatagaataaccgctgatgtgtcgtgctactccctatgcctagagctaaagatccctagtgatgtgccggtgaatccctatattaattcatgcatgctaaacgaatttgattagttcacctaagtaaacatgatgattttgattacacacctataaaccgtggctcatctaaattatttatgttgacggatacctatgatgggcatatctattatttaagatcaagttctaggtgatcaatctagaactagcagtaagaacaattgtagatgaagaactctaaaaataatcctaagctgttatcaatctactaatccatctaaatccatagtgaaactccctaaacccaacaaggtgattactcaaacatgaacaaacgaacacagattacaatctgaataaattgcattggattataatataaagaagagtaaaaggagttcagaatcttctctacatggatatgattcttctctccaaaagtatatctcttataaaacttttcttaggtctaaacaatgaccttagaattatatatataggtgactagaaacgtctagggtctttctagcaaataaagaaaaatttcgggactccttaaagactttgtgaaactttggaacttcctttgtcgaataagggtgtcaatcgacatagatatggtgtctgtaacgcccccgagcctgaccatgaccggactaaccacggccgacccgggtgggcgtcaaagttggagagaaccaggcggaactcggctaaagatccagggatctgagtcctcggccaactcgcatccggtcatctccccactagattcaccgcgtaggcttgcaaacccttgcggcgtacccagtgttgtgcgactcggacaaagccttgtaccattacgacatatccgcatttgtaaaaccatttgtacttaaacgttatttgaataaaaggttaccaagaagaaacattttgttattcggatccatagtttaaagaaaaacgtaagatacaaaatcaggtttgacaaaggcaacataaaataccctagtccggcggccttattgttcgtcttccctctagtggttgaagctacaagttacctttaagacaagtagaatcatgagtaatctagtattactcagtgagccgcgacaatgcaacagagaacctacggcaattctaagccattctaatgcaattctagcaacctagaggggttcactgagttaatgccatataatctggtatttatataattaaagagacacacattgtcgcttccattctattctttttctgcgctcaatatcctcagatagaatcctccaggttttgtcccataccatctctggtttggttaaactttctgaaagtagcatgatgacaaatagcctacgaacatacttggcagagcaacaaaaatttgcatctttaaacccgttcatgtactctttgtcatcgtgaagcaatcctaaagcaaaaaccgcatctctgaatgattcgtgaattacccctttcactgttttgagatctttataacttgtaacacctcttttgatgtttaagagaattctcaaataataagcgtcttctattgtatgtggaacaaagttagtccttccaatagcaaatcccctttctttgatcatgaatttcttttctttgctgttccaagtgaagtgatttggaatttcttcaactaagagctttgttggaaatggagctgcttttggtaggtttttggcactagcatggactcttctacttggaggcttcttgttaagctaaaaccacaccaaaaattgtgttgcttcattacttaatcgatccattacactctccgttgtttcacctggaatataacaatatcttaattacatgtacataggttatgataatttctatctaaactaaatgattccattatgcgcatctacaacaacattatttagaatataacaatatcttaattacatgtacataggttgtgataatttctatctaaagaaaataattccattaaaatgattccattatgtgcatgcaacaacaacactatcttaattacacgtacataggttatgataatttctatctaaacaaaatgattccatgtttaacacaatagtaaaataaactcttctacacaaaccaaataaaaattcattgtatgtataatttgataataaaataatcactctactattcggctagcacaatttatctccaaatttggtagaagtatataaagccattatagtctctaacgtctaataaaacaaagactctatatatgtgtcattatacttcccaaataatggatgtcaaaacaatatatatgtctgacctagtttataataaactggttgttttcctttttcatgaaagaaaagtttaataactggagttgttctatagtttatgagaaatttgaacattctccacatagcttcacaagctgaaacgtacgtgtcataattaaaaaaaactgcaattaacaatgtgaggtttaataataattactctatgtgtctaaaattaatgcaaatactaaagaaattacctgcaatcaaagtaatctttaacttcgtccttctcctttttagtagtatcttggttatttggctcaatagtcactgttacacggtcatgttctttatgaacatacttaaaaagatactttattaaacctattagttgcaccaatccacattaatatgagcatgataacagagggatagcttttcattatagggaatgacgtaacgattatcgcattgaaaaccgttcttctcggcataaataccagtgttatgtcttctataaactggaaacccatcattatcaaccttagtagtgtcataatagctcttggaaaaatactttttgcattgtccattcaccatacatggtgaattcggatgaccaacaccacacggtccatgaatcatacagtctttaaccagtacataaagctctagtttctttttcttatcaggaatctcagcagttataactttgtcagtgtcttcggctgtatacaacttattggttgcatgcaggaataacaatatgtgtgcatggagaagtcctcgtttttgaaattcaattgtgtacatgcctacaaaaaaaaaaaaacgttgaaatcattagtggtcaagactataaaatacagagaggaatcatatagagtaattttaagcgaccagttaggagcattacagattttttggtatctttagattttcaatatctccaactaacttaaaatttgtttgcgatagttattcttaataagcagatttttaactaagtctacattagattaatgaaacagtagtgttctttgaatttaaactgttgaatgctattaactatttaaatatatttcaggaataaaagcaaagagatgaagagcaatgtatgggtcatcaacctattttaaatgttagttttaactcgaaagcaacgtttatatgataatagtaggattcaagattatttaacccaaactgaaaaatacgggtagtaaaatgtaaatattgacagggacatttatattaaaaaaacacgagtaatgatatagatatcagattgaaattatatgtacatgaaactgtcttcccaagtaggtatttggtggttagatcatacataagattatcaagcttcatcttgaaaatttgacaaatgatgtctggtctatcttcagacttcaagttcctcgctttatagaatctaactatttcatgccactttggattgcaagtaaatgttatgaaaactgatggaagtccaaagtgttggcaaatagccattgcatccaaatagttgtttgccatgtatcttggtccacctgtaaaagaagctggaattttaacttctttaccttggttttccaaatcattgtttctagagttggatgcattttgaattgattctccgttaaaacttcagaattttggttgattcttcttaatatacctcagcctgttagacttaatcatagtgtaagcatcaactatgaactgttgcatcaaacgctaagaacaaaataaaacgtgcgtgtttttcagccttcctttcttgtagacgatatgcaaaccattgtctcatgcctacgtctttatgttccctttttgcatcgccaccaccatttgttctagttttctttatcccaagtctataaccatcttcctcgcgtgtgaataacagaggatattgccaagctagataggaaacatgtagttctctgattctttttaaattccccgtagtattttcctgtaacacaatatcacgtttatccatgtcttcatggaaaccccctggaattaatgcagcaacttcatatgctgtaggcagattgtatatccttgggtcactatttcgagcaacaataattcttatgtggaaactttcttctgcatctgtattaaatctgtcttttacagatctaaacgccttcacatgagggtttacccgatttaaaatcttcatgatttttttgatgagttccttatttaaacttttcttcttctagccttattcagtatcgttctcattgccgaataatagagaaacatattagtttattgatgtactactgaattgtatagttgtaaagattgaaaaataaaagaaaagatacctcattatgttatatctgttgttaacctcattttcagtatcagcaatatatagctgttgaaactttgctttagcacttgattttggcttcaaagcacctatgagatggtaattttcaccttggattgcaaacatgttaggctgaggacccttaggaagaaaatgatctactttacttccaatagatgtgaatgagaacaaagtgttgtaagctctgatgttttctctaaaatgcttagagagttcatcatcacttgtaagcaaatgccacaaaaattcaggcgagtccttcagggaaggcaatacgatctgtcttgcatacaacatcctgaatatattggatttcttgaattcttcctcttgtttacacgtttcccataccaaaaaaatagcaccacacttgtcacaactataaactggatcatcttcatgacgaaagctaaacaaaacataagctaaatgagttaaaatgaagattataccactttttaggttgggtggaatcacaagctttgacttaggctttccaaaagccttctataacatattaagtatgtcaaaattatcttttgcttcataaataatgtcatctgggatttgagccacatcttcagcattaacatcttcatctcatgaagaatttgaagaacattcttcttgactgctccaaaagaaatcttcttggtagttctcttcatagtcacatgttattatttgaacatgatagttattaaatgagaatatctcttagagacataaaaaagtaaacatataatgtcttaccttctgatgaattatgataatctgaccagtcagtatcttcatctgtatcagtattggtaccattctccttggcataacctaccttataattaaggaaatcatcattaactcatgtggtttgtaaagttgatttgtattctcttatattatttaaacctaaatagaaaaacaaataactatatttagtaggcttctttattaacatccatttctaatacatagcatctacatcatttttgtgatatagtgggaatagctttcttctaacctgaaatctttcctttgtttcttttgtttgtatcagatggtccagaaaggtcattaatataggtcaaattaatcctaagaccactctctcaaataaagaggtcagttgcagcacttagggatcgaattcacaaagttctcggatcacgcaatatactaatggcaaatcgaattatgctaagtaatatagtaaataaaataaagagaaacaaaagtaaacaatagcaatcgattggatggttgtgaaacaagataataaaagcgtcaggcttagggtattctcaggagataaatgatagtagatctagaaataactaagttgttatcgtaccgttcttgaactcaaactatgattctagagtaaccggtggtgttccgcgaaactctctatacttagaggtaagataaccagagaagccgagaaatcctatactaaagcatgcattaggttcagacatttcatcgaacaccttttgggcgcagaaatgtctgggctcaaattccagttgatcagaaagcaacacgcattaagaacaactaatccagaagggatctataaatcaaactcaaccacctagcataccgagaatcctaaactactctaaccatcctcagaaacctattgactactcatacatcattgcagagaacataaacgttgaatagaatgaaaacatgataacaacagagtaatagcaagatgataacaggatgaacaacagtaaacaaaattaaaagcaaaatgctgaatactaaatagattaagagaaatccggattacaaaatgtcaagaacacagggtctgcggaataaaacttagataaacgaaaatgtaaagtactgctacttataacgaaatattctgaaaccctaatactcaaaacgacgcagtattgggacagattaagaagggtactcgacccaggtggtcgagtgagtggtcgagtgataagctggagtcatcttttcttccttgtgctcgagtgtctggttgagtgcagaagggagaagactctgaagctggcaatcgagtatgtagtcgagtgatggttttggtgatactcgactttgtggtagagtggcgtgatcgagtgatggtcaggtggtggaggtgatgatactctaccaggtggtcgagtgaagtgatcgagtgactctcatggtggtactcggctaggtggtcgagtggtgaagtgaagtggtgaagtcttctactcgaccaggggatcgagtggtctgttaaggtcgtgaagcgtctacttgaccagggggtcgagtggtttgacatgatcaggtccgcttcttccaattagctcgtcaacagctccaaatcacctgaaaacaacacaaatatgcaacatgcactacatgaaaagtaagtaatgacatgcaaagtgatgacaaatgatgagaaatgatataaaacagtgatgatatgatgctaaagtgatgacaaatggatgctcaaaacaggcaaaatgcacacttatcatggtacagttcaactccccttaaacactaacatgtcgatgcagctatagggggtgtcaatctagtccactgttattgctagcaatcaagatgtgtacagaagcaactaagtcaagccagattataatgatggtgggtttctagtaacaatcctaaatcaagattcaaacaacaaaaataagaactttaagtggcctactcgatcacaaggtccaccagaaccatacatgcaacaaatttaagtactgaaatgcaataaaaggtaactcaacaagatgatacaaataacaggtgaataaaagtgcaatcagggggtgaatctaagaagtcttaaggatggattcattgataagggcaattctagggttcatctaatggctaacatgcgaaaggcaaattccctagacgatgattcaaaaccagatatccactctcgtgatagagatcctcataactataccacttcctaatctcaactctcgttgatgaaacatagcaaggcaggctttaagtaccccaaagaacctatttatactaaaatcttggaaaccctagattcactagaagacaagagacttgaggcggtttggatggatgctcgatcttggggatcaagtaaagagggtgctgcaaagtctgcgcctttgcctctatgctccgagtgatcaattggtcgaggagatgcttgttcctctcctatttgtttcctgagatgtctggttgagtggggaatgaggaggattcgaagacgctttaaacgatcaacaagtcttgtagagtaggttgcccttgatcgagtaactggtcgagtagaggattaagtagggggtcgagtagagtatgctgcctcctttgtagctgcctgaatcgagtaaactggtcgagtagattgccctgttgcttcccttctggtttgatagagtagagggtcgagtagattccttgtaagctccttctccacctgaaaacagaccaaaacatgcaatatgtatgcaagttgattctaaatgcctaagtgtgcaaaaaagctaaatgtgatgcaacattatatgaaacaatgagtgattactaagctaaatgatgataaatacctgcctaaaatgagtaaaatacagtgtttataaagtttttaagtgaggttaagagagagaagcggaggaagttcttgaggagaagttggagaagccaagatcgccggtgaagcccatctgaaaccccaacctctcaatccatagtttgtttgggagttcgtgtgactactttgcttgttgcattctcattctaggatcatcatattagaatttggttgcttgcatgatagtttgtttgtgggttcatgtaactactttgcttgttgcgttctcattctaggatcatcatattagaatttggttgcatgcatgatagtttgtttgtgagttcgtgtgactactttgcttgttgcattttcattctagggtcatcatattagaacttggttgcatgcatgataagctatgacctaaatcacatagaaaacacctagagagaccaattgttgtatgtcttatgtttgtttaaaatccggctaggttaatcaatgaactgcatataaaaatcatcacctagtttgcttagaattgcttgtttaaaatcatactaggttctttgctgcatgtagatgaaaactagggctttgcttgttgatttcttgtttctttgtttgcattgcttgtttatttttgtgtcgtgtcttgttgtgttttttgcttgccgccatcctcgaatccatgtcggaagagggatgtgcaatgtgtgtgtaggataccttggatgcggaatctgcgggtcataggagagtctagtttagtgtgctccaatttcctgcatgtgagtgtggaagcctgcgagtcttggtcccaagggcacactcgcgggctagtatcgaaacctaggccgagagtgcatgaagatgcatttgggcttattggtatcttgggtgggttcaataagtcgtgatcttgttggttttatgtgtggattcaacaagtggttggtcgggttgacggatccatataggagaactcaactttcgacatttagtgaggaggaatggagcacattgtccataggtttgcgtctagatttagtcaagtctattttctcgcttctgtatctttgcttgtttatttgcttcctgcgtgttactatgattgtttgttgcatgcttgatttaccttcgttcgtgtgactaaagtgctatgtctttataaataatgcaaatcttcaatcaagtgatgaggaaagacaagcaaaattgtttgcaagagatagccagactggttaccaaaaacagactttcactttcaaaattgaaatagatgccacaaatttcagatgaacacgttgaaaaatgcaaccattttatattagatgaaagcaagtacgaccgtgcatatttgaaagagaagcatgaaaaatggttgactatggtgacaacagagtaaaagaagatatatgaagagattatggatgttgtgttatatgacagaggcggaatgttttttgtttacagttttggaggcaccggaaaaaacttttctatggaaattattatctgctgctattagatcaaaaggagacatatcattaaacgtcgcatctagcggtagtcctaatctacttttggtattcctttaaaccccaatgaatcctctacatgtaacatttcacgtggtacagatcttggtgagttggtcaaagaggcaaaactaattatttgggatgaagctcctatgatgagtaagcattgttttgagtctttggatagaactttgagagattttatgaataatctagaggacaagccttttggtggtaaggttatagtttttggaggtgatttcagacaagtgttacttgtgataaatggtgctggtagagaagagattgtttttgctgcactaaattcttcttatatctgggagcactgcaaagtttttgagctaacaaagaaaatgaaacttcttgcaaacattagtgagcatgaaaagcgggatatcgaggatttctccaagtggatactagatgttggggatgggaaaatttcacagtgcaatgagggaatttctttgattgatatccgagaagagttttttattaatggggataatgatccggttgaatcaataatagaggcagtttatggaaatacttttatggaggagaaagaccgaaagttctttcaaggaagagtgattctttgtcccactaatgaggatgtgaattccataaacgagcatatgatgagtatgttagatggtaagttgaactttaaccaaacactattgtattttcgcttaaattatttaatcttaaatagcgttttattaaaattgtgttttcattatatttgtaggtgaagaaagaatctacctaagttctaatagtatagaccctgctgacacaagttctgcgaataatgatgcttattcagctgatttttttaaacagtgtcatagtttcttgattgttgaaccatagcttgcgcttgaaagttggttgtcgggtccggttgttgagaaacatggatcctcatcacaccctcagatacaaggtttatgcaatgggacaagattacaggtcactcaaatggcagatagtgtaattcaagctagatttattacatgtaataaagttggtaagattgttctgattcctaggatgctcatcacaccctccgatacaagattacctttcaaaatgaggcgtaggtaatttcctctatctatagcttttgccatgaccgtaaataagagtcaaggacaaacactagagtctgttggacattatttgcctaggcctgtgttttcacatgggcaactatacgtggcaatctctggagtgacgtcaaaaactagtatgaagttttttatagccaccattttaactactataatatgtttacgattattaatcttccacttatatcagcattgatgattcttataacagaaaaaacaatgaatattgtttttaaagaagtgtttcaaaacctacactaagacagtcatggaaacaaagatatgtgattcctattcaaccaggttaataagtgatatggttcaatttacctagaaatgctctctcaaataagagatcaattgcagtatttaaggatcgaattcacggagttcttttgtttaaacaatgagttgaatgtcgagattaagctagcaggtgataattgaaatagtaagaaaacaaagtaagaaaacagcaggatgattgtgttgtaaacgattaaataaagagttaggaacatggtattctcaggaaactattgattagtagatctaatgaatgctaggttgttatcgagccattcttaaactcaaactctaattatggaataaccggtggcgttccgtgaaactccctatatctatagctaagaataaccggagaagccgagaaattatcaacctaaatatgcattcttaacgagttcgattgttcaccttagtagctaggccgattcttattacacacctaaaaccaaggctcatcaaataatagatccaactacagatacctatagcgggcatatctatttcttgattcaagatctagttaattactctagatctagcattaagcataattaaagatgaagaattctacagataacctagcaagggggcaatctactaaaccatatgattccctaatgagaaaccctattcctgacaagcaaattactcagacatattgaacgaagcaaataacatatttgggtatgaaaacataaacacaacaaatagattaagggaaagaatggatctcttcactatactaagatctgaatcaatctctgaaaactttcgatgaatagcttatgtctctcagtaacatggtttgcaaaaagcttgataagaacttgatagaaaacttgacaataaacttcacaatatgaagactaggtctaaaaacaatataaagaccctataaaacatccaaggactaataatgcaaatagggaagtcttctagggcaaatttcctcttctgtaaacttgaaagcgtctaggactttgctgggccgaaactggtgttgatcgacaccaagagtgtgtcgatcaacactcctcgctgattcctgaatccaaaatcgtctttagcttcctttcctttagctcttgctccaaaatgtctccttatatccattgttgtctcattgcatagtatacttggaaagacactaaaaagactcgagaaataacataaaggctcaaaatcctatacctaaaacatagataaaatcaatgaaaatagggttatatcaataagttaagaaatcacaaacgttttcaattttttataggattatattcaaagtaatatttggcactaatgaagttgttttacaaatttcatgctcacaggtttagttgcatcaaatcaaggaataaagatgctcaagcattgtcaggacgtgttcaatggaataagagttggtaaaaaaactcaactggattttgtttactatgttatagttcgaataaaaactatggttttttcatttctttattactctgattatgtctaatactcgaatatgagattgaatatttcttttctaaataaagacaagatgcagtcaacatcatccattcgaaataagattttaggaatcaggtgctaacctttatacacatattaggatctgaaattgatgtcgcctgctacttcatgtttagcttgtccttcttatatacatttacactaattcaaaagctacagctggtgtaaacctgaatttcgatttgtaatcagattagagtttttcttaagagaacttactagataatataacaagttaaaccttaagctgtcttcaacatataagtagctttttcaatctttaaatagagcaaatggattctcgaactgcaaaatataatatactacttagctttcatgtataaggacgaccaaattcatatgtttttttcattgtggcaacaatcagctattggatttacatattccttttggctccatatctcattaagctcgccttcctttccaatgttatattaaaaactaaatcagacaatataggaagcaaatcaaaacttgagtcaagattcaggattctaggaaagaaaacatacttgaaacacgcatagaggggttgattagcgtgttgtaatgtttgcggcttttgcctgcttcggtctctgggattcttaaatgaaggtgttgtgctgtagttaaaattttgcggaataaattgttaaaatcccccaatttggagatgattgatatctgaggctctattcccatattatgtttcatctgcaaaaacaatccatgttaataaatatatgtgtatgtagtattctattgattttcattgactcggatttcagtaagaaccctacactggtggattcttgtatggaaataggagacgtatcaagatcgtctttgactgaaaccatgaggcaagggacctcatacccagttgcctcaccataatttgcaacttctacaagcatctgagtcgctttcttccatgagaactcatcataactagagaaaacaatgaactcaattgtatgcactaactgcaaacagagaataaaaaggcgtctacttgagcatatattgatacggttcaaattgccttaaacctactctcttaaataagagatcggttgcagtatttaagggtcgaaattcctcaaagttcttttgttcacacaaagaattaggtgtcaagattaagctagcagagaataagtgaagtaaaaagtaaacaaaataaaacgacagcagattgattggttgtaaaacgattaaataaagagttaggagtagggtattctctggaaactattggttagtagatctaatgatagctaggttcttatcgaaccattcttaaactcaaactctaattatggaataaccggtggcgttccgcgaaactccctatgcctatagctaagaataaccggagaagacgagagatcttatacctagacatgcattctaaacgagttcaattgttcaccttagtagaaaagccgattcttattacacagctataaaccaggctcatcaaataatagatccaactacatatatctatggtgggtatatcgattatctggattcaagttctagttaattactctagatctagcattaagaacaattaaagatgaagaattctatagataacctaccagggggcgatctactaaaccatttgaatccctaatgaaaaaccctattcctaactagcaaactactcagacatattgattaaaacaagcaacataattgatatagaaagcataaacacaacaaataagaatagaatatgaaaggatcttttcactgtattgaaaacgaaatgaatctcttaaaaacaagggatgaatagcttatgtctctctgaaactcgatgaaaagcttgataaaaacttgatagaaaagaactaaggtctaaacaatgacctctaaaactatataaatgccctataaaacgttcaaggactaataatgtaaatagggaagtcttctgtgcaaatttccacttctgtaaacttgaaagcgtcatggactttactggcccgataccggtgtcgattcactctcactgaatctggaaccgaaatcgtccttaactttcttctccttagcttttgctccaaaatgtctcctcatctccattgtagtccttcctcatataataactgaaaagactctaaaaagactcgagaaataacaaaaagactcaaaatcctatacctaaaacatagataaaatcaataaaaatagggttatatcaaacaatcaaatagaaagaaatatacatgtcatacatgaagatagcaatgtcacatgcaaccaaggattatttggatgaaaatatcccttgaactccatcttttgtaatttccctcatgataagagttttctttgcaccctacactcaagatttccaaccatcaaattaataaccaattacctacagaaacttagagaaagcagccttgaagcatgccacaaatgtacaaccaaataacatcatcaatcttttgacaagtaagaaatcaccaaagatatctaactagctctcatctcagtccccaaaatagcactcaagttttacaaaacaggagattgcaaagcaaaatgcttatacctttgttctcttgccaaaattcagacataacattagatcaataggataattgtttagtttagtgcttcttgtgcgccgagacatacacctcaaacatagaaatgaagaaaaacaagaaacgcgtgagaatcaaaataaaataacaaatctagacaaaatctctaaactaagcctaatggtgattcccaagaatttgggcaacgacgctaaatttgatattgttcaaatttccttaagaccactctctcaaataagagatcgtcgatagtacttaaggattgaattccacaaagttcttttgttcacacaataagctaaagtatcaagattaagctagatgagtatgagaaaaaaaaaagtaaagcaaatagcaggttggttggttgtaaaacaagataataaaacatcaggcataaggtattttgatgattagtagatcaagaaatagttaggttgttatcgaaccgttcttgaactaaaaccctaattactgaataaccggtgatgtgtcgtgctactcactatgtctagagttaaagattcctattgatgtgctgtgaaatcttatacttaaacatgcattctaaacgaatttgataagttcacctaagttgataaaccgatattattcgggacgcctataaacgttggctcatcaaatagtagttccggtaccaggtacttatggtaggtatacctattatctaagatccacttctagagtaattaactagaactagcattaagaacaaccaaagatgaagaatcctagaataacttagcaaggaggcaatctactaaatcatatgaatccctaatgagaaacccttaacctaacaagctgactactcagacatgatggctgaaacaaacaacatgtatgaataagaaagcatagatgagatcaataaagagagagttataaaagatctcttcactgttattgaaatctctggtgaaactctgaaaacaggggatttggaacttcttagaaaaagacttggtaaaaagcttaggtctaaacaatgacctttaaaactatataatgacctaaaatgtgcatggactaataatgaaaatagaaaagtcttctggccaaatttacatatcttcaaactctaaaccgtcatggacttttctgggtcgcaactggtgtcgatcgacattctcgacttgatatgaaagcgaatttgtcatttggcttattttcttcagcttttgctccaaaatgtctccttatctccattcttgtcccaatccttagaatacctgaaaaaactctaaaaagactatagaaataacaaaaaaactcaaaaacctatatctaaaacatagctaaaaacagtaaaaactaaaaaagggtaatatcacaagtgtcaagtgaagccggagaatttgaagtgatggtcaagatggaatcgtgtagaatttataagtgatagcaggatatttaaagttcttgtaatattaaaacaaaaaattttccttctatattatgattattattgattttcttctctgtagatttaaactggattttttaaataaaagaattcaaaattcacttaaaattttaaaattcaatccaaattttaaaatcagatagttaataagaacatcaataacaaaatatactcgctattaaacaatattacattgcataagacaacacgctataatatataaataaaatattgcaccacaaaaaaccgatatcagaattcgttgacctattatcatgggcgcatatatagcgctttctactccactattgtctcgttagatagcgttatttagccgctaacaatacttaattttcctctaatgcatcgaatgtttggcgcttggtaagtcatttgatggcttgtgtgataagaacatgcagtccctactgtggagatgtttgatgaattaagcgagtttgttgtaaccctacactctaaagtttgtcgtaaggccttcaaattccctagctttatggatgagtagaagctttgtttgtgttgttttcttttggttgttatgtttcaatctttgaagaaccatgttttgtcttcgactttttattttggtatgtctcacacttttaagaacatgttatggcttttggttacaatcaacaagatctaacttccgattcattttttattttgtacagaggaagtgttagtaacatgttggtttgtcaacctagaatcataaaaacttagtacaaagaagtcaatagacaaaaaatactttcgttctttaaccactgatgttttagaacaaaatcatagaaatgaaaaaccaatgttgagattcaaatagtaaagacctacagaaaagaaaaaataatcataaaggactttaagccttggatgtcttacgattgtgtccaatttgcaattatcacaagtgtgttgttttctaggctttttcttctccatagcaatctccaattgatgcgtgctttattttgcctcaggcttttacctgaaacaccacatgattactgcaagtgcacagtatatcggagtagtatttgaggatcaaatccacagggagtgcatctacaaggaagaattaaagttaggtaacatggatcaagacaaaagaaagagtggggttttgtgaatgcaatgaaaataagtaaagagtgcaataaaaataagaaagcaataaaaggaaactgtaaaaggcaatgaaagtaaatttcaataagaagagcggtgtaaaacaagtaaaaacaaaacgctaggtcttcggagttttcttcgggcatcatggttcaacaaaaaggtatagatcccaatctaggtgataacatgcttaggtttgtttacttccaaattctcggacatacaaaactcattcaagaccagctagccccaacggctagtaggtgaaagccagctattctcactaatacctcgcgtactcagttgccctaacggttagtaggtgctaacatggtttgagatacagatcaaagcattaagttcaagttcgcttctagtccataagtccctatcactctgcgggcgtgcaacggttatagttctttattcagttgagttagtgcaagcaattatacaagattctgccaagtataaaatacctaagatcatgtactaggtggcgttccggacatacatgcattaagattaaactcaactagaaagaatagtgtaaacgatcaaacaaagccatagaaaccaccagcctaaacttgatctaaagtccccatgaatgcccttcgaaaccccctaaaacgtaactagagatctactcacacatactcaaaaaacgcaacatcatatgaataaaaaatgcataaaaagaatatgggtatgaaaagggtttaaggatcttctctggaaatccaaagcttgataaatcttcttccttttacaagtagagaatagagaatagaagagaaaagagaaaaacaatgaagaactagaagaggacgactttgaggcggtgagaggcgcaaggggcagcctaattttgtggggtggtgattagggtttcccctaatcttagtatttatagggcttcattaggttaaagggtagaaacgtccttccattgattagtaagtgatgggccaagttcctgggcttcttagggaggcttgaagtcggcggcaagaggaaaggaaggagtggttgtgcaccctagtggtcagtggaagacttgaggggacgcccgtgttcaagtctcttcggccggcggttttaaattgatcatttccaaaaccgcgattctagaacaattcttcactcttcgggccataactattgaacggcgtcatggattgcttcgatttgacttcgacgttaatcttgactcttctggctttccaatgacacctagatacctccaggacgagatcgggaagaccttggccggatgccaaacatctgaggcacataaactgtttctaaaacagaatttggtcgacttctacttctttttgcatgaaaactcataattcttccttgaaggtcaaatactcgaaatattccttgaagtgtcctttaattcttgatttttccatggaaaacctaataaaaacatagcgaaagtgggcgaaaatacaatgttatcatcaatgcagatttaattctcgattttttggtcttcttggttgttgacgagcttctggtggtaaacatatcttcgtcacgacattttgggaacatgtattccaaaaaccctgggcatgatgtcattaacatatgaattgcataataattattttgaaagtaaggatgacacaatggtatatgagaaacgtttcatttttctcccgctgcaatcgcgtaggcacatgggatattctctagatcaaacctgcgacacaaacatttcttgcctttcaaattaacaacgtgcagagatgctccaaatgtaacttgtacttgatgtgcatctttgtcttgcacaattagcaatttggcgtactctacacgactctacaaaaaaatacattgtcattagttagctatatttatatacattaatgtataaattgtaattgtatttgatatacctctatttttactgcttttagctatgatttagggataggtctagagtcttttgttatttctagattcttttctagtccttttcaggtttttacacatttgggatgcatttagacataatggagcatcctaatgaaaaacagagaacgtataccgcgatgaaatccagagaccaaaaatcacgtaggtgtcgatcgatacaacctctggtgtcgagcgacaccaatatctgatggcaattcaatttcgcgtttcattgaagttatgaagatttgcagattcagccctgaactttcccttatttttaaagaaaacccatcacgttttagaaacttatatatatagttttaaggtcattgtttagacctaaggttttgggaggctattctatttttctcttctaatcttgggtgtaaaatcctgtggagactcccttaagagaagatccttctaaactcttttctcttgttatattcattattgatttcttattcaaacatgttttgttcttctatgatcatgtctgagtaatccacttgttagggttagggtttctcattagggttatagatgatttagtagatcgccacctgttaggatatctgtaagattcttcatctttggttattctgaatgctagttctaaagtagataactagaacttgatattaaataataggtatgcccaaaaaggtatcttttactagaactactatttgatgagccatgtttatagatgtgcaataagaatcagcttatctaactcgtttagcatgcatgtcttaatatagggatttgtcaagccaacgcttggaatatttagccttaggcatagtgagtaacaaggcaaaccaccgttattctgttaatagggtttgagtttaagaacagttcgataacatgctaactattactagatctactaatcatttgtttcctgagaataccctaagcctgacgtttgtattatcttattttacttccatccaatttgccattgcttgcttttgtttctttttatattctttacctattttacttaacttaattcgatagccattagtctattgcgtgatccgagaactttttgaattcgatccctacgtgctgcaactgacctcttatttgagagagtggtcttaggattaatttaacttatatcaaatttggcgttgttgccgaagttctctttgattcaccattagactaggcttttagttttcatgtgacaggggaactaaaaggtgaaacacaacaaactgctggtagatatcgacagtagtgtcaatcgacactggctgtgtgtcgattgacaccaacatggcaacacgaccatgacacttgttgactacaacaagcccgatattgtctactttaatcagtctatgatataccctcctgcatttggaaagagctgatttggagctaagacctgcttattatatgatatggtttctagagcaaagtttagaggtgctccagatgaagcaccacttgatcatttggaaatcttagaagacttagtttcctccatcaaagcagacggtccagctgattatctactttgccagctatttacccactctttaatgggtaaaggagcatcgtggctccgacagctagcacctgattcattgacaaattggacgaacatgcaccacttcttcgatgaatccatgatagaagcaatgcggctgctgatttcttcattttcttaagatccaacagaaggtttaaaggcagcatggatcagattcaaatcttatcttagggactgtccacaacatggtttccaagaaagccagctcatcagcatctttttcgatgaatagatgtgatgtatcagaagtcattaaacgcaacaagttcttgcaacttcatgacaagatctcccaacaaaacattggtactaatcaataacgttgtgacgagtctcacaacaaagagccaaagacagtaagcgcatgaaattggttaaggcttccatcattagcaaagaggaacaaggatctacaccattgcttctccagctaacacttcttacatccaagcccacccaccacccgttgttaagactaaaactgaagccatgctagaggaataactcggacagctaaagaccggcctttctcaagtgcaaacaaacatcaggaaactccaggagtttgcttttacattggaatctatcaatgttgttaaactgttgagtggacagcaacaacacctcttcgagagaccctcccgagatggactaagagtagccttacaactgcttgtcatactgtttcgatggattgtgaagatgagtttgtggaagttaaggaggatcgagttgattttaacattgcagaggcagcatccccgatgaatcatgcatttatggaaacaaccttgagcatttatcgagcattttaataattgaatagttaagttatttctggatggaaacaacctcatcggttttatggtctaggatgggacttttcaagttgataataaagcatgcttgctcctaggatcgtttgggttaaggggaaaacaccactcgccagacagcactttgcgaataggttttgtttgcttgttaagtttcagtaggtcgatattgttgactaacttggaactttcacatgagaaaaagcaaaatgagaaagcgaaaaaaggataaggaagcagcaggaacaagtcaaaccgagagggtcaatataacccatgagacttcctcaaaggccaaagaagtgccctaggaggaggaaacagaaccaagggcaccctgactctaaaatccgtgattgttagaccgcggataatggaaacagagatcagggaggaaacttggaagagatcaaggatgggaatgatgaggcagaaaaaaggcaaggaaaaccctaccggaattccttccatcggggaaatgtgggatgcgatgaaaaccgtgatggcacaactggccgttcttacccaaactgtcctgccggcggaactccagccaaagttctggatggaaagactcagcagacggtgaccaattctgggaacatagtggggaacttgacagaagtgatcgaaattgatacaccgattcaggcggttcgtaaagtggactacctaagcctgttggaacttatctcacaacttgggacgaagcacttcttgggtagttcaaatcaaattgaggggaacgagtggagggcacgttttgtacggaacttttggtccactctctccctgaaggattacaagaagtacagtgtccatttcttggaaggtgatgcgcataactagtggcttacagtaaataaattcaaaggtgagcgtatcaaaaccttcaacggctttgaggacgagttcaacaggaagttcttcccatccgaggcatggaacctgttgagagttacttcttggatcttgtccagggttgccgtacggtctgcaaatccgaagaggaattcaacaaaccaagacgttatgtgggaagagaactcgaggacaaagtagcgcaagtttgttgatttctccgaggccatagggtagacttaaggacccattgctcggtcagtaccttcaacattgtctaagaactggttgaaatggcgacattgatcgaggcaaacctcgataaggagtataggatccgcccaaagacgggtgataatccaaagaatgaaaagacaagataattctaccaactcgacgataaaagcgaatgctgggatggaaagggggcatgtgagaggtgtggaagtatgagtcacagtacccaacattgctcggggacaggataaatgcagacaagagtgataccagatcaccaaaagttgtgctaccgctgtagtcagacggggcattacataagggaatgcccgcagctacaagcggaggggtcagttggtgaaaagggaaatcgggtagggagtgagccatccggacaggccaaaagagttgccatggcaccccgcgtgtaacacccccgaaccatcctaaaactaagaacaatttcggaagaaccacgtatggttggcaaccgccagcacacaaatccgactaaagatcacccaaggccaggcccgaccatagaagaccgctcctcgcgaccacgagacttaaaggctttgcaacccataccgcgaccgcgagttgggattagtccggactagactactgagaggatacacaagatctttaagaaaaaccaatttcttattcatatagaatgtattaaaatacattaccaaatacaagtataggattttggtacaaaagccaaaacttaattcagtcgtacataaaatacaaaaataccatctaccaaggcaacacaaaactaaaccatgcttaaactaaggtttacaacaaaggttacctgcaaaagagagtgggggatgagcgctactcgcccagtaactcctagctccctctaacaggcaataattccctaacccaaaacccaaaataacaagtagtatgcggaagtataacaatattgaaagcataatctcaagaaatcaataaaataaacaatcaagctggttaccatgagtacgtcaactaaatggaaccacatgcaacacgcaatcaagaataactagaaacttaccttgattcggctgaacggtttagactcgatctaatcctaatctaaaataagccttcgatcgcctaaataatctacttggtagagcctcgacattagagctcctcgggatgaactagtcgtacctgaagaagaactagtcaacactcgctcatggactttttagagagattttggcgtttcggtgtgaatgaagaagaataaggcagaatgactatttataggggtggtaggacggtttgggaagcaccaggtggcgagataggctcaaccgagcttatttgtaactttatccaaaacctgcagacagacttgaattattatccatacacggataaacttggacgatcttatttgtatggaacggatagacatgaatgaacttatccacaagttgatccttatctgcttccatacttatccaaaatttcatacttatccacactcgttcttatttgtacctcatccttatccactcacgtccctatccatacttcatctttatccactttcgtccctatccattattgttcctatccataaccatacttatccaaaatctcatctctatttgatttcaccatacttatccaaaatctcatcttcatcattataggccactcgttcttcttacctgcttacacaaaagcaacactctcggctatacactaggcccgatcagttacaagcccatatcatcaagcataatctacatgatccattccctcaacacatcaacacattaatctcagtcagtctagtccatgttcctcttgactcacccatccggttccccgaccacttgctcacaagtatccccaaaactgcgagatcgttggtcggacgaaacaatactcgtcccgtaaggacttctttcgaatgctccgattgtatggcctgctaaatctttaacgaaaattcctcggcctagtcctagtcttggtctgaggcattacactgcgtgtatgagttaacaaaggaaactggcggggccggtaacttcaatttgatcactggtaagtcaataagccatcctagtaaaatataaacaatgcatatcatgtttgggggtagggtactcaacattgagacgatgtatggggaccctacatatttgactatggggctacgcagagttttgtgagaaaagggaagttccataaggaaccaaaaatgtatcctaccgcagtgaatgttgcgggcaggcaggctatgacttaatcatcatactgctgattggttaggcaagtttaaaccaaagttggactgtcactgtagtgacccgcataagggcaccgagaacgggcaaaagaccatatgagagaaagttgccctaaaaacacggctgattgatcattcatgcccaaaagataataaaccatcaacggggaaaggaaatatctatttgggcaaagatgggcaagattgggcaacacgggcttgccacgggcaaagtttcatcgcccaagtgtcgccattccgttaaggcggcatgcgtgtcatggcatgcgtttcatcatgggcagatgagacgtgtacatgctgactcacccttgccatccctatataaacccaattcgatccaaagaatttttagagaaaaagggagggaaaccgtgaggctgccgagtttcgaagtgaccgtctgaccgagaatcgtgagaaaggtcctattgtcgaggaattctgcccgaatcatcgcaagcgttctattggttactgagtgagttctagatatggtttggttgcatgatcatacacgtttacatttattgattgattttgtgagtcagataagtgatgatttttggcatgaatgatggatattggttgcatatgttatcttttagattcttatgttaaagtgtaaggttgggaggttgtgttgagatattgatgattctatgtgttagatttagattaacaatatgtttaataaaatcttgaactcttgggtcattgtatgtgcagcttgtggtaggaggcaaagatcataagcataccaagatcgtgatatgtctgatgaagtccatagagatcgattcccatttccatgttggaactgggaagctttgaagcagtccggctggaacctgaggatcaatgtttattcgttgacaggaatcacactgacttacccatttagctatcgatttcttcattcctggccaatgaatatagcggcgtaagtctttatacattttggtgctgctagggtgaatactcagtgtagacgagtgggccattcggaggatctgttgtcgtaagtttcctcgatcgggtaccataattctcccgttgagtagcaaggtaccatcattcgccatgtgataaccactagagttgggtccgtctagcgttttcagctccgcaactatctcttgtaacttctcgtcttgttgttgttcttctcgtatccgctgcaacatgtttgattgtgaaatggtttgaagtccaagcggctattggtgattctccatcaacggtaaaaatatttatctgcttgaattcttccagaagcagattcagctctttgtctgcatctaactcggttcgtcggcggctcaaggcgtcggccaccacgttggctttcccagggtgatattggatttgaagatcataatcggcaatgaactccatccatcttcgttgtcgcaggtttaggtcaggttgggtgaacaagtacttgagactctgatggtcagtaaacacttggaccgtctcgccatataaatatgacctgcagattcgtagagcgaacactacggctgccatctctaggtcatgagtcggatagttctcttcgtgctttcgaagttgtcgagacgcataggcgatcactttcccatcttacattaatacaaagcctaacccgactctaaaggcatctgtgtatatggtgtaaggcttaccgggaggtaaggttaagattggtgtggtagttaaagcctctttcagtttcctaaatgcttcctcggcttccgtactccaagcgaatggcacgcttttactcgtgaggcgcgtcaagggtttggtgatggaagagaatcctttcacaaacttttgatagtatccggcgaatcctaagaaacttctaacctccgttgcattggttggctgtggccattcatggatggctgcgatcttctcagggtctgcggtgactccttgttccgaaacacgatggcctagaaatccgatttctctttgccaaaacttgcacttactgaacttcgcaaagagtcgttgttctctgagtctttctagaaccttttgtaaatggtagtggtgttcctcttgacttcgcgagtaaacgaggatatcgtcaatgaatatgatgacaaacttatccaagtagtcatgaagtacttcgttcatcaatctcatgaatgcggtaggggcgctagttagaccaaagggcatgaccacgaactcgtattgtccatatcgagtctgaaatgccgtctttgttatatctccttcggcaatgagaatctgatgatatccggatgcaagatctatctttgaaaaccaactagctcctctcagttgatccaagagttcgtcgatccttggaagcgagtacttatccttgatagtaatattgttaatgccacggtagtcgatacacaaccgcatgcttccatccttcttcttcacaaacaacaccgggtctcaccatggtgatgaactcatgcgtataaatcctttctcaagaagatctcctagctgctgtttcaattctgctaactctgcaggcgccattcggtaagggacttcgcaattgggacagctcgaacttcaaggtaaatggcaaaaggattgctctggggaggcggcaagccttctaatgctttaaacacacccgcgaattgtcctacggttgggatgtcttcaactttcatttcttcttctctatctccaccaaccgcgataagggttactaaatatgcttttccttggactagcatattttcggcacgaagggctgattcaaaaactgccccaacactcgggctcactccggtataaactatcttggtttggtctcctaactcaaataccactctacttctagtacaatctatccgagcatggtatccagataaccaatccattcccaaaatcacctcaaacttccccatgggcataatcaaaaggtttgcgggtagagttgtccgaaggattactacgggtactcctaataggattctacgggtttgaaggggtggttggtcactcgcggtatggataaggatgttaacttccttttcctcaaaaattgtggtgaattttgcgaccacctcaggtgtaatgaagctattggtggctcccgagtcaaataacacatatgtgggtacaccaccaatactcaccgttcctggcaatgcattcacacaccggaaaaaacattctcacaaatcatacacaaaatctaaaaactacttttaaaagagagttagaacccatacaaacctgttacggggcctttaaaaggtcatggggtttttgtcgattctaagtctaacgcgtacgcgttagcaatcgtcgtctctaattttgtcaggggtcctctcgctcctgatgctggtgggggtcgtgagttgtgttgattgtctggtccccggggtttactcggacacgcgtgagagtagtggtcttgacttccacacgaataacaataaccctttggattaccttggcctgtcttcttactcggacatacattggaacgatgcccttcttcacagcggaaataacatgtgatatacgctggcgtcggttgggtaaccacaggacatgatcgtgcgaaatgtcccaactttccacatgtgtaacatgcccttggatcaacatcatttctccttctatcattgttatagcacgttctcgtccgtcctttatcattgtctctctcctgattcagtgtgaatttaggagcgttgtttctggtctctacgttgttagccttccttcctcccgatcgatcactttctttgttcacactcttctccaactcaataccctcctcgacattcactgcatgttcagttagctcattgacactactatatgtgactgcttgtagtcggccccatatctctggcctgagtcctctcaagaacctacgcaccatcaatgcttcatcgtcttgtccgttatataagtatcttcttattcgcgtgaaagcttgctcgtatgatcggacactccttgtctcttgtgctaagttcatgaactgctgctccaatcgatcacgggcctctggtggaaagtactttttctcgaattctcttctaaaagcttcccacgatatcatctggtcttggtccctggcagtgacgctctcccaccaaattcgtgcgtcctcgtccaaaacgtaaccgcgatctgtctcttgaagttgtcaagacatcgaaaaatttcaaaattcctctcaaggtctcttagccacttgtctcccacgaccgtgttttgctctcctttaaacacgcgaattcctaagtctctcatcatcatcacgagcttcaagaactttgcggatggtgattcctctcgctggctttcttggatctgctgctggtgttgttgtgtttgaatcatgtgacccaatagactctgaaaaatatccagggtgtgctgcgtttcgggggctccttggttctgagtttcgggaataggatttccttgattttgctcgagcgatggggattgtacggggttatgcgatcgagacgcaataactctcgttcgatgtatcaaaaaatatcgatccgggcgacgagtgcttgggtgtggaatcgggggtatcccattcaggtaatccatacggctccaagtgaatataatctccggtaatctcaccactctcactcggtatccagttatccgaatccggatactgcgcaaagtttccacgactagacaacacatctctcgactggttctcgtccgacccctgccttgacatctgcatccaatccaacaacgatcttaggtttctaatattcccccccctctatcctaataggaacgacccggattatcctaagtgccttttgcgaccatttactcgataaaacatttgaaaaactggatcctaaaaagcaccaaaccatgctttgataccacctgttgtaacgcccccgttccgtaatagaactcggccagtctgggacgtcacaatggaaatgagttcccatagagtagccgaggttcggaaacacattccgacccttagcccactcaaggttgcctatttccccacttgggatccatttaggcttgccaaccctcacttgacccaagtgttgtgtcgactcggactaagtcttatcagttgaaacacgtatactttaaaataaataccgatttcattaccaaagagttatgaaaatacaaggaaaaaccacaacataaacatcgtttttatggccaaggcatgaggcccaaaagtacacgattctaaaatacatactttaacttttacaaaaggacattgaaaaactactccgggttccctagtgttcaccactccctctaatcccctcaaaggttaccttcaaaacaagtagagtcatgagtaatctagcattactcaatgagctcgggttcccaaagaaacgttagtctaatccccacccataatccccacatgcataacataaataatcatagtacatagagaaggtagtaaaccacacaaacacaacaagaacaaaacgtttcttaaagttttaattagggcccggatgcacttcatgcctccacaaatcgtgaacacccgagttataaccacaaaggcatataaccggaacatcaccttggctacaccgtcgtgtaaacgacaccgacccttgggtagctaacccagtctctccgggtccttcgaaccccttggggtcacttgcatctcgtcaagcacaccccacgaaagaacgaaatcacaaggtaaggtcagatacatcccacatgaccgtagtatgcttatggagttaacttggatactcccaagttccacacactacgaccttccaatcgacaatatgaaacgtgcggttcgttttcaacgcgcatgaacatagagtcctcttactaagtctactgaatactagcgagtagtgtcttgacaacgcaaccatccctctcgaatgaatggtgctaagctaacacaaccactcctataggatatggtgcttcggtctcaactgtcctagctattcgaataaacaacctcaataataacaaccacaaagcaaagaaaagagagaatagagaacatgcaagaagaaacgaaaatcaaacatgcaaaacaaaaaccggaactcacaatcaccgatgaaccttcctaacttgaccgatggtttctactcggaaactctctcagactatgctgaggctcggcgatctctaactctctcttgggttaaaagactcggacgaactctctctcacgggttaaaagactcggacgaactctctctctcacgggttaaaaggctcggacaaactctctttctctcttggtttgggcagagctttggtgcgaaggcttctaagggttaactaagcgagggttgggttctatttatagagtgaggacttgtgtaagggaagggagataaaacttggtcaccaagttggctctaggacgaaacttgctcaccaagttggctcgcccaggtggattcggctctaagttggctcggatggcttgggacgaaacttggtcaccaagttggcttcgcccaaatggatttggcttcaagtttcaagacttgggctctactctggcttctgcgggttataaatactcggcccctcttctcattctcgcaccattctctcttctttttctcttgcccttctttcttgcccgggatcaatgcgcggggtactacattgacagccgctccaattctagcagtgcgggagccaaataaaccatatgctctttataccgacaactcaagtgttggcttgggatgtgtccttatgcaagaaggaaaggtgattgcctatgcatcacggcaattaagacgacatgaggagaactatcctactcacgatttagagatggctgctgtagtattcccattgaagacacggagatcatacctatacgggaaaacaatacacatgtttacgaacaaccaaagtcttaagtacttattcacgcagccagatttgaatctacggcaacggagatggatggaattcatcaccaattatgatatgaagatttagtatcatccggggaaggctaatgtggtggcaaacgccttaagttgccgaaaaacggaagtagatgttgagaaagatctagagtcactaaccgatgagttcaagaaagtaagtatgttaactttaaaaggtgaatctagtaagcccttgggtttgcaagctgtgactcaagcaagcctacttcaccgaattcgagaggaacatgtgcaagatgaaaagttgcaagaaatcgtggagaaattaaagacattaaatggtccgaatgctagtggttatcatctagctgatgacgccactttactactcaatgggaggattacattgcatgcccgtaaaggattacggtaagaaattttgagggcagcacatacttctttattaagcattcatcaaggaagtacaaaaatgtacaaggacataaggaggtattatcattagcctggaatgaagagatcagtggcaaagtgggtaatccaatgtgattcatgccaaagtgtgaaggtggaacatcaagtgcaagtaggtttactacgcaaactaccaattcaagcatggtgataggagtcaatctcgaatgcgggaacagaagaatataaggattctacaaattcatgtattttggggaaagcaaaatcgtagggttactacatgggaagatgaagagacgttccatgcaaagtatccacagttttctgaacagaaaatgaagaagatgaagccggaccatccaatccttttggaattcaagatgaattctattaaagggggagaatgtagtgacccgcataagggcatcgggaacatgcaaaagactgaatgagagaaagttaccccgaaaacatggctgattgaccatacgtacccaaaaggtgataaacactcaatgggtaaaagaaataactatatgggcaatgatgggcaacacgggtgtgtcacgggcaaagtttgccccatcggatatggtttctgagtgttccggatatggtttggttgcatgatcatacacttttacattcattgattgatttcgtgaatcatataactgatgatttatgacatgaaggatggatattggttgcatatgtgatcttttagattcttatgctacagttatggatgggaggttgttttgagatattaatgattttatttgttagattaaccatatgtttcataaagtcttgaattcttgggtctttgtacgtggtgcttgtggtaggaggcaaagaccataagcataccaagatcgtgatatgtctgacgtttgtagggaaccgtgctatgatggggtcttgtaacgctattaattgatcgccatgtaatgcgaaggacttgaagagatggggctagctatcctggccgagtgtctacacgacggtgtagcgttttggtagagatgatccagttacatgactaggaaacccatgaggaacacgtaagggcagtgttaacgagtctgtgggagcagaagctcttcgccaagataagcaaatgcagcttttggcaaagaagcatatggttcctagggcatatagtgtacaaggaaggcgtctcaatagatccataaaagataaggactattagagaatcgccgaccccaaaaaatgcgaccaaagtaaggagtttcctagggttgacatactattacaagaattttgtgaatggattcgcaacaatagcccaagccatgaccaagttaactcggaaagaagcaaaattcactttgttcgaggaatgcgaaaaaagtttccccaagttaaaggatatgcgtacaagtgcaccggttcttgttttgccggaagccgacgagcgctatggagtatatacggatgcttcaataaaaaggctgggttgtgtacttatgcaaaaagagaaggtgatcgcctatgcctgtcggtacttgcggaagcatgagggcaattacccaactcacgacttggagatggcagccttgattttcgcacttcagatatggagatcatatctctatggatctaacatgcaaataatcaccgaccacaagagtcttaactatatattcacacagccggaattgaacctctacaaaggagatggatgaaacttgtgacagcttacgatattaacatagtttaccatccatgaaaggcaaacactttggccgactctctaagccgaagaagggcataggtaaccacaaaaagaacaaagaaaaattgatcgaaacaatcagtgcgatgagtctcaatgccttggaagtagatatgaaaccgttagggttaagtgtggcagacaaggccgacttactaacgcgaatctgtataggtcaagggaaggatgagaacttgaagaaggtaccaccgaatgagaaaactgagtacgaaacatcgaaaaacgggacaatcgtggtcaatggataagtaagagtactagacgacaaagaactcaaggaagatattcttcgagaagctcaccaattcaaattctcaattcacctagggatgaacaagatgcaccggaacatcaagaggtactaccaatacaaaggcatgaaaagagatatagcggaatggatatcctagtgcccgacctgaaagtcggtaaaagccgaacaacaagtctgagtggcttgttacaaacgatgtcaatgcccaaatggaaatgggaccacattacaatggactttgtaactgggctgcccactacacgggcaaagaaggacgcaatatgggtgaaagtcaatagactaaccaagtcagcccatctcattgcaatcaagaaaatggatggagtgaaagctatagccgatgagtacattgatgagattgtaagatttcacggtgtaccggtgagcatagtacccgttggagactcacgattcacttcccatttttggaaggcattccaaaaagctttgggaacaagaatcaacatgagtaggacctatcaccagcaaacggacaagcagtcggaaaagactatacggacgttggaggaatgtctacaacaacagtttccaagtgagtatagggatgtctccatatgaagctttatacggctgaccatgccgcacaccaatgtgttggacacaagtaggagagcaaagcatgattggggcggacttataaatacaacccattcggcaaagcttgtggacacaacactatacaccaaaactttcaccaaaacttaagagagaaattggaagagaaacactattctttcgaagggtacaagcgacggaaagagatagtggatgccttggagatcaaacctttggtaactcccggatcgatgaatccggcggaggccgagaaaacaactggtctaatgaccatggtgaggcataactgtaccaacgtgagattgaacgatctatgaggggctagggaatttggttaacgcatcctacttatgatattttgttctaacgatatgtgatatgtctgggggtgaaacatggggagcatcatagcatgtgcatgatcgcttagtgtaaaccacaacaatcttatctttcgttgatatcaggatatgaccaagttcgtgggaaggatttggcttagcgggagggatggctttccgggcaagtgggaggtgtcatcatcgcttccaagtgtagttataatgaagttccaaagaagaaagatgacagacaaagacagtggttgtctcagaacaagtcaatgacataattccaaggaggattccagagaagctacccgacccacgacgctttgtacttgattgctcaatctcacctgacaggtttcctagttctctttgtgatcttggctcttgtatcaatttgatgactcattctattgttgtaagacttggaatgacatatttcaaggctactaggattactcttctcctaggtgatcgctcaaagagaatccctgaaggtatcttagaagatgttctactgaaaattgcaaaatgcttgattccaaccgacttcgtggtttttgaatatgaagaagaacctccagattcccttattatgggaagatcattcttagctactgctggtgctcagatagacgtgaagcacaaccaaattgctttgcatatgtgtgatgttattatgactttttacatggacaagatgaggaaaccacctatgattgatggtcaggcattctctgtagagacctctagagacacaattgttgatcctgaccagctactaagtacaagcaagcgtccacatgaatcaagctccaaaatatttttatttattcatcaatatattaaatttgagctcacataaaagaagatacatgtcaccttgtatatagagataactttaatttattatatactagataacaccggcttaaataggggggtgtaagaaataaatgctaattttaatctctgatatttgagttctaaatcgtagttaacacattctattatgtgaattttaacaaaaggaaaaatttcttttacgataggtgtatcatgacgtacaaacatcagatttatcaatttgcttgatataaccaattacatgtgtatgacaaaacaaaattaatttaaataaatgtatatttattaaaatttaaaattcaggatattttaaaatttagaatttaaaatatgtatcatgtaacggttttgtcatatgtttcaattttgcaaaattctcgctatttcggaatcaaatttttttgagagatagtttacaaaattgttgatcgacaaatgtgattgtcgttctttttgttagtatcatctaaaatttgtgatcagagactttgatttttttttcataatttgaattgctatttttatttaataagatacatatagcttccatataattatcctcgttactttcttaaaataaattctttttttctaaataaagtaaaggtttgttgcactttgaggcactttgggaaaacttaagtgaatatagacactttcaaaagttgagggactttccctttttgtttagtgaaaaatgacaattatgtctccgaaaattagaatccggaaatcatgactaattggtcatcggttttggtattggttaattcgaaaaagtaaaaacggttaatatgtgcagtttaaaggagcggatattaagaaaggagggtcgtccaatcaaaacaatttcagcatagcgagatgatgatcttcaaacacaacaaatttacgttgtgttagatttgctttttgaaaaacaaggagttaaaaaaaactagtttctaggtttcaatttttggcttattaagatggcgaaggaggtacgtttgtggaaaatcgcaattatcaaatcccaatgtcgttcatgctatctattactgtaatcagtaactaacaattttttttttatttatatgactagggtttgatggacgactacattatggttaattgtggagagtggttgtgttcttcgaatggagagttgaaagttgaagacatgtaacaaccttttctccaaggttgtaccaatatatgaggaaataaaattgggtgcgttgaaagaaacaattctggaggatttttgtgttaagggtgtcaatcctttgttaagttactctgtaccaaataggaatatgttcgttacaaaggaaaagactccaccagttatggttacaagcgagattggccttcaatactatctaaagggccttagagaaaacaggggtcttaacttgtttgtgaagttagaggataacgttgatgagtttcaatgtagggaagggattgatcatccaaatatgagttgtaaaacacctggaggtagtatgaaacgtaaattaaaagtatgcatgatacaaataatggttcaaaatatggtaacaagcatgctggtgatatatcttttgggggttcaaaatcgcctaatgttttgttgactccggctgatgaagaattcataaaatgcattgaaagaagcagaagaaaaaataggaagaagcggtgggctgaaatcctccccgactgatatagacaacgaaagtgttatcgttgatgatgaagattacttatttgtggataataatatagaggagaatgaaggagagagggatatttctgatgatactatgccttgtggcatatatgataaagtgttatggggtaatttcctaacgaatgattatggtggctcaaatgctgaagagttgatgcctaagggtggagttgatgcaaggtacattgataaatctcttagggattgagaaatgtagcaaggaagttggaggaagtggatgatgaggagtttgatatcccacccttatttaaagacatcgagtatgagatagagaacatccctgatttggatattgacgatgatgataaagtgatatacaaggggaaagtgtatacaagcaaagaagattgccaaattaatgaaaaatgcatgatatgagttattcacctttgtaggaatatccaagctaagtataagaacaaagctttgacgcagttagtgaaaaatgcatgatatgagtttacaagtggagagtataaagagctgtatggtcagactaatgccctgaacctagattgcagtcagtatctacatggcaaagggatggctagttggacaaggctatatttccggggtcagcattttaatttgatgactagcaatatagaagagacgttaaaaaagcgttaaacaagcgaagatcgtcccatattgagttgataagatttattaggtctatgttaactcgatggtttaatgcgcgttttgtttgtagattcaatacgacaattgatgtattctggtcatgatcacagattgaaacaagaggaaatctattgtttatttgatttttcaacacctacctatcgtaaatgttcaatatttttgtttcccagtagacataaatattgtgaataatttacgtggtgcctgcttctttgattatgtgtttttgcatcctacgtcttcttcaagttatattgcactagttcgtatggtgagagtaaaaattgaagtcatacagaaaaagttattgtcttttccctggttttacatagctagactatctaatctgttgttaagaagttaggaaatgcattgtaactttatttctctaatcttttgataccacatagtccaaactcatctgagataccaaatattttaattataaagaaaacaaataacaaatgatgataacctctcacaacaataactgtcacgacaataacctctattaccactaccataaccaccaattcagccctctcacgacaataacctttattaccataatcataaattaagccctctcacaacaataacctctattcccactactcccataaccataaattaagccctctaacgataataacctttattaccattaccataaccataaattaacccttaattagcaccactttgccataaccataaattaacccttaattagcaccactttgccataaccataaattaacccttaattagcaccactttgcccagccttgttcttattctcattcttcttctcatccttcttcttcctctattgctctttgaatattgtgtcaatctctgcatctcattttcttagcctccctctagcctcccaatcatgcccttagcgtccttaatcctctacaaatcacggaggctctttttcttcttgctctcccaatccttcaccatctttttgagttcagctataacatcgtagtcttttggttgagattttctcaagtcggccacaatctcaccttccacctcttgacaaatcatgaaatactccggtatctaactctattgattattcataagcagcttcaacctacggctctcgggtttggatgtaaagatcacactttcatcaacaagtgtgaacgagtcatcaaagacaacgacctcaggttgctcaaagacattctcctcttccttcaattgcttcacccacacactcactccaaacatgccaagatgattccggttattaattaaacttatttgggtgatattctctcgtccactatcgaatctcctgctggatcccaaaataaaaaccttcagtgcattggtctttgatgccattgttgttttgaataaaaaagaaataaatgtgtgaagattgagttgaaagcaagagaaaagtataatgtgaaggcagtgtgagaacccttccgctgtttatagccactaaggcctccattcgtaatcttcgtcaaagttatgatgtaagaagatcttcaagagttttaatgtaaactttcctcttttgagttctgatgaagaatatgcatggaacctttttacagagagttgaacggacttgttttggtgttttcctttctttttttttagtctcataccttaagattcaagatttttaatgtatgaaaagatttattaggtgagatttgtttctggtaatagaagattttattagatcatttatgatgtgcttttggaaaacacgttgtagagaaaatatacaataaacacttgttcaaattggatttgtacaaattgtcatattatgacccatgcctttacaacgcgagaacagttctgttgcgtccttctagtcttaggtttctatatttattatgtccaaaccacattatacattagggtttaacaatcaaatagaatggactactttagctaaatttttatctaacattttattcccatgttgatagaattctggctacctctgccaattgcttcatggtatactgattcttggtaactcaaaacccatgagtgtggcttgaaacaattatcaactaaagtcttgcaggaaatgttaaaactattcacagccaccaatgcatgattacaagggaaccttagtttatcatacctctgtcaagtgcactgcttattttcaagatcaacaacatatcttccacctaacatgtcaagtatctcatagctccagctgatgatccgttcaaccttgcttacattagttgttaagatgattttgtgatttgcttgtcaacttccggaggaacagtacctttatgttcttgagattgctatttagattttgaacagtttttcttttgtaatgtcatgagtagatgtaatgaatctagtaattatgatgtattggatggtagttttaatttaattaatttgtcttaaattagatgaaagagtaagtgatttatattgtctatgttcaacaaatactatagcttaataatttaatatgattacaatttatacatctgagtacgactaatagaagtatcttaataaaatagggaattataaggatgtctcaaaatatgaacaagtagatgcaaattgaatatgtatatttatatccacatttagctgaccattcgaacatatccaaccatttgtgtttttgaaattattttggaaaatgtgttcgttattcatgttgcaaaatcgaaagagtctctatcagtcatgcaaacaaagatatgttgacaaaaaatacttatagtgagagaaagatgttcgctaatttatatgttaaatacaacttcataattacatctacttaacatttttgaagtacaaaataaggaatttattgggtcgggttttgttttgggttttacccactttttttgaccggatctttggcccaaatcatgttaattggcccatcaacctccaagatttcgtctccttcaaatcctctcacacctacattcactcacacaatgaatcacggaaaatcaatctcttaatcaaggcacaaatctattacattcagttttcctaatctatcaaagaatctttactaatcaagttgttgatattataacttccatgaatcttacctatcatttacctataattgctaatcgaatcaagctcattatattctgactatttatctttcaaaccatttatattcactgtcctatgataacgcttatttgaaatgcagttaccaaaacaatcaaatccatatctactctgtttggaagttacattcaagatatgacagtatctacttaacatattcaatcgccttcaatataaagatattgatcaagccgcatatccagcttcatttatttgcagagaatattcactgattgattctaaaaagattacgcctactctataatctaaaaccctatacaatctcacaacactataaatatactctatattgcataccatttctacacattgcagaatatcaagatatcgttccatttttgagaatcactttgcttacctttcaaatggttgcctcttttgcgttcctgagagatgtccgatcatacaagacctcatggcgtgtccaagtcaaggtgcttcactcttggcgtcaatacaccaacatgacaggtgaaacactcgagttagtgttggcagactcacaagtaagttaagtagatattgttttgacgcatttgattgcgaccaaatatgcactatgttattgacatgtgctaaatatttgttttctgtttatactagggtgtcaagattcatgcatcagtgaagagggacttggttagcaagtatgtgaacaacttgcctttgaatgagtggaggtttatagaaacctttgctctaaaccatgcatcaggtcaattccgacaagatgttattggtcaagtggttaatattggtgagcttgagactctcgaggctagcaacaaacctaccacaaagcttgacttcgaattaagggacgacacataagtctatgtaccctgacctaaatcctcaagaatgtaatttagaaagcaatctcttgatatattgttttgtttagtgatgagggaatgtcctctactttatggggagcatttgctcagagagtttttagtgcatgtgaatctgctgatggtcaaatggttatttgtgttctgcgatttgccaagattaagtcttacaaaggtacatgtctactcttaactttcttgattttactcattgattataacatttatgaccataactaaaatacagtttctaatgtatgtaggagttaggactttttctaactcttttgatgcatctcaagtccacatcaacccgaaatttccatgaagttcaagcttttgtttctcgctttgttttctttaagagtctgtttatttgatagtgtaatgttgttctgattccgtttatatgatgtgattgaacagtttacctgctgatggtctttctctcactttccgtgagagtgttccaaagtttcaaatgattactgtgaaacaagattatgactgttctcagtatgagaggaagtcaatccgtgatctgcttcattctatggaggtttgagttctaaattttagcagtactatgaatttgagtaaacatatacttatataaattttcatttcagattggaaaagttagggttgtctccaccatatatgctcttgacttggattggtcatggtattactttagttgtcgtaattgcaacaagaaagtgactcacattcatgctggtgttaacacaacttcatcgaagtcatcaaaaccaaggttttggtgtgatgtctgcaagaatgcagtcactaatgtgcaagccaagtaagtatgcctcacagtttaattgctttgttctaccttaactagcaaatgcacacattaattgacccttatataatttaaggtacatgctttatgtgaaagtcatggatgacagtggtgaaaccaaattccttctgtttgataccatctgtgcagacatggttggtgaatcatgtacatccatgttaggtggctcttttaatgaggtatactttcaatcgaaatagttatcttcttatgtatgtggaatctaatatgttgcaagtgtatataaactggctaactaacaatttatggtcttactatttagattgaggatccaaatgatgtccctgacggtttgagaaattttggttgggaagacttttctatttctggtatctgttgagaaagaaaacatatgggatggtaaggattcttttaaagtcacaaggctattgtctaccgatggtctctgtggtgaagcggtcctcgaagactcagaccactctgtcaaccctgcatccattgtttctggggaccaggtatgattctacacatgttctccttaacaaatcaggtgtaaattatatagtatcaatgaaacttttctaaactctgttttcgtgtttacagtgtattatgttaacttcgagccagaagacttctaactcagttacttcatcatctaagcgtgtttatgctacaaagttgtcagactcggaacaatcatccagttccaaaaagctttgtgttcagccattggatttggagaaatctgaacctgatattaatgatgaagtcgctattaaggaggtgaagactgctgagataactgacattgttgaaggtgcttgaattacagataaagggaagggtgtgaaatgccacgaaacacctcaggtggtagtcaagaaggctccaaataaggtggttactaagcctatgcctgtgaggatcaagcaggaaaagaagtgacatgttttcaagttgtcttgatccatgactcatgtttatgttggttttagaagttattgctttggttttgtttttcgaacaattgtttaagtttaataccttttgttcaatcttgaatttgtttctttagaccttgatattaatttgtttctgtttactttccttaattttgattattaactattttattaggttatacatataatcaagctaatgttagtaaccaacaactaagagagtgaatgcctataatcaaactaatgtatatgggactctgactgatgcatataagtatgaatattcatggaaagaggatatttaccttatgctcatggtgaacttcatatatttgaattcctgaaaacaaatgtaaatatttagtatacacgcaataataatttacttagtttcaaaaaaataatgattgtaatctgaagtcgaaagatatgtaatctatgcaatcattagaacaaagaagtttctatcttttgattggatcaaggatcggttattcataatctcgatattttcattatatttcattgtttatattaggaaatatacataactcaatcgtttcgactttcctatcctttcaactgtctatatatatgaaagacctttggttaaaaaataaaactatctcctctcttaacttctctgtaaacagtttccttaaaaactaaacctaatgggtaccattgactatatccgtgatttcaatctcgagagaaccaactgggtcctctatgtgaagatcttaagtctatggaaccatctggctgtcaacaatggtgaaccgacaaccatgattctctgtgatgagaatgtgagttcataattcaactacttgtgaagttttcataattttgtttctgaaacctgttcataatctagagtatttttgtttacgcttcacagagatgcagaatcgatgccagggtaccttctcgaaattatttgtataatttcagatctaccctacgtgagggaacgtggtattacatggcagacttgcttctgaagagagcaacttcaacaacaaagtactcatcatttatttatgagatcaagtttatttggccaacaacaatgtggcgtgtaagtcctagatcgactcagatttctctgcaagtaatccattctgatgaggttgaatatgaacctgacacttatgttaatgataaactaagttattcattctaatgttcttatagttacagttattgcataaggaaaatttacagactctgacttaactattttgattgtaagatgttgttggaatcatatcgagtgtttctacttttgcgaggtttccttacgtctatcgtgaaggggaaactgactatgaagccagatatgtgaagtttactatcagagacaatctgtaagttacattatctatgtaacttgtagacatgtaggtttataaggaacagaactgtctgatgattggtttctttggattgttgtttgttgtagtaataggataaccacatgtgtagctaaagggagggcctgtgagttatttttgatcaagttttatcgacggattggtttggtcacttataactttgagccaattgttgctgtggtccggttctggagagttcatgatttcaaaggttagttaaaattcatctataagtaggcgctttcatagattcatgattatacaatagacatttaaagtagataacaatactgattttgaagtctcttataggatccaatgccttattcagtgaggatggatgttctaaactactcattgatcctttatttccagactatgatcttcaaacttacatgtatgtgaaatcgagtagtttatattaactgtacaaagacgtattcctatactttttccaagtgaattgagttttattgttttcttacagtggttggaatgcatatggagatgacgaagtggttgatgggaagattgattatgtaattgaaaactaaagccgtgttcttatttctgttttttgtctgaactaatggattgttgtcctgcttttgaagtcctatgactcttttatttatgttgtggttcctttgatatttcccaaatttaagtacctatttgaacttcttattttgttgatctactgttaatatatgcttatgttattagttgtatcatagtcactaccagtatttttaacaattttagaaaaactagattagtaacttgcaaaataaaattttgaaatgtgtaaaactcaaatcaatttaaaccaaatggaagccagttatatgataaaaagatggatgtgatataactgagtttttcatgttgaaaaactgaatttaaaacacaagccaatccaatggttcttgaaaacacaaaaagaatctgattgttttcaaaactgtaataatttattttagatattaaaaaaatctcttgaaaattaaattacataaaagataaattggaagccataagttatatgaaatataaaagtcatcttcttatcccattcatcttccacacaagaacaaaaacgtttagagagaaatataaacacttttctgaaatgtcatttctaaagaccttctcagatgtgcatcctagaaagacgagatggtttgtctttgttaaattactccgtctgtggaattggcctccaaattatgatggagaagaacctactatgattttggctgatgagaaggtatggaagttatgtctaaagctatgcctgatttataattgtggatttttaattatcactatacacattcatgcaagatttagtcagatttacaaaaactttctcagggaaacaaaatcgatgcaaattctcctctccatgtaaagaaagaagtgttgatttcaacacttaaagaagggcaatggtatctgctatcacattttgaagttgccgtggctaatccactggatagattctctaaccatgtgttctaacttacgtttttaagaaagactacaatggaggaagtagcttctagaaaaagatgtcagtttattgattgttagcctttataccggatcaagcatgcttctactgttgagaagcaatttgttgttggtcagcacttgagtatttgtttttaactatgttcggactactatatggcttacagatataaatactaaattgtatgattcttggtttttatatatttacagatgcaatgggaatcattgaagctgtgtctccaatcggcaaaattccgtggtaaagagggagtttgaaggtgactatgaatctagctatccgactttcacaattaaagataccacgtaagtttatcctcaactatcatacattgtacttaggttgatgacacttttggataatggattcaatgcactacatgttataggtcacagttaatgaaatgtgttgcaataggaaggtcttgtgatgagtttgaaaaaaaatggtacaagaaaataagcgagatcaattttaagatggagcctgtgatgattattctccgtttttggaaaatgtctgagtttcaaggttatattcctatttctttctactatgattgttctactaggatatctaatttatgaatcagataatctaaattatgttttatacacaggaaatccatgcttgataagcgttggtggttgttcaaaggtttacattgatccaaatttcagaggattagacaagaacacctatctgtaagctacttatttattacagaatcaataacctttgaagttttttaaagttccatattaactttgtctatttgttgtctatttgtacagccgtaactttgctggatcagatgatgaagatgatgacatttttatggagactgtggagtccaatttctaagttatcgatatgccattttaaatcccagtgtactaagcttcatataactaggtttattttcttctgttctatgttggacttccttggagtactttatattatgaatgcttatgtctacttttatctgaatataagtagtgtaccaacttatattcagcataacatgttttacaggaaatgctaacttaaactactagagtaaaagaagaatcgtattacctttatgagtttgctatcttctctgacttgaaatgcctgaaattatagtaagagaacaaacttagtattattactgaattatttggataatatgaaaaatccgtgaaggaaataactataaacaaccattattcatgtagctaatgaatcaaaatacttaatcatcattatctacttaacatagttggaatcattagcaaattttagttctgtaatttgattggctacagagtcggttatgacaaagatataattgattaaaggatgtgaacggttattgaggaaggaaacctttcatatagattcactaaatcgttacaacattcctctccattcaatatatatataaggcaaagggtaggttaacttcagacaatctgtactcacttttaaatctgtatcaaatccatacaccaagatatgaccgacacaaactatatccctgacatgaatttgcacaggaaaaatcatgtcctatacgtgaaaatcttaagcatctgggaccatcattctattatctgtggaactcctgctaccatgatcctctgtgatgtgaaggtttgttctagaataaattttttggtttcctattttttgttcttgctttctattgtattccaaagaacttgatatgtttttatttttttccaggggaatagaatcgacgctagagttccttagcgtgattatttatacaatttcaagcctagcctatttgaaggaaaatggtattacattcaggacttccgattgaagagagcaacttcaatatctaagtactcagattacgtttatgaaatagagtttatgtggcacaccaaaatgtggcctataagtgatagatccgatgaaagttctctccaattcatccatgctgatgaagtcgaatctgaatctgaggattatgtaactggtaatctaagacttatctatatagtttatgctttctctctattctatttccttagtactaagatttataagttatttgattgctctgttgttattgttagatgctatttgagtcatatcaagtgtctcaactgtgtcaagatttccatatgtctgtcgtcaagacacttgattttatcttcattttttcacatagccgagtgaagcacatacaaactggaccatgagtaaaaaacatacatcaaacaatgagaatattgattcgtcatccaatccgccaaaaaagaaacagattcaatcacttatgtttcaaagcattaggatgtctcagtggaattcaccttcgtctcacggttatgtcccctttagttctgttttgaacacagttcagcgtgatgtaagcaacacctctcagttacacaattcacccaatgttagaggtgaggtgtccacccctaatatatctgcaagacgaagacaaacgtcaaaaggtataaaataggatatgtacctgataaagaccagtttgtatcagtatatttcaactcattatactgaacattacctctcatttaaacaggaatgccacttggatctcatattccgtctacatatccaatgtcaagcataagtatgacaggttgtactccatttgtacttagagatatcaccaattcatccgttgggccacatggcagaatggatggcacactgcttacgtgtcctgagactgaaaaaagacagagaaaagattagtaactaattattcaaactgtgaatattttaatacatgtggtttatgcaataaagtttttgcttataggcaaacaaactatcaatgattcggagtgcttgacccaagaacaatcatcatgtgtcaacaccagtatacttaatatgccaagaaaaagtctgcacatagactttgctagagtaagttctgaatctaatgttgaaggtgaatgattatctataagtattcctatatgtactaaaacctagccaactctgtgttttgactaatcatctacttaacattatccagtgaaactatcaagcacaactgcagatcacactagcagggatgaggaaatgtatgatgagatgaacggtatcaatctcaatgaggaagaggaactagaacaaaactatgacataagtagcggtgaagatgttgggtcaccaatcagaatacagagaatggatttggatgaggcacaagacatgggaacttgcccatctgtcttatctaatgaagctatttccacagaacaagcatcacatgattccataggtcaaaagagcaaagaatcagaatcactaaagataaagaaaacacgtcggaggactacaaagagtatacctttaagtatggaatccgactattgcttttaatttacatgccttttatatagacttattaagaaggatattgattatggttatttgtttctcagcttatcttgatcgtggtgaccctacctattagtgtaaatattgtggtgcattgatgtggtatgatgagcgaatcaacaaaaggcgcaatctaaaagatgatgcaccttttacactttgctgtggacaatggtcagttaaattatcttttcttgaagagtcaccagagttagtaaaggaacttcttactgatgatgatgcacagggtcggaattatagaaaacatgcttggatatataacatggtttttgctatgacctctattggcggaaaagttgataaatctatgccaaaaggtcaaggacctatcatgtttcgattgcaaggaggtaactatcatttgataggcagtttgaaactttcggaaggtgattatgcaaagtactcacagttatatatagtggatacagaaaaatgaagtggataacagagctactgtaatcgggttagcattctcaaaaccaaatcactgaaacataagcaatgacctaacaattttggttcttttttgttaacacattttatgctctttctataattgtagaaagggaaatgatgcaactaacggaggtcgtaagggcaatctgaacaaaaaaaacaattgctgccataatggatatgttaaacgaagttaatccatatgttgcaatttttataattgccaaggacagattccaagctgctgactgctaacctttctgtatgagaatagccattggtcgtaaggagaaagatcaaaggacttacattaggcctactacatcagaggttgcagaattaatcccaggggattttgaaaatggtatgcctgaccttgacattgttattcaagaaaagattacaggtcaccttactagaatcagtcaaattcatatttcctatctagctttgcaatatcctctaatattctgctatggtgaagatggttttacccctgggatagagaaatgttacaaaggaaatgacaaaaagaagaagcaaaaatgcatatggttcaaagttattatgatgctatggctatatgcaaacactatggatttcctgatttattcatcacatttacatgtaaccctaagtggcctgagataacaagatatgtcaaggaaagaggattgactgctgaagataggcctaatattgttgctaggatttttcaagatcaaattagattctctcatgcatgatccaactgagaagaaaatgcttgggtagactgtcgcatgtaagttaatttatttcactatcattctgtacttaaattgttgatgtcatttacttacaataaatattgttttctgatcgcatcaatgtatacagttgaattccagaaaagaggccttccacatgcacacatccttctgtttatggactctaaaagtaaattgccaacagctgatgatattgacaagatgatttctgcggagattccggataaagaaaaggaacctgagctatatgaggttattaagaagtgcatgattcatgggccatgtggtgcagctaataagaattctccatgtatggtcgatggcaagtgttcgaaaaattatccaaaaaagtttgaggagataaccaaggttggtaaggatgggtttccagtctatagaagaaagcaatctcataactatgttgagaaaagtggttttagatgtgataataggtatgtggtttcttacaataagatattgtcagttcgatatggtgctcatatcaatgtggagtggtgtaatcagaatggttctattaagtacttattcaagtatataaataagggtccagatcgatttgcatttgtggttgagcttgataaaccacaaacaacatagactaatgagaatgtcaatggcatagcagctggtgaagaacccttaccaactaagaaaaagaaggacgaaatcaaagattatttcgattgcaggtgcttttctacatagtctttcccagctttgcatttatataaattgtcccgatatagaatttatagtttatttcttttctatattacaatttcagatatgtatcagcctctgaagcagtttggaggatatttaagttcccaatccagcatagatcaactccagtgcagcacctatcatttcatgttgaagggaagcaacccgcattttttaaagggaaagagtctataaaagaagttttggaacgtattgccaaccaagattcccaattcatggcttggttgacattaaacaggaatgatgttgttggtaaaaatagaaaacgtgcacgtgatctcttatatgtagatatcccagcgtattttacttgggatagaataaataaaatgtggaacaaaagatcatgtggattttcattgggacgtagaaattatgttccaaggaaattagaagatgaatattttctaagtgttctgcttaacattgtcagaggtccaacgtgttttgctcatatcaagacctacaatggtgttgtctacccaacttacaaaacagtctcttttgctcgtggtattcttgatgatgaccaagtttacattgacagtttggtggatgcaagtcaattctgctttggtaatttcttgaggaatttctttgcaatgttgcttctatctggttcattatctagaccataatatgtttgagaacagacatgggagttattatcataggatatgctggaaaaaaagagagatgactataacaatcaaggtatgatcgtgtctaagcttcattcatttcatttcatatatatgtaatgttacatatgaattcacacatcatttattgttattcttcttttcagagttggaattaacagaagctgaaatcaagaactacactcttcaagaaattgagaagattatgctgtttaacggaggtacaattacagagattgagaactttccacagccaacaagagaatgtattgataactccaaccggttgatagtagacgagatgagatatgaccgtcaatatttgactggcaagcatgctgagtggatagatatgcttacacctgagaagagaggtgtgtatgatgagattacaggggctgtttttaaggatctaggtggagtgtttttcgtgtatggatttggaggcacaagaaaaacttttatttggaagactctatctgctgcaattagatctagaggtgacatagttctaaacgtggcttccaatggaatcgcctcattgttgttagaaggtgggaggacagcgcattcaaggttttctattccacttactccagatgaatatacgtcttgcagaatcaagccaaaatctgatcttgctaatctaattagaaaagcctctctcattatatgggatgaagcacctgtgatgagcaaatggtgttttgaatcacttgataagagtttctctgatattattggtaacaaggataacaaagtgtttggtggcgcaaggttgttgtctttggagatgattttagacaagttctccctatgattcccaatgcagggagagctgaaattgtcttggcagctctaaatgcttcatatatttaggatcattgtaaggttctaaagctaactaaaaacatgcgcctgctaagcaaagacttaagtgaagaagaagctaaagacatcaaagaattttcagattggcttctggcagttggtgatgggagaatacctgagccaaatgacggagaagaactcattgatattcttgaagaactattgattacataaacaggaaatccaatagaagctattagtcatgagatctatggagatccagcaatgttaaaagttaatgaagatcaaaaattctttctaaaaagagttattttatcacctaccaatgatgatgtgcacacaatcaatcagtacatgcttaacaatatggaaggtcagttgtatgtgagcctagagttttaaattttcttttaagacaattaaattttaatttattaatttaaacttgcaggtgaagaaagaatattcctcagtgctgacagtatagatccttcagattctgactcattgaaaaatccagttatcacgcctgatttgttaaacagtatcaaactatccggtttgccacaccatgaattacgtttgaagattggtgctccgattatactacttagaaatcttgatcctaaaggcggtctgtgcaatggaacaagacttcagattactcaaatgactatacaagttcttcaagcaaaagttataattggggacagaagtggagacattgttttgattcccttaattaacattacaccatcaaatatgaagctgcccttccggatgcgtaggagacagttcccagtgtcactagcattcgctatgaccatcaacaagagtcagtgacaatcacttgagagagttggtctctatttaccgaagcccgttgtttcacatggccaactatatgttgctctgtctagggtcacttcagattctagataaagcagggaagattcaaaagcaaacaacaaatgttgttttcaaagaagtttttcagaatatcatctgaaatctcctcaagaatgattcgtctttcattcttatcaaaaggtatgtttcattctttaatcttttattgattagttgcttcatggttggcaaaacccaaaaaaatcaaagttattcctgacaaaactaactgtttgcatctaatgaacaaggcaattacaagatggaaaccaaaggatgcaataatcacagacctaatcaattaccatttcctctagctaaccattgtttaaaattccataataacacaagaatcaagtagctaatcttacagttctacacttcgcattttcatcaattccatgtcttgaatttatcagccattagtcctgcatcaaacagaaacaaatgtcctacttcaataaattcaaaactgcaaaaattttccgtgtcttctcaatcattcatctagctttcgaattctaaatttcgattctaggtttaattttgaatacaattcccgacgtttacagaggcatagagtaagtacagattaaatcaattgacaatctttgaatgaaaccaatctgactccaaaacttacgcattattttcatgtattttgcagattctgtttttcacaattggaacatgtaccacctgtgaattccgtgtttcagtagctctagcatcatcaattgaggattgaaaaagagtgttagaagcaaaactcagtagaaagaggatttcaatcggatttttgaaggtaacgagagttgagagagagtaattttttttttccgttttttttttctgttgacagttaagagagtcatacagtatttgggcttaaaatattaagtgggcttcgattttagatttgcgcttcaataacattatggtttaaacaaaagatgaaattgtattgggctttgtttattacttagttttcagaaatattatcaaatttataaacatacattgttttaaattaattatacaatttagaataatcacaatcatgtttaaaaaatttagtaattgagtgtattcattattagactttatcatataaaaaaaattgaattacataaatccaaataaaaatacatgttagacattacaacattgcatttcatgattaaaataaatacgaatactaattctaattaccattagattactaaaattccacatacttatacacacaacagaagctataggttcataaaaaaaattaaaattcgacaacccttcaaaatcatatgcttacaaaaatatacacattctatcaactaatttgaaaactccgcaaaataaccaatgttatcgtaaccttaattacgtgtcctttaattatacacacagccaaatatataattgagaagtaaggaaaaatacaacaaccatactaaacataaactacattgtcaaaacacaaaacataaataattttaaaaaaaaaaaaatctcgcggtgtaccacgggtcatatcctagtatgattacaaatgtgtctctgaaagtgggtaaatgatgtttcttaataaactaggaaagcaaaaagatgtatctgaagaagtagaagtagatgcaatctgaacatctttctccattatattccttgtaaaactcatgcaattgccaacagtgtggataatcctcataatgaaagagctcaacgtaagatctgaatcttttttgttccaaagcaaaaatgtggccaataagtgtcttggccttgatatctacatcgaaggaacacttgatctcgagtttgaaagtatttaaagcgtctaagacttcgttatctgcgcaacggtttaggccaatgtaaagaatattggctataggaaagacattgttgaaccaatgattcatacaatagatttgtttaaagggagaaaacaaatctagtaatttatcttcattagatatttcatccaagttttgattacaaaggggattctaatctcttgtgacacacattagggttttactcaaaaacaaagaaagaattaggggtttgagaaggtatagctgcatccatgatggattgcctactaccctgtgaaaggatcaagccattcgtagttcagaaacaaagaaagaattagggtttttagagggtatagctgcatccatgatggattgcctacgtatcctgtgaagggatcaagtcattcgtagttctgactaggtataaatttatgtgtctttttgagtatcaaattctcccctttgtgaagtccttgaggcgctttaaatagggtccttaaaccgtctatctagcaatattctcggaagatttccatttatccttaagtcagttatagagaataatcgtcctaaggatattttccttattctttggaggcttcgcgaagatttcctgattcgacattatcttcaaagattctcctttatcatttccgaaagtcttagaaatgatcctattttttcggagatgatcctttgagaatgaatagtttttacaagtctttgcctcgggtgttcttcacggcgcggtgttgtttgagaggtagcttcggggcaaacagtatgtaccagcttggggcacgcatgatgactgtccattgagcttagttgactaccccccccccgaggtgatatagatgttttccgaagcgttcttgtggttggctcgggctgtgttcataggattaacacccgagccatttggtgaactctctgagacggttggtcgaataaggtcccgaggtgctttgttctagcctcggggccaatcatatgtttaaccctgaggtgattgttattcttatattttttggctcgctcttacttgtgggggaatcagaccccaacagttagccccccagctctttggtttaagagttaatggaactagcttcatgaatggtgtgatcgagccagctgcttccgcatctaaactgactgatccgtatcttttgagaggaaggcttgtttttcttgttcccgaacaatgtcgttgttttggattttgttctgattttttttatgtaaagacatgactggatggctttatcctcattttgaatgaatatattggaatgtttttgagaagaaactttgtctttcatacccaaggtgtttgacttgggtatcagtataatacctgtctgtctcaaccttgagacggcttactttcatcttttccattcatttattcaacttcttcaaatcaaattttgaaataatatattataatttcgggaaactttcttttattaagaatcgataataaattgtcttaaaataatagcataaataaattataatagttggataaaaatgtataaagaaaccgtgcttaaaaatataagaaataacgataaatcaaataaaaacccaaagtccccgaaataacaccaagcgagcagctactcagtattctcttcctcacctgagagaaaagaaaagggggtgagtaattaattattcagggaagacagtcaaaactgcccattgaatcacaatatcacgattgtactttgacacaatatccattcataagcatagaatcaaacaacaagcatatagctcacacttttgtagcaagctataacagacaagcttctgtcttgctcaccgcaagatcttttactttattttcttagtttttaaattattttaacttatggctcctcaagcctatttatggaagaccacggcccgtagctcgatccttcctctcattgctcgttagcggttaatgatatgtaatgaacccgtcagttccattacagtccaacatcctcaatcttaccctttctttaatatcattattctcttttatttaccttttatatttctatttaaaaataaatacgtcttaaagacgtcaagcaaatcaatatgcatatcacgctaacaacctaaagcataatatcacacaacacatattataataattttcaattaattactaacatttaacaatcagcacccaatgtctaatcctatacaaatgaacttcaaaagtacaaaagtagaaaaggtgatactatgtttccacatatctcgccctctccttagcaactcggttggatttgatggtcagaaatagcaaggacgatctcaatcttcctcaacaagctttctcgtcggcttcacgtgacgggacgaacggcgaagcggagggtttgatatcacagatctctccagtgaggatgattcacgcagtggctctggctgatcacaacaacaatcactggtggtctgagtggtgcttgtttgacggcgtagggttttggtggtgtgactcgcaacttgcgtttcatttttataatctcgtgggatcattaggttttcacttgggtttaaatccttagcgggctggacttgggcttcatagtctaattataaaataggggtgttccaataagttagataaatataatggaagttcgattaagcctttcgcatacccgaggtggttggctcgggtacaaattgcttgagttaaagttggatttagtatactttgttccgaggtgatcgactcgataccaagttattcgggataacttgatttctaatcactcaggccaatgcaaataagaaactctatttagacgaagcaaccgtttgacaccagtgtttatttcaactgggttttggtagatttattcagaaggttagcaccaatgtttatgataactgggttttagtttccgaggtgatcggctctgtaccagttaggactgggtttttgtaggagtgaatgtatttgagcgttttcgggcgaagctttgtctttcatgctcgaggtggttagctcggtaccagtgtgtttagagtaactcaatttagtagacttgaatacccacgattgcgacccgatctaattcagtcatttatcagcgtttagaaacgagctggggcacatgtgttaagtataactgggtttcagaagatagaattcatagcctgatcggggaaacattcgatcagattcttatcttgaatatttatatagcgcgttgtaaccaaagcagtgtaaatgaaactttgaaaatgatagagtcgtcgcgcgttaaaatatttcaaagtagaaagattagaaattgaattataagaaaattcgaagtagaaaaatgaagttcaaatttaaaccgaagcaaaggtttaaaattgaagtgggagtatggatatacggaccccactcccccttttgttttgtgggggatagctgaactctaccggaaacaagctccctacgtacccttttcagggatcaagccaacccgtagttcaagttccgatgaaaaggccggagctctttttttacttgatagaagagttcttttgcttggtagacgagtctttttgctcggtagacgagtcttttttctcggtagacgagtgtttttgcaagtttatgcaaaaaatataacagagactgcatatatatgattgagttgtgcttgttagattataattgataacacttatcttagcggtttggacgtagagatgatgacatctacgacatggacgatctgaatctctcagattgtaaatgtcgttgtatggaaatctagatttgagatgttagtagttaggaggtctcatctttgcgttagaaagagagaagcaaggataaaagcttttgatataagtgagtatgtcaaccaagcttaattaatatgttagaaagtaataaaacttatcttttatgagagacatcatcgaaacggagacagaattgggtctcatgtctttgatcagaggcgatagagagaggggtccatgaacgattgtaagtgatattccatagttgcttgctggtgtactgatttttgctgatttggagaatagctgataacttttgtttgaattgttaggctttccatctcaccgttgagtctttaaatggtagttccatgaaggtctcctccatattttagtcagatcggatattgcatgaagcttccacgatctagtgaagttgctctgacaaagggatttttcctttgttttgctgattcagagaggcaatgataactttagtctggactgttgatttttttatcccatcggtgaatcactatctagtagcgtcaagaagcactctgtaaatttctagctagatcggacttcgtatgtatcatccataaacttctgaattagtgcaaaaaagttattgtgtgctaatttctgcagtttgaatgattctgggccaactttgaagacaattttaggatggggattaacaccaattgataatccgtttgaaggaaaggattccttgtatttatatctttgctcatagtacttacacaaaccttaactctttctgatgcgtcgggaaaatgtctcgcaaaagctctagttgcacactgaatcttttttgcagacttggcatggattgaagactgtttcagttgtttcttgtacaggaagcaagatgcataacttcttgatcttatgtcttgtggactcttgggttgatagcggtcatgtgataaggttcaccaatcctattaccacaaaaggccacgtaagaagaatgaagttgagttggaaggtgacgtggaagcgaagagaaaagaagaagggaaagactcttagtgagaaggagggtttcctgagaagactgaagtataaataagccgttgtggcatctatttcctttttatgcttttatctgggttttactgagatttattgttagagagagattatcccggtggtgtgccagaagagagtctctatgttgagctctgtgtaatcgttgctggtgagagtagtgaatgattgtatttcttttaaacagattgattatctcattgataatcgatcaaatctatctatgttttcaatcaaacttttgataaaggctttaatctctctattcatcattttgttgagttttgagttgttagatcatcttaaatctatcatcatgatggcacctttgtattagattgcggactacgaggtaagcgatctgatgaagaatggtgtcttcttgagcgacgcaataaagacttttatggttttgtttagattggtcgacgtagagatgtgatgatagttctctgataaatgctgtataaacgacgaagttaatctttttagaaagataagcctaggggcttcagatcgatatattaatacgttttgtattttcttgtagttcgccggaaaattggtcacgaaactggctgatttgataacagcagacctgcgccttagggttacggccaggatgtgcttgtcatagaaaaacagtaagaactcatggtagacagcataaattgagctgaggtcggacttctatgaaagataagccttggggcttcataatgatgcgtagattggatcctgattccgtttagatcgtccggagatcaatctgaaacctggcaggtcgcatggagatggatttggggtcatatagactacgcatgtttgagagaaacgcctataacttccggaaagcagcatacaatgaaacgaagttgatcttgttggaaagctaagcctcaaagcttcagaacgatatgtagatgggctcttgatctgttttgaatcgttaagaatttaccttctaatccagttgttctcgcagttcgagtctcagatttgacagatgtcatatgttacatggaaacggtgataacgcttagttaacagctccgatttgggtgaggttgattttgttggacggataagcctcgagtctttctgttgatatgtaaatcgcttcgtggggaattatgttttgaagttggttgttctgacagaggagggtttgacatcaggattgcatccggtgaagagaagcgatgatagctcccaatagaaagctcggatcgaggcaaggttggcttctttggaaatctgactctcagggcgatttgtagataggtatatcgtaccttagttcatcaggagtttccaaaaaaacgatcccgtagctgactggttttatagagttgggtcttctgacagattgcacttgcctaagataaacgtttatatctttcaacacatatcttgttggaagtgatcaagtcatcatcctaattagaagtgtcatatattatatagttaagtaactgatttatgtatattcgtatcacaaatcgaagagatacgaatagaaattgttaactgcaaaacagttacatgtgtatgtgtctctgcattaggttgtcttctagagacgtgtcccttagtcaaaatttgtcatgtaaacctataaatacagtttatatatcgaataaaagtgtttggtttttgttttacaaaaacagagaaatatagagtgatatatcccgatttttactgtttttaactatgttttaggtataggttttagagtctatttgttatttctagagtcttttctagtccttttcaggtctttacatgtttgggatacatttggagattatggagcattctggagcaaaaaagacaacttaagctgcagaaacaatccgaagacgaaaaggcacgtaggtgtcgaacgacatcacccctggtgtcgagcgacaccaatacctgacaaaaatttgaagacgcaacttattaatgttttgaagatttccaaattcggccaagaactttctcctatttctaaagaaggcccatcacgtgttgtaggtcatatatatagtttttaaggttattgtttagagctaagcttggagaggctattctcctcatctcttttgtactttgggaacaaaaccctgtggaaactccctttggagaagagcttcttattcagactatgatttgtgtttctttgattatgtctgagtaatccacttgttaggtttagggtttctcattagggattcatatggtttaatagatcgccccctgctaggttatctgtagaattcttcatctttaattgttcttaatgctagatctagattgatcacctagaacttgaatccagacaatagatatgcagacaatagatatgccctccataggtatctgtagttggatctgttatttgatgaggctggtttataggtgtgtaataagaatcgtcctatctactaaggtgaacaatcgaactcgttaagaatgcatatttaggttaataatctctcggcttctccggttattcatagctatagatatagggagttttgcggcacgcccacgggttattccatgattagagtttgagtttaagaatggttcgataaaaacctagctattattagatctactaaccaatagtttccttagaataccctaagcctgacgtttttacattcttgtcttacaacctcacaatctactattgcttccttttgtttctttttattttcattactatcttacttagcttaattcaaaaccttggtctattgtgtgacccgagagctttgtggaattcgacccttaagtgctacaatcgatctcttatttgagagagtggtcttaaggcaattagacctatatcaaatttggcgccgttgccgaagttctctacgattcaccattagattaggattagaaatttgtctaagattatatttttatttttctttttatttacttagtctttctcttttccttttcttgtgtgttttaggtatttgtctaatcacagaactaggaccaagcgagaaacatgaacgagagtaagattgctgggatcatggctaagcttaacgcggtctacaatcaacttgtggaggttgtcgattatgttagtagcagaggttttccgaatcagagatttgatcaccaacaaggctacagaggttcctatgggaatggtccaactagctacactcagaattctcagttccagcaaccgcttcagaatagcaatagtttcagcttcagaaggaactatgatcttgcttcttaccaagccccccccccctccacccacacctaaaagcaagatagaatcactgctggaacagattctggaaggtcaacagaggatcttagagagacctatccctagatggaatgagagcagcctcactacttctcggcattctacttcaatggaaagtgagtatgagttagtgaagattgaggagagtgacgattttgcagttgcagaggcagtgtcgatcgacaccatcgcatatatacgagacatcaggctgtgacgaagtagaatcgaccaggctggacattaatctccagaatcgctcgacacacattgatagtgtcgaccgacaccacctgggtcaaaatgtgtcatgtaaacctataaatacagtttatatatctaataaaagtgtgtggttttcgttttacaaaaacagagaaatatacagtaaaacaaaacagagtaaaatatatgttgtccgatccttaataaatttgagagttcaaagttctacatatcttagattaaggcgaggtcaagttctccaaaaagatgactctgtgggcgatctgttgatatattattccatacgagattctcaggaaatcgtccctgaggcgagctggactattccaacggattgtagtcttaacaaactatttatgatacagaaaaccagagataactctttgtagaggtaactgatcgaggagtggttcagttctctagaaagctaatatccggggcaatccgtgaacatattactggttgcgagattcattgagacttgtcggaatgtcaatcccgaggcagagtgatctattcagacggatctgtaaagaaacagacagtaacgacttcagcaaaacagtgataactctgagcggagatatcggattgaactatggttagattccatggaaagctgatctccgtggcaatccgtgaacatgttcgtcgtcacctggttcattggactttgacggaaggtcgccccaaaagtagtcggattcgattgtctttgcttgttgagcgtacatcgaatacttggatgaatgatatgcgaagagaattttttgtcgttccccacagacggtgccaattgttgaaccaaggattcacacaatagatttgtttaaaagggaaaacaaattaagtaagttctcttcattaggtattccatccaagacttgattacaaagactattctaatatcttgtgaaaaacgttagagttttcctcaagaacaaagaaagaattagggtttttagaaggtgttgcatctatggtggattgcctacgtaccatgtgaagggatgaagccatcgtagttctcattaggtataaagttatgtgttctttttgagtattgaattatctcctttgctaagttgttgataataggtttttagtcaattatcgtaaaacaccaatcctgtcgttgtagtattttaggttgtcaatccaaatgggtgtgatgctaacaatcaagatgtgatcagaagtcactaagtcaagccaagcaataacaggttttggggtgttctaacagtcctaagtgaacatgcaggaaacagaaatttaagcagaaaaaataaaacactcgaccaacacagctcgttgcagagcatagggtgtggtcgagtgcctggtcgagtaacaagcagtaaaccaaataaagatactcgactgcacaatctgttgccaaacaactgggtggtcgagtatcaggtcgagtaacaagaaagaattgtagaaactaaacaacatgtaacaagatgcagtaagcaacaatagagtaaacaaagaaatcaattagataataggtttctaaggatgggttagagtagtttagaattctctgtatgctaggtggttgagtttgattgatagatcccttctggattaattgtttttaatgtgtattgctttttgatcaactggaatttgagcacagacatttccgcgcccaaaaggtgttcgatgaaatgtctgaaccactaattccagagatttgtggctttgtaccaaggtattggttgcagagagcgttttggctttaacttgttgattcgtaatgcctgttaggtaaactctcgtcaatggtgattgagtctgggactagtttaacttgagggtctctgttgcggtggcacttatatttggttaccgaacttgttgtatagggataatttattgagcatgtcaatcacctataaactgaggaaataaaagtactcaattaccccatcctcgggaattctttatctaattgatttctttgtttactctactgttgtttactgcatcttgttacctgttgtttagtttctgcatctctttcctgttactcgacctgagactcgaccacccagttgtttagcaacagactgtgcagtcgagtatctttgtttcgtttactgcctgttactcgaccagtcactcgaccacacctagtgctctgcaacgagctgtgttggtccagtgttttattgtttctacttgattttctgtttcctacatgttcacttaggactactagaacaccccaaaacctattattgcttggcttgacttagtgacttttgatcacatcttgattgttagcatcacacccatttggattgacaaccgaaaatactacaacggcatgattggtgttttaggataattgactaaaaacctattatcaatttggcgtcattgccaattgggtgtttctttgttacatttgagatttcagacttacttatatcaagttctttttcaatattcatttcggttactgactgtgtgtttttcttgttgtcttcttgattcaggtacacctctgttgtatgcaaactccatcaacaggcaaccagaaccttcttttcaacgacaacatcgaccgaatagctcgtgaactcaaggaaaggagaaacacagtcacccttttaccccagcaaccactcgaaatggctaacgaacaaaatcaacagaatggccctgccaacattggtgctggagatgcaccacgggaccatcgtcagaggaaaggaattgcacctcctgctatccagaacaacaacttcgagattaagagtggtctcatatcgatgattcatgggaacaaattccatggtcttccaatggaagatccacttgaccaccttgactaacaaaaatcaatggtgtcagtgaagacggattcaagatcccgttgtttccattctccttgggcgacaaagtacacatctgggagaagaatctgccacatgactcaatcaccatctgggatgattgcaagaaggcttttctagcaaagttcttctcaaataccagaactgcaagattcagaaatgagatctctggcttttcacagaagactggtgaaaacttctgtgaagcatgggaacgtttcaagggttacaccaaccaatgccctcatcatggcttcaagaaagctt

SEQ ID NO: 200 - DNA, 79122 bp, Arabidopsis thaliana
aagcttatcagaggaaggccaactcaaatcgtaactggacgctaccgtttaacggaccagatgacgaagtaacttttcacgagagcgatattatcggcttagacagtccacacaatgattccttggtcataacactaaccattggtgatttcaacgtcgaacgagttttagtcgacaaggggagcacactggacatcatctttctaacgaccctgcaagaaatgaaggtcggtatgacgcaaatcgtaccaactctgcgacctgtgctcgggttctttggggaaaccaccatgactctcggcactatcaagttaccagtccgagccaaggggataacgaaaatcatcgatttctccgttactgacgagccgaccgtttataacgcaattattggcactccatggttgaatcaattctgagccatcgcctcgacatatcatctctgcctgaaattttgacaagcaacggcgtgaagaccatctcgggaaatcagaaaaatgcctgaatttgcttcatggcagcacacaagctcagaaacccgagcgatgcgtggaaattggcgtaaacttaggcgaaaaattgacagccgagctgatctctttcctcatagagaacgtcaatactttcgcctggtccccagaagacttgcccggagtaagcgttgaaatcgtagcacacgagctcaacgtagacccaacgtttaaacccgtcaagcagaagacaagagcgttgggtcgagagcgagcggaagctgtgaaagccgaggtagagaaactgttaaggatcagctccatcaccgagacaaagtaccccgactggctcgcaaatcccgtcgtggtaaaaaagaaaaacggcaaatggagagtctgtgtagacttcactgatctgaacaaagcctgcccaaaggacactttcccattgccgcacatcgatcgcctcgtgtaatcaacctctggaaacaagttgctgtcattcatggacgcattcgctggctacaaccaaatcatgatgaaccctgaggatcaagaggaaaccgctttctacacagaacgcttcgtcaacaagatctgcgaaaattatcacgcacgcttcgtcaaccctgatgccattcggactcaagaatgccggggcaacttatcaacgcttcgtcaaccagatcttcgcattacaaattgggaaaacgatggaagtatatatcgacgacatgttggtaaaatccatggaagaggtagaacacataccccatttgcgcgagagtttccagcagcttaacctctatatgtcgatccggtgaatttctcggatatctagtcacgcatcgcggcatcgaggcgaatccaaagcagatcgaggcgttgttaggaatggcatcgccacaatacaagcgagacgtgcaaggccttaaccggttcatctcacgatccaccgacaagtgcttggccttttacgatgtggaacaagaaattcgaatggactacctgaaacgaagaggctttccaggaactcaagaaatacctggcaaccccaccgatcctcgcaaaacctgtaatcagggaaccactctacttatattttgctgtatcggacactatagtcaacggagtgttagttcgagaagacagaggcgaacataaatcgatcttttacgcctcgtagacatcaccggcgcagaatctcgctacccccaaatggaaaaactcgctttagcagttgtaatgtcagctcagaaattgcgaccctattttcaatcccattccatcgtagtaatgggatccatgccgctccgcgctatcctacacagtcaaagccagtcgggacgcctggctaaatgggcaatcgagctcagcgagtatgacatcgagtatcggaacaaaacatgtgcaaaatcccaggtcctagccgattttatcgtcgaattacccacaaaggaggtccgggagaatccgcttgatacaacttggctcttgcatgtagacggctcgtcatcaaagcaaggttcgggcgtgggcatccgtcttacctcgccaaacgggagaagttcttgaacaatcattcagattaaacttcgaggctaccaacaacgtggccgaatacgaagcgttcgtagtcggactcaatctagctcaggaactaaagatagaaaaaatccgagctttttgtgactctcagcttgtcgcaaatcaattcaacggagaatacacgactcgggacgaaagaatggaagcctatctggctcatgtacaaaatctggcaaagcatttcgacgaattagagttaacgagaatccctcgaggagaaaatacatcggccgacgctctagctgctctggcatctacatctgacccaagcccgagaagagtcattccagtggagttcatcgagaagtcaagtatcgagctcggcaaagaagaacaggttttccccattcaagttggcgcggattgcgacaacgctttggatgacagcccagacctaggttacaactcagaatggatagaacccatcaaaagctacatatctgaagggaaaatgccctcagataaatagggagctcggaaacttagagctcaggtcgcgcgctttgttctggtcgaggagaaactctacaagtgccgattatccggacccttaatgacttgcgtggaaaaagaagcggctcgcaaagtcatgaaagaagttcacgaaggctcgtgtggaaattattccaggggaagagccctagccatcaaaataaaacgccacgggctcttctggccgacgatgatcaaatattgcaaaaggttctccaaacaatgcgaaaaatgccaaaggcacgcgccaacaatccatcaaccagccgagctcctgtcatcaatcgtctcgccgtacccattcatgcgctggtcaatggacataatcggacccatgcatccctcgaggcagaagaagttggttctcatcttaaccgattatttctctaagtggatagaggccgaatcttatgccagcatcaaagatgctcaggtggaaagcttcgtattgaaacacatcttgtgtcgccatgggatgccttacgagattgtcacggacaatggctcgcaattcatatcaacgctctttcaaggcttctgcgacaaatggggaatccgactcagcaagttaacactgcgatatccccaaggaaacggtcaagccgaggccgcaaaaaacaatcctcgacggtctaaagaaacggctcgccgccaaaaagggctcgtggtctgacgagctcaaaggtgttctatggtcgcatcggatgacgtcctgtcgggccataggagaaaccccattcgccttagtctacggaacagaatgtgtaattctagccgaaatgacggtaccaagcctgcggcgagccttatcttccgagcatgaaacagataatactcagaggctactcgacgaacttgatctgatagatgaacaaagagattcaaccttggtgcgaatacagaattaacagaatgagacggctcggtattacaactcgaacgtccgacagcaaagatttcacaaaggggaccgagttctccgaaaagtttttcaaaacaccgccgaaccgaacgctgggaagctcggggcgaattgggaaggaccgtacctgatctcgaaggtcgtccgaccaggagtatatgaacttgccgacctaagcggcaaagccgttccgagatcttggaatgcagtgcacctaaggaaatacaacaactaaatccgaagtgactaaacttgaactacgaggtggcttgatccttgaaaagggtacgtaggcacctcatcttcggccgagttcagctacccccctcattaaaaaggggggagtgggtccgtatatccatactcccatttattattttgtaagttaactttggcataaataataaatcgattcacgattttcaaacgcttcggctaatacgatgagcgacagctcagagtatctcttacgcttgctcggcaacagcgcactatataaatacaagataacatccttcagataacttctgctcggaattcttttatctttagaaacccggttactctaaacaccggtaccccagctcatttctaaatgctggttgggaagtgaatcggatcgggtcacaaccgagaagtttcactcaataaaacggttcagatttaaagaaagaatccaaccaagaactttgaatttcaagaacaaaatggataaagcaatcaaggcacaggttctacaaatcctcggataaagccatccaggtataagtgctacaaccaaacgtattaaaaaaaccggagacaaaagaaaaatcccgcttagggttcctaatcgagctcttcggacgggcggatactctcagcaggcaggagcgatccggattggtcggtaaccctcgcctcatcggtgagagtctcaaccgacatgtgaccaccgggactcgaaggagcgggctagggagtaggagctttgagaccctctttcagctcggcaatgaagcggttgaggttagcctcagcgtcggtgaaatctttcaaccactcatcgacctgatgcttcttggtctccaaaaccccgccttcttcaagtaccttgattagctgcgcattagcttgcgcctgggacaggtaaatgaattggtcattaacttcattgaggagcgacaccttttgcttggcagctttcaacttagcgataacagtctctgaaacttctcgcctcgtcgtttgaacagcctgagccacctcgctatcacggagtactctcgcctcgaccaacatccgcttgagacggacaatctcagaatccgcctaagattctactcggccatcttgatggcgttctccttgtttacaaaggacgccgtctcggcctcctccctcaccagatttgccgcggtggcttctgcgagctcttcattgttctctcgctcggcggcctgaattcgggactccacctcggctaacttgctgaccacctccatgttattctgcatggccgcatcttacgagtgcaccatctggttcatcgaggcgatggcctgaacaaataaaggatagagttataggatcggaaccaaggacaaaccatgaataaggaaacacatacccggaagaagtgagacgcagtctcgacgtacttccacgactccagaaaagtatcagaaggcggatcggcttcctcagctcgcgtgcagcgcaacaaccgcctcaggcgtaggcacagcagaaggcggatcggcttcctgagcttcagtaggcaccgtctcaaccggcgcagttgcatcaggaacgacttttccgtcctgggttgcctcgggagcggcctgcggtgaaatcagccccgtgtcggcaagacatttctcctccgccaaacgcctctctttgtcttccttcttcttcgcataaacctccctcaaagtgagcttggtcgactgcatatctacgaagaattgggtgcgatggtccgaggactctgagctggaggggcaagaaacaccatgaactagacgaagcgctcgctcgatctgatctcgggaaaaatgcttcaaccagtcacacttcctagccgataatgcgtgaaaatccaaagcgaaggaggctggaatcggctcgaggaatttgatagtgcgttctgcaacaaagggaaaaatagttagaacgctcacaaaaccgcctcgggcacaaacaaagtaatagctacaacgacctaaagttctccatcgcgtcagaacagttctgaggagattcgtcgagaacagcatcttcaaggggcacgaagaagaagtgattggtatacggctcgtccttgctcgggaacccgtcaataaccttcctacccttagcaggagagatatagtatcgatccacctcggatctcgaggaggtttctcaaatgagcgagcgtacaaggtgtagaatccctcggggggattatgagcacactcgtcggggctcggcacgcgcagagtgacctcaccaaggttgaaccagactctcagttctgaaagcgattgctcggtgcacagagtggagccaggagggttcggcattatcgccctcttgcctttcttctttttcttcttctcggctttctcaaaggccctttgctcggtaatccgtatgatatcctccatctcgtttgggccaaagtaaagaaagtcttcaatctttacttgcggcaccaagggctcggttgcgtatagctagtcggacgtcccagctttgtcggccatcggagcaagggtccttcggacaagaggcagctcggtatcgtcgggcaaatccaattcccgagcaatgacagcagtggtatcctcccgagccgtgaaaggggttatctgcttagaggcgttcgaagacgatgcaccatcatcctccgaggatgtccaaaccatctttcgcttgcagatagggggaagatcgtacagatggttcgaatcgctggagtcgaaaagagaggcgctcggggttgtgggagatccagaattcattctcggctcagagacgtttgacgagacgaagaactacgagaaaaaaacaaatgctttaaccggcaaaatcaaaacttataaagaaacggcggagcttcaccggaaaaagggaaaacaataagaatatcaagatcagagaaaaggaggcaaaccttgatttttcttcttcaaaaacttcaaatgaggatttctcaaagggacggctctcaatatatagaactttgaagggcgcgtcgggtccgcaataaatgatgaaacgcgttagaagcgcgtgggctcggcagaaagagaaacgtctgcgtgatcctcgggaataagcaagaaacgtttccacttctcaagagagagtcggctgcatgtaacagggcgcctgaaacgcctcaggcatcactacagagttgtcccgagccggcccggaaacgcctcagatatcacttcaaagagccatcccgagctggcgttggaacgcctcggatatcaccacagagccgttcgagccaaccttgaaacaggtcgggcgtctttccaaagtcatcccgaagcagatctcgaaacgcctcggacaactttcactcggcttttgatgcatccaggagacgagtcgcccaaccacagccaaaggaccaacttgacctggctcgggagaaacttcgtatccgaggagaagacttagaaccgatgtaaaatcgaaacgttactcctggaaaacccggaagtgatactggaaaatctctaaggatattgccgaatatggaagatcccgcaaaattctctaaggataaagttaatctccatcaccgactcttagatatctggaaatcttccgagaatatcgagggaggcgatttgccaaagccctatataaagcacctccaaggacaaacaaagaggacacgcacaaaaacgctctcaacttcaggctataaaaaacgctctgactttgaaggctaaaacacttattttatatatttctaaacacttgtacgatcaaatcatcattatctcaataatataattaagaacaccgtctgcggtaatcagcaattctgttgttctttgagaatctcacagagatccgttctttgaaggaaccctgtagtgacccgcgtaaggacattggccataggcaagagtccaaattttcgaaagttgcccgaatgcatggccaattgaccttacgtgcccaaaagaccatagaataccaaagggcaagtttgggcaagaacgggcgtgccacgggcaaaactttgccccgctgggcgttgaccgaccgttgaccgcgccaaggacgcgtggctcggcaagaacgggcgtgccacgggtgaaagtttgccccaccgaatgttagtagcttggagccgaagtttaggtggccacgtgtcactcatccgtttgagtagcaaacgtgtcatcgcggttagatgacacgtggattggtgattcgcccatactcatgacacgtggacatgctgactcgccattccctggcctataaaagcccaactcgaccccatttgattggtgaagagaaattgagcgggagtgagaggctgccgagtttaaaccgttagttcgatccaagttaggggcccatagccgagaactctgcctgaatcgttagaagctttccgttggttactgagtgagttctggataatggtttaagtttcataatcatatcctcatgcattcttgattgatttcatgacttatatgaattatgtgaatggttatattagattgcatatgtgatctttagattcttatgctattgcttatggttgagaggttgtgctgagatattgatgattctatgtgttgatttaaccgtatgtctcataatatcttaaactttggggtcttggtacgtggtgcttgtggtaggaggcaaagaccataagcgtgccaagatcttgatatgtctggccttcgtagtgaaccgtgctattgtgaggtgttgtaacgttgttacttgattgccatgaagtgcgaataactcggagagacgggactagctaccctggcagagtgtctacacgacggtgtagcgtttggtagtgatgctccggttgcataccgttgtggttgtaacgcgggagatcacaggagtgcgtgtttggtgttgggtttgaaggcagcatatcaagccctatttaaaagatttaataaaactggagtcctaatgcattccatatttatgtagttgcttcggcaagctacctttcgttgccattctctgttgcgtgtttcatgttgggtatttgtgttggggtaaactaatgtttgttgcagggaatcccgagcgcactgagtaatcttagattactcatgattctacttgttttgcaggaaacccgtagtgggaaatagagggcgtggtggacattaggaaacccggagtagttttgtgccttttgtaaaacaagtatgtttctaatatgtatagtgcttttggcactaggccttggccatgaaacttataaatgtttggtaacatgttgtgtaatatttatacttatgaaataaatcgggttttcttgtacaaattgcgagtaatgactgataatgacttagtccgagtcggcacaaaatttaaatatcgcgagggttggcaagcctaaacgatgttcaagtgggagagtggtcgtcaatacaccagccaagggttgggatgggttcccgaacctcggttggatattgatgatcaatctcaatgtggcgttttcgaggcgcccgtgacttgtccggtcatagagcgtctcgggggcgttacaatttgtggtaacagagcatggttaatgatgctagcaggactcgtgattttcaaatgttttatcgagtaaatgagtcacaaaaggaatttaggataatccggtctgttcaccattattaggtagatgggttaagtttaccttggttgaatggattcagatgtctggtcaaaggatggagaggagtgagtcgatgaatttctcaccagtttatgaaaactggagtcatcattttggtctaaaagacttggtaccgtacgctggaggggaaggagatgagggatactattaccccaatatgtatggagcgcctgatttggatgttcttggaaccacaccaaaatactccttaccaaggtatgtacactatagcacatctgaagggtcacacttagggacgagaccacatgttcctgtgaatcaacccactgcacacccaaattcttcgctgccaagagaagttaatgaaggaaatggggaaggtcgtaatattcaaagtttgccagagactcaacatacgttgggaatgattcagactttgttgactcatatgattcaacaacagcaacaccaacaacagatgcaggaaagccagcgtgccgaatctccttcagccaagttcttaaaactgattatgatgatgaaggatttaggtgttcggaagtttaaaggagagctgaatacagttttagtagataagtggttgaggaatctggaaatgaattttgaaacttcaaggtgcccggaagactttaagggccagatagcagtaaactttttagatgaggatggtcgagcatggtgggatagtgttgtttcacgataccgcgaccagcctatcacttgggatatgtttaagaaggagtttgagtctaagtattttccactggaggcacgtgatcgtctggagcttcagtttatgagtctggaacaagggcaaaagagtgtccaggcgtatgagcaaatttctacaagacttcggagatatttgtacaacggaagggatgatgaagctatgatggtacggagattccttagaggactagggcctgatatttggggacgtcttcagtaccaacgtgagtgaattaacggaaagggccgtgaatgtaaagaagggaatgagttagagaagggagagaagttacgggagaacgaaaagtttgaaggcaagaaagggaataatcgagaatttcagcctggggttttgaggactaatcagtcgggaggacgaaaccagaataatgatcgtggaaagcctaaggttggtaaccaaggaggacgtgtaatgaatacttacgatccaagagcctgctatatatgcggaaagccgggacattttgcacgagattgctcaatggtcgtacagactaaattgccaaatctggcatttgttacttgttacacttgtggggagtcgggacatgtgtccaatgcatgcccgaataaacaagggcgactacagagtaaccgagtgggagcttgtttcatttgtggagaccaagggcattatgctaacgcatgcccgaacagacaaataaagcagtataaccaaatggttaaccacccaccgccagttcagatagctaagggatcaccggtaaagaagcaagctactccagcaaatgtctatgccttagatttagaacctaccaaacctccaggacccgcaaaaggtcccataataggttagtatgggttcttacttttcttatttatgtatgtttgagtgattgattattgtatgcatagtttactagtttaaatattgcatacatcattttcatatgcattagggacattacttgttggtggtaaccccacgcatgtattgttcgattcgggagcgacagatagttttgtaagttttgacatggccgataagttaggccacgggtattgtaatacccctgactttgactaggaatccgtcggacgatcgcgaacatagaggtgcgatcgtaccttaggaaaattttcgataagaaaatttagacggagttgtgggtaaatcaaacattacccgaatgatcattgatcaaagaatggttacataaggagtttaagatcagtttacaagagagtagagattttatcggctaatgctacatatcaagaagactaggatcggctattatcgacaaaggcagttaaggctatcgaggaatttattaagactatcaaaattattaacgagaaatagtaaattcaggccgagacaagcaagcgatgatcgaatgggattggatgcggacacaacaaggttagtggagtagttaaatgacttagtcatttatttgttaaaagaataggtaatgatcattgtccgcgtacaatagtcggagagttctcggtacgggcgtgtaccgtgagcgacataacgaatggtcgttaaggccatgtcgttgaggtgcttgtggcataggcagttgttccatgaacttggcgtgtgttgtgcatgatcctccacacgttttagattagaatgggcatttagataaggataagaacaagattggataatgataagcttgaaagtggataagataaggataagccttatcctttgagtgacttgcactccaagtaacttgctgaccaagtttccccagcctatataaaccccctagatcgattcattagttcttcccaccaaaacctttagcttaaaccgttagatagctagttagtccgtcggagtctgagtcaggtagaagttggtcgagtcgggagtcgtagttgggtaataaggtaagtagttccgcctttagtcttttaatctttttagaatattttttttaattttgttttcggtccgacgcttagatccatcgttagtacgcgttggagatagctcggttggatcaaaattattaggcggtcaagggtagaattttaatctctcgacaataaggccaaggtgagtaccgtagcgtgtgtagtagcacatgactaggttttattttggggttatgattgttaggcatgaggttgcatttttatacttagtataatttatgcatttattgttgatagtcggatctacgtttttacgtaagatgggcttggttgtttgattagatcttgcattcatgctcgatttagtttaggatgaagtatttgtgtgcttaggctggacattagtttagccattatgttggttgattgtttgtttgtttgttcgtaatttttattatgaattaaattgttagcaagcatgttaggttgtttgattgattgttgttggttaatcttgctttgccttgattaacctttgagtgtcaattgcttgctagtaggttttattaccagtagtattaggttacattagactcgtagtaagtaatgtggttagtcagttatatgaataaggtgtgacgatgtcgtggttgtcccactagctcggaatggttcgctaccacccgagactgcccgacggggtagtaaaagttttaccgtaagggagttattccatgtagacggtttagattggggaagggatgtgatcgttttagactttgtgtccagcggtcggagacattgccttgtgggaaatcagcatcgtaaagtgtaggggcccgtaggatgaagagtcgttagcatgctagttttagattaagtagtttccgctgcatatactctataaagagtattcattgcttgtttgtttgtgttgtgtgatttcttgtcgagtatactcaatttagtatactcgtattgattgtttgattggggattgggattgggatttatgttatttgttagaaacccgggctcactgagtaatcttagattactcaagattctacattttgtcttataggtaacctttgttggggagacctataggggagcacggacgttggggaaccggtgtaaagtttgttgtctttgtaaaattagatttgtaaattgactcgatttgagcattaggctcgggatcccaatccattgtaagtattttcatgttttattgaataaaggagattttctttaaaaatccttgtgtacttctgatattagtcttgtcccgactaacacaacttacggtcatggtacgggttgaaaagccttaggccatgttcgtgaggaacgttgttcgatgatggcctgaccttggtaccagatgtgttctgggaactcggtcggatcgtctacgggcatcaaaagtaacgcttccagattcgttcttagtcctagaacggtttgggggtgttacaagagtggtatcagagcatggttttgttcatgcttaagggacacaagttttcaaacgttttatcgagtcaaaatgagtcgcaaagacaactttaggaaaccggtgctaccatgtgctataggtagagggattaggtagagggattattaggttttaccttttggatgttaatgcagatttagagttaatggatgaaaggaggatggatgtggtgaccattacaaggctaagaatcaatgggagagaactcataaggagatgatattggagttaatagatggaagcaaacaaagatggttatgcggagatggatcttgctaaagtatttaaggaggtgtgctatactagttgaagaagctcgttcaagaaatggtgtgtgctcaaacaactgagaagaggatatctcaagaagcaaaattgatgaagtcattgatccatgaagcgttgtggaaaagtaatcaaggaggctttgaaaagaaggtaccatgaagtttaaagagagatggagttagatctactgcaagtccatggtcgatgattaggtgaagcaagtcgagtaagtggccaagccaaagatcaagaagaagatgagttctcacccgattcagtctgtgtagtcattggtctacccactacggcctgtttggtaatccattaacagaagagcggaaggcacaagtaagttgtgttataccttaggaatagattaccctaacctttatgaccttatgggtttcggcgcaggtacgaatgggttctaactattctttgtgtggtgtggttgatgcttgctttatgtagaataaatatttctagcatatgttgttggtagattgctcgctttaagttttattattgcttgcattggttgagtttgcatcatttagaataatattgcttgcattagtttcttaagcgcaactaggcatgtggaatggtaaacccatgcttgtattgttgccttaagtattttgagtatgtgttggtagaaaagtagggttggtttctagtatttttaggagccttaagaactgtaaatagtggaacttaggattttagatgaaccctagaagtttaggtgggaacactttacccggttgatcttgtggtgttttatgggcgtgttggggaaaaagcaagggttggtgtgtcaggtaagtaagatgttatgtgatagggaatcacatacgtaagaatgaaactttagttgtgccgtgtgaaatccgacccctagatcagcaagcatgtcaaggcatcatgtgagataggaaatcacattttagaagaggaataagataaccactgtaaagaagagagagccgctgccaaacctactatgggaacagccctagtgtggttgatattgccaatagccatgaaggaagtacccttcaccgtgatgatcaaagaaaatggaaagagccgatagtagatagtcgtaaagggaatgaagggaaagagagagagagagtgtcgtagttattttaatcatgagtagacgccaagagagagtgtgcagactattctcgtaaggacgaaggggatcaacacaaagttagaaaggtcatgtcgaccaaacggagaagcaatggacttctggcggtaccgagcagactttcaggtgatggtgtaatcaaagaagaagatgttggttgacccaaaccgtaagatttaagaagacttgtgtggtaatgaagtaaggaagaagcaaagacaacaagatgacatagaaattgcagtttcagagaatgtgaagcccaagacaaagaggattgtattaactcgaaggacggagttagtatttccagggtgtagaagcaggaagtttgttggaagagctagaaggacactagctcaagatcaagtcataattccaaggaagtaagaaatgaccattgtcatttccagagaatcaaagagaagaagagggatgaagctcaagacaaagccctagttatccgatggaaaggataattagaagaagagagtaaggcattcaatcatgataagtgtgtattttgcatgttttcagcatccatttgtcatcactttagcatcatatcatcattgttttataccatttctcattatttgtcatcactttacatgtttaggatagatttgcatgcatgttacatatttgcgttgatttcaggtgatttggagctgttgacgagctatctgtaagaagcgaacctgatcatgacaaaaccactcgacccagaggtcgagtaggagcttcaagatctcaagagaccactcgacccccaggtcgagtagaagacatcacaacttcacctcaccactcgaccacgaggtcgagcgtcttcatctccatcacctgaccatcactcgatcacatcactcgaccccgaggtcgagtgtcttcatcccatcacttgaccatcactcgatcacatcactcgaccctgaggtcgagtgtcttcatcccatcacctgaccatcactcgatcacatcactcgaccccgaggccgagtgtcttcaccttcattgccataccactactcgacctcatcactccacctggaggtcgagtatcactatcaccaccactcgactgcatactcgatgataagcttcaaagccttcttcattccgcactcaaccagacactcgagcacaaggaagaaaagaagactctagctgttcactcaacctcccactcgaccacatgggtcgagtacagttcttaatccgtcccaatacttcgtcgttttgagtattagggtttcggaatatttggctataagtagcatgtacttcacattttcgcagccaagtttttatctagttttattccgcagaccttgtgttctaaaccttttgtaatccggatttctctttatctattcagtattcagtattcagcttttgttcttgatttcgtttactgttgttcattctgttatcatcctgctgttacactgttgttatcatgttttcaacttgttcaacgtttatgctttctgttatgatgtctgagtaatgaataggtttctgaggatgggttagagtagtgtaggattctcagtatgctaggtgattgagtattgattgatagatcccttctggattagttgttttaatgcctattgctttctgatcaactggaatttgagcccagacatttctgcgcccaaaaggtgttcgatgaaatgtctgaaccactgattccagagattcgtgaccctgtaccaaggtattggctttaacttgttgattcgtaatgcctgttaggttagctctcgtcaatggtgattgagtctgagactaggttaacttgagagtctctattgcggtggtacttagatttggttaatgaacttgttgtctagggttaatttattgagcaaatcaatcacctgtaaactgaggaaacgaaactactcaattaccccatcctcgggaattctttatctgattgaattctttgtttactctactgttgtttactgcatcttgtcatttgttgcttagtttcggcaattctttactgttactcgaccagatactcgaccacccagttgtctggcaacagactgtgcagtcgagtatccatgttgtactttctgactgttactcgaccagatactcgaccacccagctgtttggcaacagactgtgcagtcgagtatccctgttatactttatgtcttttactcgacgtgtcactcgacctcacccagtgctctgcaaagagctgtgtcggtcgagtgtcttttgtttctgcttgaatttctgttttctacatgttcacttagaactgctagaacacactaaaacctgttattgcttggcttgacttagtgacttctgatcatatcttgattgttagcatcacacccatttggattgacaacctaaaatactacaacgatatgattggtgttttaggataattgactaaaaacctattatcaatttggcgctgttgccaattgggtgtttgtttgttacatttgagatttgagacttgcttagatcaagttctttttcaattttcttttcggttactaactgtgtgtttttcttgttgtcttcttgatccatgtacacctctgctgtatgcgaactcgatcaacgggcaatcagaacctccttttcaacgacaacatcgaccgcatagctcgtgaactcagagaaaggagaaacacagtcaaccctgtatctcagcaaccactcgatatggctgacgaacagaatcaacaaaatggccatgccaacattggtgctggagatgcaccacgtgatcaccgtcagaggaaaggaattgcacctcctgctatccagaacaacaacttcgagattaagagtggtctcatctcgaatattcaggggaataaattccatggtctgccaatggaggatccactcgaccacctagatgaattcgataggctctacaacctgacaaagatcaatggtgtcagtgaagacgaattaaagctctgtttgttcccattctccttgggcgacaaagcacacatctgggagaagaatctgccccatgactcaatcaccacttgggatgattgcaagaaggcttttctatcaaagttcttctccaatgccagaactgcaagactcagaaatgagatttctagtttctcacagaagactgatgaaagcttctgtgaagcatggaagcgtttaaagggttacaccaaccaatgccctcatcatggctttactaaagcctctctgctcagcactctttacagaggagtcctaccacacatcagaatacttctggataccgctagcaatgggaattggttgagaacttggctcaatcagatggtaattacaacgaggactgtgataggaccgtcagaggcacatcagactctgatgacaaacactggaaggagatcaaagcgctgaatgacaagctggacaggattcttcttagctagcagaagcatgtgcacttccttgttgatgacgagcagtttcaagtccaagatggggagggtaaccagttggaagaagtcagctacatcaacaacaaccagggtggctacaaaggatacaacaacttcaaaaccaacaatcccaacctctcctaccgcagcaccatcgttgctaatcctcaggatcaagtgtatcctccacagcaacaacaaggtcagaacaaaccttttgttccctacaaccaaggtttcgttcctaaacagcaatttcaggggaactaccagccgccaccaccacctcggtttgcacatcagcaaaaccaaggtcctgctgctcctgaggctgatatgaaacaaatgctacaacagctgcttcacgcgcaagcctctggctccatggagatggcaaagaagatatctgagttacataacaagttggactgtagctacaatgatctcaatgtcaagatggaaacactaaataccaaagtccgatacttagtgggacattctgcatcttcttcagctccaaaacagacaagccaactaccaggcaaagcagttcagaatccaaaagaatatgctcatgctatcacactgcgtaatggaaaagcacttccaactagggaggaaccaaagacggtcattgaggacagtgaagatcaagatggggaggatttaagtctcgagaacgatcaagcagacaaaccactcgagcaaccactcgaccagtcactcgagcaaccactcgaccagtcactcgagcaaccactcgacctgtcactcgagcaaccactcgatctgccactcgacaacgttactcgaccaacaactcgacctatcttcccagtagcatcaccaactgctccaaaaccagttgctgtcaaaaacaaagaaaaggtctttgtccctcttccctacaaaccacaacttccatttcctagctatcacaagaatgcgttggcagataaatatagagctatgtttgccaagaatattaaggaggttgagttggcagactaagatcatcttaacagtgctttaaccaaaagtggtgaagatgggtttctgcattaggaaacattgggataccagaagctgttagactcccataaagtgatggaagaatcagaaccctttgaggaattgaatggaccagcaacggaggtaatggtaatgagcgaagaagggtcaactcgagttcaacctgcactctcgaggacgtactcgaccagccactcggccttgtctaccaacgaatctagggagccgatcattccaacttcagatgactggtctgaacttaaggcactgaaggttgatctcaaaccacttcctaaaggtctaaggtacgcattccttggtccaaactctacttaccctgtgatcattaatgctgagttaaatagtgatgaagtgaacctgctattatctgagcttagaaagtataggagagcgattggttattcattatccgacattaagggaatttcacctagtttatgcaaccataggatccatcttgaaaacgaatcctattctagcattgaaccacagaggaggttaaatcccaatttgaaagaagtagtgaaaaaagaaattttgaaactgcttgatgctggtgtcatctaccctatctctgatagtacttgggtttctccagtgcattgcgtccctaaaaagggtggaatgactgttgtcaaaaatgaaaaggatgaactgatccctactagaattataactggtcataaaatgtgcattgattataggaagttgaatgctacatctaggaaagatcattttcctttaccattcattgaccaaatgcttgaacgtttagctaatcatccatactattgctttcttgatggatacagtggtttctttcaaataccaattcaccctaatgatcaagaaaaaacaactttcacatgtccttatggaacttttgcttataagagaatgccatttggtttatgcaatgctcctacaacatttcagaggtgtatgacctctatactttcagacttaatcgaggagatggtggaggttttcatggacaatttttcggtctatgacccctctttctcctcatgtttgttgaatcttggcagggtattgaccaggtgcgaagagacgaatcttgttctcaattgggaaaagtgtcatttcatggtgaatgaaggcatagtgctgggtcacaagatatcagagaagggtatagaggttgacaaaggaaaagttgaagtgatgatgcagttgcagccaccaaaaacggtgaaggacatcagaagtttccttggtcatgctgggttctacagaagattttttaaagacttctgcaagatatccttccaaaccatcaaggatgctttggtatctgctccggttgttcgagcgcctaattgggactatccatttgagatcatgtgtgatgcattagattacgcagtaggagctgttttaggccagaaaatagacaagaagcttcatgtcatatattacgccagccgaacgttggatgacgcacagggaagatatgcaacaactgagaaggagcttctagctgttgtattcgcatttgagaagttcagaagctatttggttggatcaaaggtaacgtctatacagaccatgcagctttgaggcatttgtatgccaagaaggatactaaaccaagactgttgagatggatacttttactgcaagactttgacatggagatagtagataagaaaggcattgaaaatggtgcagctgaccatctctcaaggatgagaattgaagaaccccttccgatagacgattcaatgccagaagagcagctcatggttgtagagttcttgggaaggagctacagtgggaaagagttccaccaactgaatgctgttgaaggagaatctccatggtatgctgatcacgtcaattacttggcgtgcggagtagagcctcccaacctgacaagttatgaaaggaagaagtttttcagagacatacaccattactactaggatgagccttatctttacactctctgtaaagataagatctacaggagatgtgtctcagaagatgcagtggaagttatcctgctgcattgccatggctcagcatatggtggtcacttcgcgacgttcaagacagtgtccaagattcttcaagcagggttttggtggccaacaatgtttaaggacgctcaggagtttgtttcaaagtgtgattcatgccagagaaaaggcaacatcagcagaagaaatgagatgcctcagaatccaatcttggaagttgagatctttgatgtatgggggattgattttatgggtccattcccatcttcatacggtaataaatatatactggtcgccgtagactacgtatcaaagtgggtcgaagctattgctagtcctaccaacgatgcaaaagttgtgctgaagctattcaagaccataatcttcccaagatttggagttcccagggtagtaatcagtgatggcgggaagcatttcatcaacaaggtttttgaaaacctcttgaagaagcatggagtaaagcacaaggtcgccactccctatcatccatagacaagcgggcaggttgagatctccaataaggagataaaaacaattctggaaaagactgttgggattacaaggaaagactgatctgcaaagctagatgatgcattatgggcttacaggacagccttcaagacccccattggtacaactcctttcaatcttctctatggaaaatcatgtcatctacctgttgagctcgagtacaaagcaatgtgggcggtaaaacttctgaactttgacataaaaactgctgaggagaagcgattgatccaactcagtgacctcgatgagatccgtctagaagcttatgagagttctaaaatctacaaggagagaaccaagcctttccatgacaagaagatcatcactaaggatttccaggttggtgatcaggtgctgctattcaactctcgcttgaaactctttccaggaaaacttaaatccagatggtctggccccttctgtatcactgaggtccgtccttatggtgcagtcattctagctggtaagagtggagattttacagtaaatggtcaaaggctcaagaaatacttaacagaccaaatccttacagaggtgacatcggttcatttccaggaccttcttgatgattaaaggagtaaaggagtcgagctaatgactttaaagaagctcacttggaaggaagtcccatgactatctctgtaaataaatttttcttgtcttgttatttttgatttgttttagttgtgtttgtggttctcagagacaagggaacaacgtagagatagagtaaaaattcaaaacttttactctatagaagacctagagatcgagtgtataacctggtggagtacaaaattttgaaagttttctgttgcatctggagacccgtaattcgagtacgtcagtcgagtatacgtgatgtttaaaatccaaaatttttaagaacatcactatagtcgaccaacaggagctacggagacttgtaaggatttcttgtagtttacagtagaccacgcgttgaggataagctggagagagaatctaaaactcaacctccaccactcattttgaaacttcactcgacttcacaaaatccactcgacctacctcttttcatctcaccaccgacactccaaagagccactctgtccagatcagttcactcgaccaccgtgaatcactcgacctccgcgccgcagtcaccagaccatatcttccgtcactagacgtccgagaaccactcgacctccgcgccgccggcaccagatcatttcctacttcactcgactatccctgcaccgccgtaatcaagtactcctcctcgttcaccgtcgaagtctcctggaccactcgattacgagaaagctactcgaccacaaagtatcactcgacctcgagtattcactcgacctctgcagcagcaacttggcctcttgttcttgaaagcaacggagccctgaagaattgtcaaagtgtttactcgacctctaggcttcaccggctgaacccgacatccacaattcactcgacctccaggaacagctcaggttactcgagtacagaattgtactcgatcaattcaatctatttcattgcctattgataacaattttggtttcattgctatctttgagactaacctattgacatttgagctttgagttttaaatttctacaggagaatcatgagcaattatagtggcagctcttctgttgatcctgactacaacatggatgagacagagtcgtcatcttcaaggccagagagagaacagagagaatatgaaagcttcagaaggaaagctgagatagcccgaggaaagagagcgatgacagagaggtatgagcttatagaagaagatctggaagacgagtacatgcctgaacagactcgcagatctaccaaacttctgcacaagcccgacgtattgcttgctgaggaatatgttaggcttttcaagctgaatgagttctgtagcacgaggtatccttgcttgaccaaacttgcacaactcggattgttggaagatgttcagcacctgtaccatagttgtcatctagacactctgatggcttatccgtatgtagtgtatgaagatgagacaatacaattcctctccacgctgcaagtagacctctaccaaggtatgacctctgatgagttggattgtgaaggattgggattcttgcgattctctgtgtatggtcatgagtataggttatcaatcaagcgcttggaaggattgtttggcttccccagtggaacgggatctaagcccaagtatgacagagaagagttgaaagacttgtggatcaccattggcagctctgtaccgctgaattcttcccggtcaaagagcaatcagatacgcagccctgtcatcaggtacttccagcgttatatagccaatgtactctactcgcgagagatcacagggactgttactaactctgatatggagatgatcgcaatggccctcaaggaaattcttcgccaaactaagaatggtatgtctctccaaggtgaaatcaatgacacacctctctctgtacatcttctgatccatctgtatggatacaagagctgggctgtcagcaataatcagaagagagcacgaggcgctctgtgcataggtggtgttgtgacaccgattctgatagcttgtggagtccccatcatttctgctggactcgagccgcgagccatggacatcgagcacctacgtcactgcgaatttctggagtttgcaatggttgacgatttccataggttcaggtttgagcactctacaaacaggagagctaccatccttctccctagccctaaggttacacggataatagagggagataatattgatttttggcctgaggttggacacctctactatgagaacgctttgccattggatgaggatgatcttctagaagaagctgcttcgggtgggatggatgaagatagagcagtggagttcgacactagcatgtatcactttggtgaacatgtacctccagcgaggcagagcaagagcttgactgaagctcataagaacaacagtaaattgcagaagtggtgcaagaagcaggacaagctgatcgccaagtgtttcaagcttctaacagataagctgagttgttcctcctccaccactgctattccacagggacaacctcctctggagatgccatcgaggagatttaatgagcttgcgcacaagccttagcttagcgagcagagagtctgacatgtccaggctaggcattcgtcattcgagtcccgggagcacaagagaagaaggaaggctacactcactagacctagcagcagatcacgcctcattcactcaaggagatcactcgaccgcggcgctggccgcagcagaaggaaagaggtcgagtatcctcagagcggtattggccgccacagagctgatgaggtcgagtacccacctgctggagctgataaagataaggtggatcgtctatagcctgggagcaatcagaggcagcaattgacgagcaactacgttcattctttgactgaggtaagcgcctcacttcaccattgtattatatcatctgttgtgatttgtttcttcattttttgtttttgtgattggatttgtcctgagtactctcttccaagtttatttgcacagtggactgtgtgatttaagtttgggggagggctcaggaagtgtgtgttgcattgtgtatatttttgagtctgcattcatctaaggcatagaaaaaacaaaaaaaatttgaaaaatttcagaaaatgatttcacaaaaaaaagagtgttcatgtagttgcattacatttaggatcgagtctagagtgtttcattcaggattgttgcatatgcataggggatgatgatgagatagccttgtaagcattttgattcaccggataaactcagtgccctcgttgctagttgtttgttgcgtagtcaatgaatttgaaataaaactgaaccatgcctagattgctctactcgaccacactgtcatgatctgataccattccctatcaatttgaacctgaatctgatctttaattatcatgtctgcatcaaatttgaactcatggataccctaaaatacttggattttcttattcattttgatcactcttgttaatccaagtagctgactctcctaattagagcagttaacccaaactcaaacctagactttctttcaagccctatatcacttgtgagtgtttgtgaggtcttattccgattaagcttggtagaaagtgttaggttcgttacgatagagatagtgtctcatgtagttctagttcgcatttttcggactagataggactaggtgggcgcttatactttgggttgggatgtgtttaaaagaaaaaaaaaaggttgattcattgataagaaaaggtaaaagactctaggtgaagtaagctaaagaagcagaaaaagtctagtaaaggttttgggatttgtaaagaaaagaaagagttcttgttagctatggaagatgggcaaaaggccttggttttaagatgttaaaaagaggaaccttagttgttaaagaaatccaaatccgctagatgtatcaaagtgttgagaaagcttctcctaaagttaagagaaaagaaaagaatgattagaaaagggcttaaaagattcatgaatgcaatgggtagagttaagttcttatattgggattggagatgggattaccattagagcttcatttgatgtactctggatagatgggatcttatctctgtatgcatagcttgggacttacctttagcattctactaaagcttaatcatttttttagagatcccctgttactgaagcctattcagtaagggaccatctttgtctcttgaccttttactttagccaaatgagttcattaatgatgcattgcttgattcacgttccagaattaatgaatgttaaagggattggtagatttgaaaacatgtgtaggtcgagcatatgagtcggattgattgataatgaggcatggctaacattttaagtagaattcgatcttgcagcttagaactttcaactaggacattgatttcatctggtttatctggggctttggctttgagtccccgctttcaaacctcacctccagcttgttcttgattgtttgcttgagggcaagcaaagactaagtttgggggagttgataagtgtgtattttgcatgttttgagcatccatttgtcatcactttagcatcatatcatcactgttttataccatttctcatcatttgtcatcactttacatgtttaggatacatttgcatgcatgttgcatatttgcgttgatttcaggtgatttggagctgttgacaagctatctggaagaagcggacctgatcatgacaaaaccactcaacccagaggtcgagtaggagcttcaagatctcaagagaccactcgaaccccaggtcgagtagaagacatcacaacttcacctcaacactcgaccacgaagtcgagcgtcttcatctccatcacctgaccatcactcgatcacatcactcgaccccgaggtcgagtgtcttcatcccatcacctgaccatcactcgatcacatcactcgaccccgaggtcgagtgtcttcatcccatcacctgaccatcactcgatccatcactcgaccccgaggccgagtgtcttcaccttcattgccagaccactacttgacctcatcactccacctggaggtcgagtatcaccatcaccaccactcgactgcatactcgatgacaagcttcagagccttcttcattccgcactcaactagacactcgagcacaaggaagaaaagaagactccagctgttcactcgacctcccactcgaccacatgggtcgagtacagttcttaatctgtcccaatacttcgtcgttttgagtattagggtttcagaatatttggctataagtagcatgtacttcacattttcgaagacaagtttttatctagttttattccgcagaccttgtgttctaaacctattgtaatccggatttctcttcatctattcagtattcagtattcagcttttgttcttgattttgtttactgttgttcattctgttatcatcctggtgttacactattgttatcatgttttcaacttgttcaacgtttatgctttctgttatgatgtctgagtagtgaataggtttctgaggatgggttagagtagtgtaggattctcagtatgctaggtgattgagtattgattgatagatcccttctggattagttgttcttaatgcctattgctttctgatcaactggaatttgagcccagacatttgcgtggccaaaaggtgttcgatgaaatgtctgaaccactaattccagagattcgtgaccctgtaccaaggtattggttgcagggagcgttttggctttaacttgttgattcgtactgcctgttaggttagctctcgtcaatggtgattgagtctgggactaggttaacttgagcacgtcaatcacctgtaaactgaggaaacgaaactactcaattaccccatcctcgggaattctttatctgattgaattctttgtttactctactgttgtttactgcatcttgtcatttgttgcttagtttcggcaattctttactgttacctggaccagatactcgaccacccagttgtctggcaacagactgtgcagtcgagtatccctgttgtactttctgactgttactcgaccagatactcgaccacccagttgtctggcaacagactgtgcagtcgagtatccctgttatactttctgtctgtcactcgacctcacccagtgctctgcaaagagctgtgttggtcgagtgttttattgtttctgcttgaatttctgttttatgcatgttcacttagaactgttagaacacaccaaaacctgttattgcttggcttgacttagtgacttctgatcacatcttgattgttagcatcacacctatttttattgacaacctaaattactacaacgatatgattggtgttttaggataattgacgaaaaacctttatcaagtcaagtaaagagatggaagcagaagaagcaattatctaaggagcaaagaagagaagtagcgtaaaaggtcatgagatggaaatcatgaggctgagaagactataactaaagaagaagatagctaaagcaagagaaggaaggagtttggagtagtgccgaagaagttttgcattgtagagtaaaaagacaaactttacgtatggtaaagtgaagtctaaggagaagagccaaattcataagtcacaagacgaaatgaacggccaataagtcaatgaggagaagaaatcagagttaaagaaggttgagaagatgaagtttcaaacgtcaggatacacacaaatggaacgtgttgttagcctacacaataatcaaagaatctgaggaagtagcgttctcacaaagcaaggagatgggagacaatcggtttatgtctatgaagaagaagatgaagatgaaatggaggcgaagatgaaacaaagacgaagatgaaataaagacgaagactataagttgaaaaggagaatcatgttagcctaaaggaacagttacaccatattcaagctgagaagtaagacaagtcaaaggcgggaaagtggtatgataagtcaaaggggaggagttgtacaacaagtcaaaggggaggagagttgtacaacatgtcaaggaggagggtaataaactaagagtgaggtcaatatcacaacaagtaggaggaagatgaagtgaacctttaaatgaggaggatgaaccaagagctaagaaaagaagatgaaagagttgaagagtccaaagaagttgcaagaaaataatggagaagttaagatagagcatagtaccatgctgctcatagacacagcatagtaccatgttccaacacggaaggagtaatagctatggaagtcaaaaatatgagtcgtaatggaagcgacccaaaggtggaagaacatgaagatagtatactgcttgagttgcattatgcaaatgaagaatgtcaagagtggaatcaagaactacaaagacttatgggagttgtatcaattgtagctacaatagaagaaattgatgtcaagaggaagttgtttagtattacaacaatacaatagaagaagttgacgtcaagaagaagaaaaagtctagtactactagagtaagaagaagagaaaggtctaagtgaaggagtagggctacctcaaagagatgaagacatgacgtagacactgaaccaagagtggtattcagaagagatcagaaagtattaaagaaaaaagaagggttgaagcgggtgtacatatgatcttgtcaccaggacatgatctatacactacaaggagcttttgacaagaagagaaacgtagacgagtttagaatgtggatgagctataaaccgttggagagaacctgatgaaagaaatgcgaggtatgatcaacctagagtagagaggagttcagagtatctcgtcataatcttgtagaattcgaggacaaattcttttaaggggaggagaatgtaatacccctgactatgactaggaatccgtcggacggtcgcgaacgtagaggtgcgatcgtaacttaggaaaattttcgataataatttttagacggagttgtgggtaattcaaacattacccgaatgatcattgatcaaagaaaggttacataaggagtttaatatcagtttagaagaaagtagagattttatcggctaatgctacatatcaagaagactaggatcggctattatagacaaaggcagttaaggctatcgaggaatttattaagactatcaagattattatcgagaaatagtaaattcaggccgagacaagcaagcgatgatcgaatgggattggatgcggacacaacaaggttagtggagtagttaaatgacttagtcatttatttgttagaagaatgggtaatgatcattgtccgcgtacaatggtcggagagttctcggtacgggcgtgtaccgtgtgttgtgcatgatcctccacacgttttagattagaatgggcatttagataaggataagaacaagattggataatgatacgcttgaaagtggataagataaggataagccttatcctttgagtgacttgcactccaagtaacttgctgaccaagtttccccagcctatataaaccccctagatcgattcattagttcttcccaccaaaacctgtagcttaaactgttagatagctagttagtccgtcggagtctgagtcgggtagaagttggtcgagtcgggagtcgtagttgggtaataaggtaagtagtttcgcccttagtcttttattctttttagaatatttttcttaattttgttttcggtccgacgcttagatccatcgttagtacgcgttggagatagctcggtcggatcaaaattattaggcggtcaagggtagaattttaatctcttgacaataaggccaaggtgagtaccgtagcgtgtgtagtagcacatgactaggttttattttggggttatgattgttaggcatgaggttgcatttttatacttagtataatttatgcatttattgtttatagtcggatctacgtttttacgtaagatcggcttggttgtttgattagatcttgcattcatgcttgatttagtttaggatgaagtatttgtgtgcttaggctagacattagtttagccattatgttgcttgattgtttgtttgtttgttcgtaatttttattatgaattaaattgttagcaagcatgttaggttgtttgattgattgttgttggttaatcttgctttgtcttgattaacctttgagagtcaattgcttgctagtaggttttattacgagtagtattaggttacattaggctcgtagtaagtaatgtggttagtcatttatatgaataaggtgtgacgatgtcgtggttgtcccaatagctcagaatggttcgctaccacccgagactgcccaacggggtagtaaaagttttaccgtaagggagttagtcccttctagacggtttagattggggaagggatgtgatctttttagactttgtgtctagcggtcggagacattgccttgtgggaaatcagcatcgtaaagtgtaggggcccgtaggatgaagagtcgttagcatgctagttttagattaagtagtttccgctgcatatactctataaagagtattcattgcttgtttgtttgtgttgtgtgatttcttgtcgagtatactcaatttagtatactcgtattgattgtttgattggggattgggattgggatttttgttattggttagaaacccaggctcactgagcaatcttacattactcaagattctacattttgtcttataggtaacctttgttggggagacctataggggagcacggacgttggggaaccggtgtagagtttgttgtctttgtaaaattagatttgtaaattgactcaatttgagcattaggctcgggatcccaatccattgtaagtgttttcatgttttattgaataaaggagattttcttaaaaaaatccttgtgtacttctgatattattcttgtcccgactaacacaacttacggtcatggtacgggttgaaaagccttaggccatgttcgtgaggaacgatgttcaaggatggcctgaccttggtaccagatgtgttctgggaactcggtcggatcgtctacgtgcatcaaaagtaacgcttccggattcgttcttagtcctagaacggtttaggggtgttacaggtatgagagaagggaagtggatattttggtacatactgcgggaaaccagccacctttgcaaacccaaattgtgttagtaggagttccagtagttatccaggatacaatcctacgggcaaaccttttggtgatgccgatggaaaggttcgaagttatccttgggatggattggttatcaggatatcatgcccatttggattgcgggcggagcagtgtagtgttcgaattaaggaattgaccacaactcacttactgtggaatcaaaccaagtaagattgcttcgttcgtgttagcattgaaggttgagagtttactaagaaaaggagaagtctaccttgtcactttaaccgccgttggtggagaagttgcaagtgactcaaggattgaagagatcccggtagtgaacgaatttgaagatgtgttcaagcccttggaaggattaccaccgccgaggaatcatccatttactattaatcttgaacctggggcaactccaattgcaagggcaccatataggatggcgccaaccgagcttgcagaacttaagaaacaattggaggatctacttgaaaagggatttattcgtccaaactaatcaccatggggagctccggtattctttgttaagaagaaagatggaaatatgcggttatgtatcgactaccgagatcttaacaacatgactattaaggacaagtacccattgccgcgagttgatgagctattggatcagttgaggggagcaagttggttctcaaaaattgatctggcatcggggtatcatcaaatttcaatctcggagccggatgtaatgaagactgcctttcagacaaggtatgggcaatatgaatttgtagtcataccatttggacttacaaatgcgcccgcagctttcatgagacttatgaacgaggtattccatgattatttggatagcttcgttatcatatttatcgatgatatcttggtatattcatggagtgcggaagagcatcgtgaacatctatggaaagtaatggacagacttagggaacaacagttgtttgctaagtttagcaagtgtaagttttggcaacgagaaattggatttcttggccaccgaatttcatgacaaggagttacggcagatcctgaaaagattgccgtaatacagcaatggccgaaacctacatccgttacagaagtacggagctttttagtattggcaggctattaccgtaagtttgtcaagggattctcgtcaattactaagcctttgacccgacttactggtaaaggtttaccctttatatggaataaggttgttgaggaggccttcgttaagttgaaaaaggcactaacaaccgctccaattctagctttgccggagccaaataaaccatatgatatttccacggatgcttcgagagttggcttgggatgtgtccttatgcaagacggaaaggtaattgccgatgcatcacggcaactaagacgacatgaggagaattatcccactcacgatttagaaatggcagctgtagtatttgcattaaaggtatggagatcatacctgtatgggaaaacggtacgagtatttacagaccaccaaagtcttaaatacttattcgcgcagccagatttgaatctacgacaacggaggtggacggagttgatcaccgactatgatttgaagattcagtatcacccgggaaaggctaatgtggtcgccggaaagtagaagtggatgttgaaaaggatctagagtcgttaactgatgagttaaagaaagtgactttgttagctctagagggtgaatctagtgagcccttgggtttacaagctgtaactcaagcaaacctacttcaccgaatccgacaagaacaagtgcaagatgaaaagttgcaaaaaatcgtggaggaattaaaaacattagatggaccaaatgctagtggctaccatctagctgatgacgacactttattactcaatgggagaattacagtacctgatcgtaaaaggtttacgacaagaaattttgaaggcggcatacttctttattgagcattcatccgggaagtacaaaaatgtacaaggatataaggaagtattaccattggcctgggatgaagagatcagtggcaaaatgggtaagccaatgtgattcatgccaaagagtcaaagtggaacatcaagtgctggaaggtttattgtgtaatctacaaattcctccatggaaatgggagtcaatcttgatggattttatcactgggttgccaacaagaccaggacatagaaatgatgctatatgggtagtcgtggatcgcttgaccaagatgggtcattcggtgtcaatgaaaagcacagatgtgtcacctatcctggcagaaaagtatatcgatgaaatcttaagactctatggggtacctgctaatatagtatctgatcgagatccgaagttctcatccatattttggcaagacctccaacgtgctttaggaactaatgtacacatgagcacgacatttcttccagaaactgacgggcaaactaaaaggaccatccgaaccatagaagatatgattcggctacgtgcactagaatgggctggtgattgggaagactacatgcctttggttgagttttcttacaataacagctatcactcaagcatcgatatgtcgccatttgaagaaatgtatgagaggccatgtcgaactcctctttgttggacggaaataggagagaggacgagttttagtaattgattgattgatgagactacagagaaaattcagtttatgtgagataatatgaagaaacctcaagatcgaccaaaaaagtatgctgaccgaaagaggcgtgaagtggaattccaagaaggcgacatggtttatcttaaggtaaccgcgttaaaagggaaggatcgctttggaaaagttggaaagctcgcggtaagatttattggtccatacaaaattaaaaagagaatcggggaagtagcataccatttatatatggcggaagaaatgcgattacataaagttttccatgtgtcgcaactaaagaagcatgttccggatcctaatgctatcatacccgagccgatacaagagttaagaacgaatctcacctatcccgaaggccctcttggcattggtgaaagatgaatgcgggagctaaagaatagaagaattctgcaaattgaagtgatatagggaaggcaaaatcgtaagtttactacctgggaagatgaggaaaagttccggacaaaatatccacagtttttcgaaccaggaaatgcagaggatgaagccggaacatctaatccttcaggaattcgggacaaattctattaaggggggaggagaatgtagtgacccgcgtaaggacatcagccacgggcaagagtctgaatttttgaaaattgcccgaatgcatggccaattgaccttaggtgcccaaaacaccatagaatatcaaagggcaagtttgggcaagtttgggcaagaacgggcgtgccacgggcgaaagtttgccccgccgggcgttgaccgaccgttgaccacgccaaggacgcgtggctcggctaatttggggcccaagcaaagttgcttggaaccgaagtttaggtggccacgtgtcactcatccgcttgagtagcgaacgtgtcatcgcgggtagatgacacgtggtttggtgactcgcccatactcatgacacgtggacatgctgactcgccattcccttgcctataaaagcccaactccatcccatttgattggtgaagagaaattgagcgggagtgagaggctgccgagtttaaaccgtccgttcgatccaagttagggtcccatagccgagaactcttcctgaatcgttagaagctttccgttggttactgagttagttatggacaatggtttaagtttcataatcatatcgtcatgcattcttgattattttcatgaattatatgaattgtgtgaatggttatattagactgcatatgtgatctttagattcttatgttgttgcttatggttgagaggttgtgctgagatattgatgattctatgtgttgatttaaccgtatgttttataatatcttaaactttggggtcttggtacatggtgcttgtggtaggaggcaaagaccataagcgtgccaagatcgtgatatgaatggccttcgtagtgaatcgtgctattgtggggtcttgtaaagttgttacttgatcgccatgaagtgcgaagaactcggagagacggggctagctaccctggccgagtgtctacacgacggtgtagcgtttggtagtgatgctccggttgtatacctttgtggttgtaacgcgggagatcacgggagtgtgtgtttggtgttgggtttgaaggcagcatatcgggccctatttaaaagatttaataaaactggagtcttaatgcattccatatctctgttgcgtgtttcatgttgggtatttgggttgggtaaattaatgtctgttgcagggaataccaagctcactgtgtaatcttagattactcatgattctacttgttttgcaggaaacccatagtgggaaatagagggcgtggtggacattaggaaacccggagtagttttgtgccttttgtaaaacaagtatgtttctaatatgtatcgtgcttttggcactaggctctggccatgaaacttataaatgtttggtaacatgtagtgtaatatttatacttagtgtaatatttatacttatgaaataaatcgggttttcttgtacaaattgcgagtaatgacttagtccgagtcggcacaacatttaaatatcgcgagggttggcaagcctaaacgatgtttaagtgggagagtggtcgtcaatacaccggccaagggttgggatgggttcccaaacctcggttggatattgatgatcaatctcaatgtggcgttttcgaggcgcccgtgacttgcccggtcatagagcgtctcgggggcgttacaaaccctagatacaatttcgattgtgcgagtttcgactctcacagagacaaaaatggtccctctaatgaattggtcgagtaacaggggactcttagagaaaggactgaactttagaagaatgctaaaggtaagagcccacggacacatactctacccttagatgtatagtatgatagctcagaagatgatctcagtcccttagatgtcttaactctacccttattctcattctttctctcttttggttcaagttctgaggatgtttctttaaaacgattcaaaagtctagcggtttggtcttaaactttggtaaacttaaggcttttcttctaaacttatagcatagagggcgttttacccttctctttgaattacaatgcctaactctgtttgagttccaaactctttactagactaacactttctttagtatctcccttgagaactctaaactcttactctcatttttatctttttttcttttcattctcattatcttttccattcattccatacacaatcctaatcccaaatacaagtctcaccttgtcctacctaacccaaaaagcgtgggctaggtctacatgaaagactgctcttgtcggctcatacctaacacgttataccaaactcaatctaaaaaagaactcacaatcacacatgatatgtctataatttgcatgatttaggcattcattcttcaccactttgtcattgtttcatccacatttcatctcattaggagtcgttttagtgtgttttgcatacttaggacggtttttcattaggattgcatgtgcattgcatatttggttgttttcaagtactttggatgctttttgagttcaaacaaaggagaaacagaatagaaagtcagaatgcccaatgacgccttcagccaaaacactctatcgcagcctcagacccgtgtaaaagcaaatcactctatcgcaaccccggagaagagagcagctctgttttactcaatcgcgaagccggaggaatcacccaatcaaaaccactcgatcaccactcgatcaccaggaagcctatctgctcattttgcactcaaccagacaagctgagaatacggaatagaagaaaagctgaagaaaccactcgatcaccacctcatgacatccactcgattgcaccactcgatcacagggttgctggaccatcctatctcgtcttcacttcagaccactcgatcgcaaggaggagtccccgacgcccagtttggtcaatgacatactcgatcacagggaagcccatttcagcccatcagattccaatgacatactcgatcacatggtcatgacgggaagattcactatctatctagtttccttatttgcttcatttttgcttatataagtagcctctaagggttttccctagggcattattcatccaacttttatatttcacaactttcatagccgcagtgttttctcctgcgactttgtattcactttctagtatttgatattcagttttcgtttaagtcttttatccttcatgttatcaagctttcaatcgttgctttgctattgtctttcattatgtctgagtagtgaactgtatttctgaggatgggatagagtagttgtggtttacttagtcgttttaggttgttgagtttagaataatagaatcccttctcggttagttgcgcttattgcttgtttcactggctaatgtggaatatgaatccagacattcccgctctaaaaaggtgttcaatggaatgtcggatctattaattcaagagatattcggctctatcccaaggtattggtcgtgtagagagggtattggctttaacatgttgattcgataatgcctgcttagttagagatcgctaatggtgattaggtcagtgtctagctctgcttgaggattgctgtcacggtagtgaagtaatctgttgttgaacttgttgtctagggatagcttttgtgaagttttgtcaaccgcctgaatagattaagtagaccacaatattcgactaccccatccttcggaatcgtttatccatttgattgtctgttatcatttctgctttgttattcacctgcctgctattgccatttctgcttttagtttcatttcatttctgttattgcatactaggactgttagaaccaaccaactttctgcttggcttgacttagagctttctgatcatatctcatctgtttgcatcacaccggattggattgacaacctaaaatactacaacgataggatagtgttttaggattaatttaatgccgttgccagtcttgtgtttgtttgctatatttgagatcattagaaacgttaagatcaaggtcgtttttgttacacaagttactttcattgtgtcttttctatttttgtatttcaggtacccagcaacagttttactgactcatctctgataggtctactaaagccaagctgctacccgttgaatgcatacacgatcccaagggaatcagaacttctttttcaacgataacatcgaccgaattgctcgccaactgagagaacagacaacaacagacacaatggttgacgttgtagatgagcaagagcaacctaacaacattggttatggtgacttccctcacaaccacaaccagcgtcatggcattgttccacctccagtacagaacaacaactttgagatcaaaagcggtctcattgcaatggtgcaggagaacaagtttcatggcttgccaatggaggatccgctcgatcatctagacgagtttgaaaggctctgtagccttacaaaactcaatggagtttgtgaagatggtttcaagcttcgcttatttccattcttggagacaaagcccatctgtgggaaaagacgttaccccagggatcaatcacgacctggaatgactgcaaaaaggcgttcttggcaaaattcttcttcaagtctagaactgcaagactacggaatgatatatccggattcactcagaagcaaaatgaaagcttatgtgaagcttgggagcgcttcaagggttataaacctaatgccctcatcatggatttaagcaagcttctcttctcatcacactctacagaggcatgttgcctaagataaggatgctgcttgacaccgcttcaaatggaaattttttgaagaaggatgttgaagaaggatgggagcttgttgaaaactttgctcagtcggatggcaattacaatgatgactatgacagaactatccgcaccagttcagactctgatgacaagcaccacagagggataaaagctctcaatgacaaactagacaaaatcgtcgaaatgcagcagaaacatgttcacttcatctttgaagatgaaccattccaagtataagagggggagaatgatcagtgtgctgaatcaactatgttcataatcaaggtggctacaacaaggggtacaataattactgacccaacccaaatatgtcatacagaagcaccaatgtcgccaaccctcaggaccaagtctaccctcagcagcagcagcagaaccaacccaaaccgtttgttccttacaaccaaagccaagggtttgttccaaagcagcagtttcaaggaggatatcaacaacaacaaccaccacctaatttcacaccacaacaacaacaagcacctgcgcctccgaatttagacataatgactatgctccagcagctcattcaaggacaagccacatgagcaatggaaatccctaagaagctggctgaattaaacaacaaagtcgatcgacaaggcgtcgaacttaacaacaagtttgaattcctaggtactaggatgcgatatgtggaaggcatcctcgcttcaccatctgttaacaacaacccaggccagcttccagggaaagcaatccagaatccaatggagtatgtcactgcccatgccatcactattagacatgatcgagagctgccaactcgacatgtccctacttcaaacactgaggacagtgtgattctagagggggaggatttttatcaagatgatgttttggctaacaaaacaattgaagagcccatccttgacagtcaacgcactcgatcacaagctccgccagctactaccttcgttgcaaaacagacagcttcaaagaccaaagatacaatctttgtgccactgccttacaaacctccgcttccattccctagtcgatttaagaaagttctggttgcgaaatatcgagccctcctggaaaaacagataaatgatatgcctttagtggactgcctcgcgctaatacctgacgagcacaagcacgtgaaatactttattatagaaaggatcaaagaagtccaaggaatgatggtattaagtatgagtgcagtgcaatcactcagaagaagattgttcaataaaagttagaagatccaggaccttttactctaccatgctccattaggcaattgcctttcaacaaatgtctatgtgatctaggagatgcagtcagcataatgccactctctgtggcaaggaagctgggattcctttagtacaagccttgtgacctaaccttgattcttgctgataggacttcaaggagatcttttggcctgttacaggatgtgccagtaatgattaatggagtagaggtccctactgattttgttgtgcttgagatcgatgaagaatctaaagattctctgatcttaggaagacctttcttggcttcagctggagcagtcataaatttttaagcaaggaaaaattaatcttaatctgggggaggatttcataatgaagtttgaaatcagggacactatgaagaagccaacaatagaaggacaaaccttcttagttgaagaaatgggtcagctagctaatgaactgctagaggagctaactgacaaagatcaccttcaaactgctttgaccaaaagtagtaaagctagatttctctcaagtgagaccttgagctatgagatgtcattaaactcacacaacaaagtaccaggattagagatctttaaaggtgtcattgcgttagaaagagaggatgttgcattcaacgaggaaggctcaattgatactcgactagagtgctcaaccaaacagctaaagtcaagcatgagggcatcaaatgattggttagaactcaaagagaggtctaaatggcacaacagagctataagagacctaacacacagtgtaaaagagttgaaggatcaagtcaaggaactccatgggaaagccaaccaagcaccactcgacatcaaggatgtcccaaatgatgaagttattcctatggttagaaaagaaggatgtgaattcacattagaacagtctacaaaagacgactatccatatgatgaaaaaggagcttaccaagaaagggccattgagtactcaattacagacttgtaacgagagcatgctgaatttgatgttatatctactaaggaaggagaggagacgtcaattctactctatcaccctccttgagcctaatgagtgtgaggagtcaagttagagacttaaaacaagctcacttgggaggaagtcccatgcctatccttgtatatagtttttttttttttttgttacttttggtttgttttggttttggttttgattctcaggaaatgaagaacagctggagtaacagcaaggatgcaaccgagtgttcaaataaaaaatttcaatttttttgatgaatcactcgatcgcaagatgagagtaaaagctcgggagtgcgatctagtggttttgggacaacatctttctttacgacaatgtcaaactactcgatcgcaacatggaagtggtgtgatctagtggtctcctagtggaatttctcaaaccactcaatcgcaaggagaagtaaaaacacccgacaggacttcaatgacaacccgcctgaagacatgccatccaggtgccacgacattgccccaccaaggcaatccaactataaacagagggaccacaccgttccgcaagttcccgcaaggcactcgtctcatgagccaatggaacacaagaggaggaagagtgctagaactatacattcatcaagcaaaggccggatattgtcgggccgaagaacacatgaacgtcatgctccactacctgctggggttgcgatcgagcacaatgacgaggagatggcagagccacatcaagaaccggtcgtgcctgcggagtacactccagcatatatggatgactacatctccaggacattctactgagtaacacacccaaaccctttgtaaataccgcttttgtttttgtttctatgtttatcttgaattctttcacaaattttgcttacacaagggactgtgtaatttaagtttgggggagggttcactacgtatctgacttgtttttttttgtgaataccatttgagtctgcatatcatctaagtcatagaaaaatcaaaaaaatttgaatttttttgaaaatgaatttcacaaaattagagtgatcatttagttgcattacatttaggatcgagtctagagtgtttcatatatgattgttgcatatgcataggggataatgaggaaacaaccttataagcatgatgattcagtaaaatgagttattagttctttgatgcatttgaatgactttgaagtaaaattgcaccatgttctatagaaaccactcgatgcatgtcatgacgcctttccctatcaatttgaacttgaatctgacttataattatcatgtttgaactcatggaaagaatacatatttggattttctttcacttattcaccactcttcttaatccaagtagttgtttccattattgaagtagttcccccacccttaaccaacccttctttcaagccatgttattttgtgagagcatgtgaggcctattttcaggatagagcttggtagaatgtgttaggtttgagccgacaagagtagtatctcatgtagttccaatctgtgtttcagacttggtaggattaggtgggaacttatttggggattgagattgagtgtgaaaagaaaaagaaagaaaaaaaaaaatgggttagtgtctttaggagaaggaaggtaaaaatcatattgaggtctagtgaatgtttgggaagcataaaagtgttaagatatgctctaaaaaaagatggcaacaagaacagaaaagaaaaaaaattataagagccataagagtttaagaataactcaattcactagacaagactcatagagtttaagaaaagcttctccttaagaaccagagccaaagaaaagaaaggaaacattgatccgagaaaaaatgaaatatgcctttagtgtaaaagggtagacttaggatcatcattgagtttagagataggacaatctacttgttatgcacggtttgtgtcattgggtagatgagatgttattcttgtatgcataggttggcacttacctttagcattcttctaaactcagtcttttttcattaagagttcaatgttattaaaatccgaaccacttaaaagggaccatctttgtctcgtaacatatccttagccaaaagagttcactagcgatgcatatcttgattcatgtttttgaactttatgaacgttaaagggattggttgatattgacgcattgtgcaattgagtgtaggtttggatcataacagagcatggctaaagttttttaagtagaagtcgatcacctcgcgtcttagaacttttagcttgtacattgatcttaattgtcatatctcatgctttggttctgagtccccaaattcaaacctctccttcaacctatgtcttcttgtttgcttgagggcaagcaaagactaagtttggaggaaagtatatgtctttaatttgcatgaattaggcattcattcttcaccacttgatcattgtttcatccacatttcatctcattaggagtcgttttagtctgttttgcatacttaggatgattttgcattaggattgcatgttcattgcatatttggttgttttcaggtactttggatgcttttacagttcaaatagaggagaaacagaacataaagtcagaatgtccaatgacgccttcagccaaagtactctatcacagcctaagagccctgcaagggcaaatcactctatcgcaacccgggagaagcaagcagctcagttttactcaatcacgaagctggagaaatcacctaatcaaaaccactcgatcaccaggaagcctatctgctcattttgcactcaaccagacaagctgaaaatacggaagagaagagtagctgaagaaaccactcgatcaccacctcatgacatccactcgatcgcaaggaggagcccctgaagcccaatttggtcaatgacatacccgatcacagggaagtctcagatgccaatgacatactcgatcgcagggtcatgacaggaagatttgctatctatctagtttccttatttgcttcattttcgcttatataagtagcctctaagggttttccctagggcatcggttattcatccaacttttatatttcgcacctttcatagcaacaataattctcctgcgactttgtattcactttcaagtatttgatattcaatttttgtttaagccttttatcatttctgttatcatgctttcagtcgttgctgtgctattgtcttcgattatgtctgagtagtgaacgctatttctgaggatgggatagagtagttgtggtttacttggtcgtgttaggttgttgagtttagaatactagaatcccttcttgattagttgcgcttattgcttgtttcactggctaatgtggaatatgaatccagacattcctgcgctaaaaaggtgttcgatggaatgtcggatccattaattccagagatattcgcctctaccccaaggtattggcttgtagagagggtattggctttaacaagttgatttgatattgcctgcttagttagagatcgctaatggtgattaggttagtgtctagctctgcttgaggattgctgtcacggtagtgaagtaatctgttgttgaacttgctgtctagggatagcatttgtgaagttttgtctaccgcctgaatagattaaggagaccacattattcgattaccccatctttaggaatcgtttatcaatttgactgcctgttatcatttctgctttgttattcacctgcttgttattgcaatttctgcttttagtttcatttcatttctgctcttgcatactaggactgttagaaccaaccaactctctacttggcttgatttagagctttctgatcatatctcatatgtttgcatcacaccggattggattaacaacctaaagtactacaacgacaggatagtgttttaggattaatttagtaatatcctactatcaacacacaaaatgatctttggcttgaaataaggttaagttcaaggtatgggatactactctaaagatgagagtcaactacttcgattaacaaagggtggtgaagtgaataagattatccaagtatgtatatggtagccatgagttcacaaacaatgcattgacatgataattgcaaattcagttcaggttctaatagatagggaatgacatcagattagtaaagagaacacaatgtaaaattttatggttttttctatgccgtagatgatgcaaaatttgaaataagtaaagagaacacaatgtcaaacgtgtcttgaaccctcccccaaactaaaattatatagtcccttaatatgaaagagatttcaagaccaaaacaaagaacaaacaatgaaaaataaaaagttatggtatatacaatggtggtggtggtgtaacctcagtgatcaggtgaagtagacggatacgaaatcgtccataatctcttgagtataagcagggactgatgttgagacgggagggttttgctcgtcctatccggtcgagtagttggtcgagcgtgtggatgctcttctctgcctactccttggctctctcaactcggcgatcacttcccaaggctcaaatgatgaagctcgggttgatcgatcatgttagcccttcttgcagcaaaacttgtggaacctcttcttcttacttcgggggtgggagaagggggccttggcttgctttggaagtctttgatttgagcagccatactcttcaacaacttcttcatggttctcatcttcttcttgaaacctttcatcgttttactgtgaagcacattgagcttgttgtgaacttcagctatctcatctcctccttgatcagcatcttctttatagtgagcttgctcgaattcgttagtctcttgctctggttgttcgctatgttgctcgaattcgacttgctgctcaaattcaataggataatactcttggtgctcatagttagcttgagtatactcttgtccatcttctctagctcctccgatgtcgatgttcagagcagagggagatggcatgaagttgatattgtgccttgtcttaactgaagttcggttctcgcaaggtaggggtaacaaagaaggtccaagctccagatgtttgaacttgaagacgtagtgatccgtcggagttgtcttttcaagataatcctttcccttgaggtaatcgaggtcgaggaacttggtgttaagggaccaccaacaaaaagactttcgcaaatccccaagcgatggatggttgcagcatattctctatagctcaataggtggtctacaagaacaacagtcaacaaagtatctgctctatcacccgcaatcttcctcgcatccttggtctctctcaaaatgaagaccaaagcttgatcaatcatacatagctctccttcaccaacatctccagtagtcttctttggaaaaagggtgttggcgatacatttgtggaggtacctaatcacgggacttcgaatcgaagaactattgctcttggcgggcgagtagggctttggaccaacgattgttgcgaaagagagagtagctcatcttggtcataatcttggcagatttcctctccgcttggaaacccaaaaatagtatcaaggtggttgatatccagggcatactcgacacccttaaccttaaacgtaacgtaaccgaaacctcctctttcttctttctccgaatcattaacatgaatgtggactttgagggttgcaaggagttggcagctcttctctttaattaccccaaattggcagctcatgaacgttgcaagattggccaattccattaagtattccacatctccacaaataccaagctcttgcatcgtttctttatgtagttccttcaaacttcaattccttcaagtattgatagtactcgcttggggttggctatctcttccttcttgccggtttcttctcccaacaggggctggtgtatcatccccgatgatctcaacctcttcttcagaaactgcttcttcaaagactacctcttcttggtgttcttccgcagcctcaacaatcctcttgcccctagctacttcctccctctacattcttgagcgactagaacttcccccttgaatcgagctagacttttgagcacaatgagcttgaaaaatttggcactcagtcatgccactcatgtcaatcgctgcaacttcttactatcgacagaggatcttctagcccaagatgaaccctttcttcttgaatccatggagtttggtggtgagcttctacaggataatcaagaacaattctccaagaggtatcaaaatgaaaaggattcgttttttggtgctggagtttcgagcttaaaaaccgattgaatatttgaggatggacttgggaatgatcgagtaagtttggtgaggtatggtgaaggttagaacgaattcttgaggagtgatagggagagtttggaatgagagagatagagattttgcaaaaatgagatgatgaaagagagatttcaaggatggtttggcgatttcaatgggtggagggggatggtctttggtttcttttggaatggatagaaaagcgagttggaaatagtgatggtatgggtaaatgtatttcccatcgagtaatggagtgttgggggaacaagtgggatcacacaacttatgccttggtctccaaataattcaagctcgagtagatggtcgagcatcctcttgaaatgcgcaaaactcgatcaaacggtggagatcgctttgctttcggtcactcgatcaaacggtggtgatgcttccctcatttggtcattcaatccaatggctagaacattcttcttcatttcactcgatcaacggttgagatgattcttgactttgtttgaatttactcgactgttgacttcctcagggtcaatgaaataaacctgaaacacttttaaacaaaaacataaaaaataacaaggaaaatagaaagttatatacatggataaacatgggacttcctcccaattgagcttgtttaaagtcactgagtttaactcttacagagcttagttagaaaaaaggttgaagagcggaacagagaagtcctcatcttcagtggttgaatcttcggtgcctgaatcatattctgcatcctctcttgacatatggaaggatgagtactcatttgatttttcttgaaaataaacttctttctgatcaacatagtaatcttgttcttctgaacgaggtttctcttaccaattctcaatttcaaaaatggggtaacttttaaccattttttgaagttccaagattgcatggttcagttcttccatcttgcaggttagcttcccaatggtatccctgagctttgcattctattctgagttccagaagttttccagtaacagagtcaagtgtcaagtgttcttccttagaagagggtttactaggcagtttaggcactcttggaaaataagtcagaatagggatttcttcctcactcaacaactcatcctctaagcttccttcctccaaaatgaactcctttatgatcttctggtgcaaaccattctgttgtgaaatcattttcctctttaatagctagtgcaatttccatcttctctggatcaataccaattgaatacttattaactcttttttcaaaaatccatagttgatctttcagcttcatcacccttgaagataacccctctatgactttgctttgccatttaaattattttctcatctcctgctattcatctttgaagggtcttcagtctgagctaaaccttctatggctttcttcttgtggtcatcatttttctttagcttactgagttgagaagtgtagttgaatcttgatgggattccagcttctgtttcttcatcaacatccatgccctggatcccaaaattctgacctcctgttgttgatgtccctgaagctttgttgatgtcaaatttcatcttgatgcctttttaaggttcaggttgatctttccattcttgacatctatgactgctcctgtagagactaagattggtcttactagtatcaggggatcctttccctcttcatatgtatctaacactacaaaatctgtaggcatctcaacatttccaattctgaaaggaagatcttctattaaaccatggcggattgcaagagtaaagctaggttgcagaacttgtattccatgatccctagccagaggcataaggctagcagatgctcctaaatcagaaaggcatctattgaatgtcaatggtcctaatgcgcatggaagagtgaatgaacaaggatcatctagcttttcttggatgactttcttcttgtaagtttcttgagcgatgacaatactaatcatctcttgatttgatccttcttgagtttttctactttgaaattcttccgagaatggtgagtatccagcaaaggtgtgtgctctatagtccagatgaaatgctgggtagcaggtgcatcaatttgagttgaatccccccttcttgaatcatactgttctcagtattggcccccttcttgaatcatactgttctcagtattgggagtctgatgacttggtggagctcatcttcttgttgaatggtaatagcattagcagtagcatagtccttaggattctgaactacctttcatggaagttgttgaggatgcttcggagcaaaggtggatgcaaactgactctccacatacttgacctaggaatttggagctttaaacttgacatttagatcgttgtaagaacaatctatcttgttgtgtaattcagctatcttcttttcaaaagccatagctccaatagcttgtccttgaattatctattgaattagttgcttaatttcaggatcttgtgctgctggggcttgttgtggatgttgagtgaaccatggtggtggattttgctgttggtagcctccattaaattgttgtttggggacataactttggttgtactgaacaaatggcttagaatgattctgttgtggtggatacacttgatcttgggggttagctacattagttcttatgtacgagaggtttgggttgggcttgtagttgttgtagcccttgttgtatcctcgttggttctgaatgtagtagagctcttcatttgatcattccccccttcttgcatttgggaatgctcttcatcactgatatagtgtatctgaatctgttgagccaacaatagtttgtctagcttttcattcaaggccttgatatccttgctctttctatcttaagtttctccagttcctctcagtgagcgatcatagtcttcattatagaacccatcaaattgtgcgagattttcgactaattcccatccttctactacgtccttgttcaagaagttaccatttgagggagtgtcgagtagcattataatctttggtaaagctcctctgtagagtgtgctcaataatgatgctttcttaaaaccgtgatgggggtactaagtggtgtagcttttaaacctctcccaagcttcacagaaagtttcattgtttttctgagtgaagcgtgagatctcgttcctcaatctagctgtgcgagcattagagaagaacttggcaagaaaagctttcttacaatcatcccatgagttgatggagtctggaggcatagtcttttcccagtggtgtgccttgtctcccagagagaatggaaatagcctgagcttaaacccatcttcagtgacaccattgatcttggtgaggctacataacctatcaaagctatcaagatggtccagatgatctttcataggcaaaccatgaaatttgtttctttgaatcatgagatgagaccactcttgatttcaaagttgttgttatgaactgatggtggcactatcccttgttttaggtgatgatttctcaagcatcaccagcaccaatgtttcttggttgttccacattaggtgggtcttgtacatcaactggtctgttctgttgatccatagcagctggtctttgctgaacacaggctacctttgctttggtttcttgtaactcatgagctattctgtcaattctgtctttaaaaggtagtaggtgtgcagaatcttcggaccgagtttgcatgcacaaatattagtacctgtaccacaaaaacaggcagacgaaaagatgagttagtgacttgagtaatgtaaaagaacttgatcttaacttttttctgatatctagaatgtaacaatgcaacaatgaattggcaatatcgccaaattgataactaggtttttacgtctagttatatgctgaagtgtggttcagttcaattccccttaaacactaacatgtcgatgcagctataggaggtgtcaatctagtccattgttattgctagcaatcaagatgtgtagagaagcaactaagtcaaaccagattataatgatggcgggtttctagtaacacacctaaatcaagattcgaacaacaaaaataagaactttaagtgccctactcgatcacaaggttgaacagagacatacatgcaacaaatttaagtactgaaatgcaataagaggtaactcaacaagatgacacaaataacatgtgaataaaagtgcaatcaggggtgaatataaataaatctaagaagaatagaagtcctaaggatggattcattgataagggcaactctagggttcatcaggtggctaacatgcgaaaggcaaataccctagatgatagattcaaaaccaaatcaatccactctcgtgatagagatcctcataaccataccacttcctaatctcaactctcgttgatgaaacatagcaaagtaggctttaagcaacaatctaccaaagttaataagcagtctaaacatccaatctcttgtcttaggctagaataacaaatctcttggaattcgtagatcatgcatccatttgaacgtctttgggacactggatacctaggatcgaattcccacattagccagcgaaaatcgcataggggccaacaaatccagaagggatctaacctaatcttaaccacttgactaacctatagattaccctaatctaatccatcctcaagaaccctaattactactcaagcaaaataatgaagaacacaaacccaaaaattactaaaatcatatcaaaatgtagatctaaatgatatgggtctaattaatcttaagaccactctctcaaataagagatcgattgtagtactttagggtcgaattccacaaagttctcagatcacacaatagactaaggtttcgaattaagctaaacaaatagattataaaataaaagacaagacaagaaagcaataaaagagattgaaggttcagatgattaagacgtctggtttagggaaattctcacgagatatcagaatagtagatctagcagtaaattagaaatattatcaaaccattctagaactcaaatcactaatatagaggtaccggtggtgttccgcgaaacttactatgttttatagtattgatcccagctctcttgtaaatccctagaattaagcaagcattataatcgggtttgataagttcacctaagtaatcaacgctagcacgcatctaatactaggctcatctaagatagttccagataatagatacctatggtgggtatacatattatcctaaaataaagttctagttaattactctaaaactagcattaagaacaatctaagatgaaaaattataaatatattatcctaacagggttttcgatctactaattcatccaaatccctaattaagaatccctaaatccaacaagagaactactcagacatgattatcaaagaacaaagcatgtataaagtagaaatcagagtaagaaacaagagaagaatagaattagaaagatcttctctaaagggagtctccatagggttttggctcccaagaacaaaagagaaaaaggagaatagcctctccaagcttaggtctaaacaatgaccttaaaaatatatatatagtcttaaaaaagtgttgggccttcattaaacataggagaaagttctgggctgaatttggaaatgttcaaaacatcaataaattgcgtctcgaaattaccgtcaggtattgttgtcgcttgacaccaggggttgtgtcgttccacacctacgtgcattttcctctccggcttgcttctgcagcttaagttgtctattttgctctagaatgctcgataatctccaaatgcatcccaaacatgtaaagacctgaaaaagactagaaaagactctagaaataacaaatagactctaaaacctatacctaaaacatagctaaaacggtaaaaatagggatatatcaactcccccagacttagcctttgcttgccctcaagcaaaacccaaaagccgaacccgtggaagaggtttgaaaacaaaggagtctcaacattctctagcttattgccttgatcatcctaaccaaatccatatgcctagcagttctaatcaaatcctaaccaacatgtacttctctataagtttacacaacattctagattccatacctaagttccacaactatatccatcaggctttcattgttgggtctcatcaaagaagctaacgttcaagatccttctagactcattcttgcactataaatcgaccattcatttattttttctttggtattctttctctccccgagacttcttatttttagggagtaaacaaaggggaactcgcatattgaattgacaccctcggcaattttccaacctttgtaattgatcattcctaataatatataataatggggtcataggaaacattcctacccctatacactatatgaaaatcctgtcaatctctcattttctttttatttttataaggggagaggaacacattctttttatcacattagtctcaatatcaggtatgaacaatgagtcaagatctattaatactaacattttgaagaggtaaaaggaagagcagtgagattagctccaaccttagtggtattgttggaaactatgatatcctcaagtctgttggtttgccatctagattttccaatattcggattgagtcgaacctgcagcattaatcaactagacaataatctaaagaatagagatcataattcataacaaaattttgactcaataaaacgactcataaagaaaaataaaaataagaataagactcaaaaagaaaaacatagtaagtaactgcctctcccagacttaaacgtcattgtcctaagtggcattcaaatccggagtaagcgagaaaaataaaagaaaaacgaaaaataaaagaaaaagaaaaagaaaccatactagtgggttgcctcccactaagcgcttgtttatagtcaatagcttggtctatctaggaagagaggagcatcgggtgggactcaggtatgggtggaatactcttttttcttgcacaatcatcaaaagaaagaacaagcgcccgacgagaaactaatggcttgcttaaccggaaaacagtttttgaaaattttaaagtcttattgatgatatatggaggtttaggaggaggagatgagtacctttggcgtttaggaggtgtattgagtagtagaggtgcattacttacaatccgtccttgacttgcagcagcgatttcagccttgagattcaattctggtgcagtttgttgtgggtgtcgatcgacattagaaggggtatcgaagccactcgttttccagctcgactagccttagtctgtctacttgtcaattctacaatctgttctgagataaccactctcttcctatagttcttctgtttctgtggagtcttgttctgaataatatcagttacatgtgtacaaatcatcattacaccatgctcattattcaaatccatattaaccatcctcttaacataatttcagaccaaaggagaagacttcacaacatctagaagtggcatctctacaataagcttacccatcatagcttagcatatagcatcatctaactcatgtttggagttcctagggctcttgggaaaaggaaccttgggtttggttgccttttctgcagctgaaatcgggttttggagaatttgcaggtctggactaggttggtgtcgagcgacacccagttggtgtcggtcgacactgtcaggttctgcagtgtctgcgttacctggtgtcgattgacacccaacattttcaatcgacacttgtgtcaggtctgcaaaaactgcgtcatcatcctcttccaaattgacaattttcgcagcaaaaatccttctttgaagaactggatttagctgttttccactctttaactcaatagcactaacctcctctatatttgtaatcaattgcttgatccgattgttcaatacttgaatcttcccattcacatctttggataaagcatcaagtttgtgatcaatatcggttgtttgcttcacttgacctttgagaaactattcgagcattgactcgatcgtcttagtggtctcgggtggagggtgggcttgggttgaagaagcataagtctgaatgaagcttgtggttttctgaaccggtttctgatgtgtaattgttgattgtagctcatgtattcctgttgatccatcttctctaaagtggctaaactgtcaacctgtgcagcatactaaacctgcattttccttgaaatgtcaatgcttttggtactagtgctggaagccaagttgtcaatcaacattgttgcatcttctggatatcttgacttgaaattcccattactagctgcatccaaagccatctgatagtgccaatcaactcctctgaagaagatacctaacaactgaacctcactaaaaccatgatgcgggcaatctcactaatatcctctaaatctgatccaagcggctttaaatgcttcagctgcttcttgagagaaggtaaagatcttcattctcagcttctcggatcttgcatcattataaaagttgttgagaaaagcgacatttatttctttccaagttgtcagagatccaggcttcaactccttaagccaagaagatgcttccccatcaagagaatatgggaagagtttgcagggaagatagtcataagaaacaccctcgccttaatgcttgaaaccaagttttcaaaccgatcaatatgatccataggttgttcttgtgctaaaccatggaaagggtgcatactcacaagagtatataatgtagggtttatcgagaaattgcttctttcgaaagtaggtggtcggactgcagaccgattggaatagaagatattcggtctgttgtagtcgccaagagtcatccgacgaccatctgctctgatttcttcttggtgtcgagcgacatccagctggtgtcgatcgacaccctcggcgatttatgatattaggttttcctgttcatctattttctaactccttagttgtatgcctgaccagctctgtagcgtaacactccagcagcatcaggtatcattatcagcatcttgtagttgcgtttgaattccttaaactcctgaaacagaagaaaaagaagaaataaaaacgcgtgagtaacaaaagaaaaaaaaagcttagactaaattctacacctaatctaatggtaaatcgaagaaaacttcggcaacagcgccaaatttgatatgggtcaaattaatcctaagaccacactctcaaataagagatcaattgtagtactttaggatcgaattcaacaaagctctcagatcacacgatagactaagatttcgaattaagctaaacaaatagattataaaataaaagacaagacaagaaagcaataaaagagattgaaggttcagatgattaagacgttcgggtttagggaaattctcaggagatatcagaatagtagatttagcagtaaattaggaatattatcgaaccattctagaactcaaatcactaatatagagtaaccgatggtgttccgcgaaactcactatgcttaatagtattgatcccaagtctcttgtaaatctctagaattaagcaagcattataatcaggtttgataagttcacctaagtaatcgacgctagcacgcatctaaatactaggctcatctaagatagttccagataatagatacctatggtgggtatacctattatcctaaaatcaagttctagttaataactctaaaactagcattaagaacaatctaagatgaaaaattataaatatattatcctaacagggttttcgatctactaattcatccaaatccctaattaagaatccctaaacccaacaagagaactactcagacatgattatcaaagaacaaagcatgtataaagtagaaatcaaagtaagaaacaagagaagaatagaattcgaaagatcttctctaaagggagtctccacaaggttttggctcccaagaacaaaagagaaaaaggagaatagcctctccaagcttaggtctaaacaatgaccttaaaactatatatatagtcttaaaaacgtgttggaccttcattaaacataggagaaagttctaggccgaatttagaaatattcaaaacatcaataagttgcgtctcgaaattgtcgtcagattttggtgtcattcgacacctacgtgcattttcgtctccggattgcttctggagcttaagttgtctattttgtgataagtagcctacttatatgctgaagtgtggttcagttcaattccccttaaacaatactgttattgcaagcaatcaagatgtatacaaaagcaactaagtcaagccatattataatgatggtgggtttctagtaacaatcctaaatcagaattcagacaacaaaaatgagaactttaagagccctactcgatcattgggtcgagtagaaccaatatgtgacaaatttaagaaccaaaatgcaatgaaaggtaactaagcaagataacacaaataaccagtaaataaaagtgcaatcagggggtgaatacaaataaatctaagaagaatagaagtcctaaggatggattcattgataagggcaactctagggttcatcaggtggctaacatgcgaaaggcaaataccctagacgatagattcaaaaccagatcaatccactctcgtgacagagatcctcataaccacaccacttcctaatctcaactctcgttgatgaaacatagcaaagcaagctttaagcaacattctaccaaattcaataagcagtctaaacatccaatctcttgggttagaatctataaatctcttggaattcgtagatcaggcatccatttgaacgtcttttggatggtggatacctagggtcgaattcccacattagcagtgaaaaccgcataggggccaacgaatcgagaagggatctaacctaatcttaaccacttgactaacctagagattaccctaatctaatccatcctcaagaaccctaatcactactcaagcaacataatgaagaacacaaactgagaaattactaaaatcataccaaaatgtagatctaaacaagataaacaaatttgctcaaagaactaaatgcaaaaacgaaatagattaagagtaattaaagtttcaagattctaaaacacacaaaaaaactacaaaataaaagcttggtcctctggacaaatcccaaagttacctatttatactaaaatgtcggaaaccctagattcactagaagaaaaaagacttgaggcggtttggatggatgctcgatcttggggattgagtaaagagggtgctgcaaagtctgcgcctttgcctccatactccgagtgatcaattggtcgagtagttgcttcttcctcttttattcttatgctcagctgtctggttgagtcgggaatgaggaggatccgaagatgctttgaacgatcaacaagtcttgtagagttggttgcccttgctcgagtaaactggtcgagtggaggatcgagtagggggtctagtagagtctactgcctcctctgtagctgcctggatcgagtaaactggtcgagtagaatgctcggctgcttccctcatggtttgatagagtagagggtcgagtagattccttgtaagctccttttgcacctgaaaacacaccaaaacttgcaatatgtatgcaagatgatcctaaatgcctaagtgtgcaaaataagctaaatgtgatgcaaaatgatatgaaacaatgagtgatcactaagctaaatgatgacaaataaataactaaaatgactaaaatacagtgttatcaactcccccaaacttatctcttgcttgccttcaagcaaacaaaaaactttagttgaaggagaggtttgaaggtggggattcaaaaacctaaaaatgcatatagaacgggtgagatcaatatctagctagctaattttaggttgcaaggtgatagatccttacttaagaactttagccatactccttacaatgcaacctattcaagcattccagcattcacatcaaccaattccctttaacatttgttcagcacgaacagtggatcaagcaatgcaatggttatgaactcatttggtttcaggcttacgctaagagacaaaaatggtccttctaatgaattggtcgagtaacaggggactttcagagaaaagattgagctttagcagaatgctaaaggtaagagctaacggacacatacaagaacagactcccatctacccaatgatatatagtatgatagcacagaagatgatccagtcccttagatgtcctaactctacccttcttctcattctttctctcttttggttcaagttcttaggggtgtttctttaaaacgattcaagagtctaacgggtttggttttaaaattggtaaacttaaggcttttcttctaaacttatagcatagagggcattttacccttttctttgaattacaatgcctaactctctttgagttctagaccctttactagactaacactttcttttgtatcccccttaagaactttaaactcttacccttttttcttttcttttcattcccattctctttctccttcatcccatacataatctcaatcccaaatacaagtctccacttaatcctaactaacctaaaaagagtaggccaagtctacatgaaaaactgctcttgtcggctcatacctaacacgttataccaatctcaatctgaaaaagaagtcacaatcacacacaaaatgatctttgggtttaaataaggttaagttcagggtatgggaaactgctctaaagatgagagtcagctacttggattaacaaagggtggtgaagtgaataagataatccaagtatgtatatggtagccatgagttcacaaacaatgcattaacatgataattgcaaattcagttcaggttctaatagatagggaatggcaccagattagcgagtttcgaatcaaagcaatatagtaaagttgtaaattcaaagcagggtgcggtcttacttcaaggaaacaatcggttacgcaacagagaactaacaacctgggcattgaacttacttcatttaatttacatgctctacagtttgaaatcattattatcccctatgcaaatgagcaatcctaaatacaaacactctatatacaatcctaaaatgaattgcaatctacatgatactctgtttttgtgaaatcattttaagaaaaatttgaaataggtaaagagaacacaatgtcaaacacgtcttgaacactcccccaaactaaaataaacagtcccttgtgtaataaaaatctgaacgaaaattcaagaccaaaacaaacaacaaacaaagaaaataaaactgctatggtatgtacaatggtggtggtggtgttacctcagtgatcaggtgaagttgacggatacgaaatcgtccgtactctcttgagtataagcagggactgatgttgaggcgggaaggttttgagtattagggtttcagaatatttcgctataagtagcatgtattttacattttcaaggacaagttttatttccgcaaacagtttgagttcttgacattttgtaatccggatttctcttaatctattcagtattcgctttttgttttttttactaagtggttcatcttgttatcatcttgctattactctgttgctatgatgttttcattcatgtcatcgtttatgttttctacaatgatgtctgagtagtgactaggttcttgaggatgggttagagtagtttagaatcctcagtatgctaggtggttgagtttgatttatagatctcttctagattagttgttcttaatgcctattgctttctgatcaactggaatttgagcccagacatttccacgcccaaaaggtttttcgatgaaatgtctgaacacctaattccagagattcgtggttttgtaccaaggtattggttacaaggagcattttggctttaacttgttgattcgtaatgcatgttaggttagctctcgtcaatggtgatcgagtctgggactgctttaacttgagggtctctgttgcggtggcacttagatttggttatcgaacttgttgtctagggataacttattgagcatgtcaatcacatgtaaattgaagaaacaaaactactcaattaccccatcctcgggaatttctcatatgattgatttctttgtttactctgctattgttactacatcttgctgcctgttgtttagcatttgcttttttgcatgttatcactctgatactcgaccacccagttgtctggcattagactgtgcagtcgagtattcctgttacattttctgtctgttactcgacctgtcactcgaccacactcagtgcttggcaacgagctgtgtttgtcgagtgtttttactattctgcttgaatatctgtttcctgcatgttcacttaggactgctagaaaccccaaaacctgctattgaagaacgaccattaccgcaaagcttttcacaccaaagagacgtggatgcaaattcacaccgcaaggccattgatggagaattacaacggaatttggttcaagcactcgacgcctaagtattcattcattacatggctagttcaaataaacagagtagctgcgggtgacaagctgatcaaatgaaaccccaagctacgccaagctgtattctctattagcacaccttggagacaagagatcatttacatggctagtttacatgtccttatacactacaggtctggacgaagctcgcaaaaggaatggccctacaaacaatggtgttggaaatgcaccacgggatcaccgtcaagggaaaggaattgcacctccttctatccagaacaacaacttcgagattaagagtggtctcatctcgatgattcaggggaacaagttctacggtctacctatggaagatccactcgaccacttggatgaattggatagactctacaacctaacaaaaatcaacggtgtcagtgaagacggattcaagtttcggttgtttttattctccttgggcgataaagcacacatctgggagaagaatctgccccatgactcaatcaccacctgggatgattgcaagaaggcctttctagcaaagttcttctccaacgccagaactgcaaaactcaaaaatgagatctctggtttttaacagaagactggtgaaagcttctatgaagcataggaacgtttcaagggttacatcaaccaatgccctcatcatggctttaataaagcctctctgctcagcactttatagagaggtgttctaccacgcataagaatgcttctggataccgctagcaatggaaattttcagaataaagatgttgaagaaggctaggaattggttgagcacctagctcagtcagatggaaattacaacgaggactgcgacaggaccatcagaggcatagctgactcggatgacaaacacaagaaggagatcaaggcgctgaatgacaagctggacatgattcttcttagccaaagaagcatgtgcacttccttgttgttgacgagcagtatcaagtccaagatggggaggggaaccagttagaagaagttaggtacataaacaatcaaggtggctacaaagggtacagtaacttcaagactaacaaccccaacctctcttaccgcaacaccaaagttgcaaatcctcaggatcaagtgtatcctccacagcaacaacaaggtcagaacaaactttttggtccctacaatcaaggttttgttccaaaacagcaatttcaagagaactaccagaagcaaccaccacctgggtttgcacctcggcaacaccacggtcctgcttctccaaacgctgatatgaaacaaatgctacaacagctgctccaaggacaagcatatggctccatggagattgctaagaagatatctcagttacacaataagctggattgtagctacaatgatctaaatgtcaaggtggagacactgaattctaaagtcatatacttggagggaaattctgcatctacttccgctcagaaatagacaagccaactttcaggaaaagcaattcagaatccaaaagaatatgctcatgctatcaccctgtgcagtggaaaagcacttccaacctgagaggaacctatgacagtcactgaggacagtgtagatcaagatggggaggatttcagtctttataaagatcaacctgacaaacaactcgagcagtcactcgaccgaccactcgagcagccactagcccatgttactcgaccaccattcccagtaacatcaccaactgctctgaaaccagttgctgtcagaaacaaagaaaaggtgttcctcctccttacaaaccctaacttccatttcctggctgtcacaagaaagcattggcagataaaaatagagctatgtttgccaagaacatcaagaaagttgagttgcggatacctctcgttgacgctctagcactaatcccggattcccacaagtttctgaaagactttatcgtagagagaattcaagacgtgcaaggggtggtagtattgagtcacgaatgcagtgctattatacagaagaagatcattcccaagaagcttagtgatcctggctcattcactctaccatactctttaggtcaattggctttcaacagatgtctatgtgatttaggagcatcagtcagcctcatgccactatctgttgccaagatattggagttcactcaatacaaatcctgcaacatatctcttatcctagctaacagatcagtaaggatctctcatggtttactcgaaaacctgctaatcaggattggagctataaagatacccactgactttgtagtcctagagatggatgaataccccaaagaccctttgattttgggaagacctttcttagcaactgcaagagctatgattgatgtcaagaaagggaagatcgatctaaaccctgacaaagattttaggatgacctttttcgtcaaagatgcaatgaagaagcctactatagaaggaaaactcttttggatcgaagagatggatcagttagctaatgagttactggaagagcttgtagaagaagatccccttaatagccctttgaccaagaatggagaagatgggtttctgcatttggagactttgggttaccagaagctgttagacacacaaaaagcgatggaagattcagaaccctttaaggaattgaagggggagcaacagaggcaatggaaatgagtgaagaagggtcaacacaagttcaacctgctcactcgaagacatactcgaccaatcacttcctaaatttctgaggtacgcattccttggttcaaactctacttaccttgtgatcattaatgctgagttaaatgatgaagaagtgaacctgctattgtctgaacttagaaagtataggagagcaattggttattcattatctgacattaaggaaatttcacctagtttatgcaatcataggacccatctagaaaacgaatcctattctagcattgaatcacagtggaggttaaatcctaactcaaaagaagtagtgaaaaaagaaattttgaaactgcttgatgctggattcatttaccctatttctgatagtacttgggtttctccagtgcattgcatccctaaaaagcgcagaatgactgttgttaaaaatgaaaaggatgaattgatcccaactagaactataactgggcatagaatgtgtattgattatagaaagctaaatgatgcatctaggaaagatcattttcctctaccattcattaatcaaatgcttgaacgcttagctaatcacccatactactgctttcttgatggatatagtggtttctttcaaatatcaattcaccctaatgatcaagagaaaaccactttcacatgtccttatggaacttttgcttataaaagaatgtcatttggtttatgcaatgcccctgcaatatttcagaggtgtataacctctatatttttttatttaatcgaggagatggtggaggtcttcatggatgatttttcagtctatggcccctctttctcctcatgcttgttgaatcttggcaaggtattgaccaggtgcgaaaagactaatcttgttctcaattgggaaaagtgtcatttcatggtgaaggaaggcatagtattgggtcacaagatattagagaagggtatagaggttgacatgggaaaaattaaagtgatgatgcagttgccatcaccaaaacctgtcaaagacatcagaagtttccttggtcatgctgggttctccaggagatttattaaggacttctccaagataaccaagccgttaaccagactattgtgtaaggagaccgtgttcaaattcgatgaggactgcctcaaatcctttcacaccatcaaggaagcttttgtatctgctcctattgttcgagctcctaattgggactatctgtaacacccccgagacgctctatgaccggacaagtaacgggcgcctcgaaaacgccacattgagattgatcatcaatatccaaccgaggttcgggaacccatcccaacccttggctggtgtattgacgaccactctcccacttaaacatcgtttaggcttgccaaccctcgtgatatttaaatgttgtgccgactcggactaagtcattatcagtccactacaggaaatgtgggtattaatagcgggcgttaaacgctattagttttatataatagtgtttccttaaccgctctgagatcgcctgttatcgtaggtcggacacatttaatagcggattcttgttgtgctatagttatttatataacgatagcgctttctgttctgcaattgttaatattcttaataacatgattcaaatgttattaaaactcattaatttgattttgacctatatcaaagatagcaaatgtttcgtgttattagtttgtttttaaattattcaaaatttatttattaaaaattattacaaatcatttttatttataatatattttttatttcaatcaattaaatgttaaaaaaaaattaaaattaatatttaaatgtttagaaaaccataacaaatttcattgtttacaaaaaccacaaaaacctatacatcaatctactactaacaagccttcataatcattcctaacataaacactatcatcatcaatagcttcatcatctaattcatcgacttcttggacaggcaaaggtgcaccacctaaatcctcttctgtttccaactcatgatagcctctaggtggtgctctcataacaacataccaatttgaatcatcatcttccctagaatagaaaacatgttttgcttgagaaggtagaatgaatggatctttcaaataggctgtttggttcatatgaaggttaacaagggtgaaaccatcttcctccttcacaccattccctgtgttggcccaattgcatctgaacagcggcactttgaacatgtgatagtccataagtaaaatctcctttatcactccataatatgtaagcatatcagcgacttgtctcatatctcgagcacttgatctacacatgctaaatgcttcataagttactccactgttttgtgtcttccgcttaatagcatctatatgaaaccgttgcccattaacaataaatcctttatgtgctaaggcaacatttcttggtccaaatgccaaccaccttgtctccttagaatgatttgttgagtctgaattaatctgccacagtaaattcagaacttgatcatgaagctgaagtactaaaatatcatgaagctaagcaataagctaaccagtcattaagcaaaacatgatcatgaagctaacaatctgtgccacacggaaaccagtcatcaagctaagcaataagctaataatctgtgctaaaactagtcatcaagcttcaagataagctaaccagtcatcaagcaaaacattatcatgaaactaacaatctgtgcctagaaaaagtgtcatcaagctaagcaataagctaaaccgtcattaaccaaaacatgatcatgaagctaacaatctgttccacaaaaaccagtcatcaagctaagcaataagctaacaatctgtgctaagaaaaccagtcatcaaacatcaagataagctaaccagtcatcaagcaaaacattagcatgaagctaacaagctaataagtcaatataatttaacaagttgtataacaaataatcaagaagacaagctgcatctggaaacctttattttaagccattgtgcaaactgctcagtatggtttttccataaaaatgttttattttttgcacatcgagcatcattagcttgtaattcttccaaatgcatcctaattttacattagataacagttctcagaaagaaattatactaaaaattagtagatcaaacataaagggtaacctcttactcgacataaggatccaaagatgccatgttcattagcacataacgatgtgcagtgtctctttctttatctgatagggtaacttctacacccttctaaagaggtcgaccttcaatcacgcttctatcagcctcaatatcttcattgcgattaactgtttcttgaactggtactgagtctttaaggaactctaaacaaaatacaacgcattctccagctaaatacccctcagccatacatgcttctggccttgcatgattcttaacaaacgcctttagtgttttcatgtacctatatctcagtcaagaaatgaatattagttgaaaatcattgcaggaaatacatatattgaaccaaatgagtacatcaaacctttcgaagggatacatccggcgaaagtgtactggtcctcccaaacgtgcctcttttgatagatgtattggaaggtggaacatgatatcaaaatgggatggagggaagaagcgctcaagttgacacattgtttccacaaactctgtctccattatcaaaagtttctccgggtcgatgatgcgctgacacaacctgttgaagtaactgcataatctatttatggcaatcctaggacccttatgtaacaagcctcttaatgcagccggtaacaaattctgtactaggacatgatgatcatgcgattttaaactacctatatttggaggattaactaaaacactattcgcaatattaccacaataaccatcaggacctctaaacttagataaccttttgtagaaaatagtcttctctttcttggataaccaataggctgctggaggtaagtatgttttctttcccctgacctctgtgtgcaagttatttctgattccaatatcttctaagtcttttcttgctttcaaaccatctttagacttagcactttgcatcaagatagacaatatagcatccgacacatttttttctacgtgcataacatcaatattatgacgaacaggcaaatcctaacaagagaaataagaaactgttaggcctattcagatccacaataacagaatatcattcaattacaaattttctttaccttctagtaaggtagttcaaagaatattgatctcttcttccaccgccatagatcatttgattcttcacactcttcttcttgaaccacctcatcatcttccacctcaattctttttcttttattttccttatctagaggttttccaaaatcatttctaaaagcttgtagtgtctcatatatttcagcgccagtttgtatcctattggcattcccttcctcaacagtgttatcaaaccaagcttttctatatctgtaacgatggccaggcggtagtctctttctattccccatatagacaaacttacggctaaacttaagccatctggaaggtgtatcttttttccacatacattgcaagcttgtttccccttcactttacatcgagacaatgttcctagggctggatagtcactaatactccatagcagcatggctctaagtgtgaaattctccttcgcaaatgagtcatatacttcaatacccacaaatcttttaaatcgtctatcagtggtgccaagtaaacatctatgttattaccaggagctgttggaccagggatcagcaaagacaacattatattctcagccttcatacacatagtcggagccgtgttatatttcaccaacaatactggccatgtgtgctgtgattggtgttttgcatggagaaagggttcaacccatctgttgaaattccaagtcgaagattccttggttcagcagcaaagtctggccatttatcattcacttgtgcccaagatatagaatcaacggggtgtctcattataccatcttcagtgccatttatatagtgccaacgtaaatcttcaaccatcttttttgatctaaacattctcctaaatctgtccttgattggaaaatatctaaggaccttggctggaatcccaacctttatctcattactgtgcttatccatttcccatcttgaaactttgcatcttggacagctatctaacttctcaaactccttcctatatagcatgcaatcattcttgcaagcatagatattttcatattcgaaaccaaatatcttcaggattcttttgattgcagctaaactcttcggaagtacattgtcttcaggtagcatgtcttgaattaaatccaacagctgatcaaagtagttcttcgacacaccacttttaaccttgaatctgtaaagtcccataattgctgaaacctttgtgtatttgatacaatcagagtacaatggagtttcaacttctcttaacttctgcctaaactcagtttcctctactgcttcatcgtcgtttccctgatcatcattcgtctgatttggttcaccttcacccatagagaatgctgtcttaaacaagtcaaatgcctctgtttcatattgaggaccaccgtcttctgtagatgctcttttttcaccatgagtactccaacaagaagtgttatacttcttatccataccccttatcactagatgctcaacaatttctttgatagactgatggcataaattgcgacaatctctacacgggcatagcatttcagacagattgcccaatcttcttgctgatgaattggcgaagtttgttgctccttctaagtactcaaaactattcctacgttgtaaatttgaaaagaacttagctagatttctttcaatcggttaataagctcagaaagaatttagtgtataccttggcagcgaaatccacatcttatccatttggttacgatggagatggatccgttctgaaattgctgaaccctaaaacatctgaatgaaccctaaagcgacttggagagattttggtaaaccctaaacacgagttgtgtgtgttctgattttttcgtttcaccgcgaaatcagacactaaagaatgaacggctcagatcaaaagaagtgaaacgaatcgaacgatgtagattgcaatctcggaggttagtcaccattggctaataacacgaacggctcagatcaaaactagagtgacagatcaacggtctacattaatcacgtctacaataagaaaggacggctgagatcaaagttggcgatacatatctaacggtgtggattgcaatctcggaggttagtcactattggctaataacaagaacggctcagatcaaagttagcgagacagatcaacggtctaggattcgtcccccaatctaggaggttacttttcattggcaaagaataatttttttgtttcaaatccaaaattagcatatacaatttttttattaatcaaaaaatataaattattttttaaataatttcaatataataatttcaatttttaaaatatatttcttataaatataaaattttaaaattaagaacaattaatataagatagtattccaactatctaagttatatgttcataaacactaaggcttagtttaaggtttagggtttaaactttgggatttatgttttgcactttaggatttagaagttttacttcaatgtttgagattaagatttttaactttaggatttaattagagttttcactttagggtatagggtaactttagggtttagggtaaatttggggtttaggcgttttaacattggggtttagtgttttaatttggggtttaaagttcaaatttggggtttaaagttcaacttttaattagtgttcaaatttggggtttagagtttaaatttggtgtttaaaaacacaatccaaaatattacacaatctggtttaccaataccataatattacacaatcttataatacaatatcggtttttggtacaaaaacacaaactgaacctattacacagtctaagtttcacacgaactttattttatcatttggccatgctacaactgaacctattgcatcagaaatgtattcgatctctggatttggcctccagaccattgcattaccaatcttagccacttcaacccagactttgcttgcattaggacctaggggtacattatggcaagcatcgttcgggtctgttgaaagtactcttccttcagctaccttatgtccagaattgctgcaatctaaaagaaaacacttctgctttggactttttgtggaactgttgctgcctgaactctacaactcaaagccaataataaaagcaagttccaacatcaatgaaagttccaacatcaaccagcagacaaacaaatgaattaacaaggttacaataacaaacctggactttaggtagtgctgcatctgtagtggtggcagccgtgacgtcaatctttaggactggccatgcgattttctcgttaattgcatcacccattaaacaaatatcagtagttggcctccacaaatgagcattaccattgaacaccttcacaacttgaatactaacagcacttggttctagaggtatattgttaaccttctctttggagttagatgagcacacaacaccttcagcaataacctcatcgtcttcattagtccaatcatatattttgaatcttcgagtttcaccttccttggtttgctaaaatgtaagaagctaatgattagagatatatcatggacccttatacaaaagcactttaagaagcggttggacccttatacaaatgtaagaagctaatgattgggaaacttgaccatggatacatcttcagaagcggctggacccttatacaaaagcactttgtctattggccaaggtattttgcatcccacagcttcttcaagatataacacatctgttgtaggcctccacagagaagcttctaagcttagtgcagacttaacaaggacaaccattgcattaggaccaattggtatacgaccaattttgtacatcggttcagcagaacacaattctccttcacctacaactacatctcctgaatgaatccaatctaatatttgtactctaactccttctttgaatccaccaaaactctcagatgtttcagtatcattgtaacttttctgagataaggaacaagaattattaaaaccaatccaattaaccattccagatgtttcagtatcatcattccctttaactgagataaggaacaaggacagtttaccttttttccagctaagtctcggaccattccctttaactcctgaatctcactttgcatttctgccatctttgcgtctctagcttgcagaaatgctaacttagtagccgtaatccctctaccaaacccccttactcgtccaggtttgtcttttcccaaaatcttgctcacagcatcttcccttatgttttcacaagctgatgtagagtccatttgactatcaagtgaatgtatttgttcctgatcatacaaacatttaaaccaaaaaaaactaatttatcataatccattacttatacacaggccataacaagttccagaattctcaccatagtctcagcaaattgaggcttcacaggtctaccatcagcatgagtgtgtcccgcaatccataccttactcctagtcaccttacttgggtctgtactctttttttttctatataaagtacatatatatcttagtaccaatttgttctaacaagaatacaatatatatagatatttgacaactattattaccatatcatgagctaaacaaagcattcctttacggctggtggtgtgaggaatctgattttgtctcatcttcctgtatttgttacttatttcctacatgataaatatcaacacattaaatctatcagccatgacatataaacaagaaagttgttagttgtagataactaaccgtgaaagctgcgttagtcttgctcctaacccaagagttccacacttgaatggatgggatgttgctgggttttaaatctattctctcagcaatagtcttcgcagcacgtacttctgaaactagccttgacttccaagccctccagatatttccaatttgcttaaaaataacaactctctaccattcttcttgcaagttaaacctcccctacatcacatacaacaatcaaaagtcacacctgtttcatttatgttcaaccaaattttttttccatataaatatatacatgaatttcttcccacattgcttgtttagccactgcatcaattttcctccaatcagctagtgtaaccggaacgtgttccctcacaaggacacaaagaaaagatgataatgttattgaaccaggtccaacatgatcaccaaagtcagtgaaagtaactgaaaccttttcattaggattttcatccactttacgcatctttgttggtcctctcttctttctttctttcactctttcctccgctactttacttccttcaccatcttcttccatattggcagcttcttccatattggcagcttcttccatattggcagcttcttccatattggcagcttcttcattctcctgctgttcttgtccagtcaaacaagcttctccttctatctcagaatcttctttctcatcttcagacatttgctttctcagtctgatcagcctccggtactgttacatctttgtcattacccttctcttcttccacaacatccggtgtaacatcttctacctcatcatcttgcggtgtcacatcttctacctcatcatctacaggtgtaacatcttctacctcatcatctcgagcagccattttcttgcttcttcttgtagccactttctttgcttttcttttcttattcacctttaatgttgttgcaggagcaacttgtggtgttatatcttctacctccaagccttggttacgtctactacgacgagaaccaactttacctccacctcttgtcttcaccatttctgaaactgataaatgaagaacagtttcaaccgaaacccaaaaatcataatcgaaacccaaaaaaacataatccaaacaagacatgcatgttctccgaaactaagaatcaaaactaacaaatcaaaattgatacccaaaatcacaaacttccgcatccatgttcacacaagccaagaatcggaaccacaaatcaaaattgttttccattccaaagaacaaagaagctatgattgaatgagaacatacctattgaagattgtagggagattgtgataaatcgagttgagagactgagaaatcgaattcagagactgataaatcgagtgaaataaagtgcgaattagatggagagacagagaaagcgagtgagattgagagaaatcgagtgagagttgcagattttgtgctcaataactcaagaaattcgaatgatacctcaagagagaaaatgagagatcgagaatgaaaagttgattttttagatccaacaaaaatgagaaagttattttttaggattttgtttattttgccttagccaaaatttcactttttcctcatacaattttcaatagcgggatactaaagattagaaccacaaaattgccccgcgtcaatttcattatcccgctttaataatttatagcgtttacaatatacaaaacgctatctttaaaacacgattaagtcaattatagcacatagataaaaaaaaacgctatcttattatgctatcaatacccacatttcctgtagtggtcattactcgcaatttgtacaagaaaacctgattgatttcataagtataaatattacacaacatgttaccaaacatttataagtttcatggccagggcctagtgccaaaagcacgatacatattagaaacatacttgttttacaaaaggcacaaaactactgggtttcctaatgtccaccacgccctctatttcccactacgggtttcctgcaaaacaagtagaatcatgagtaatctaagattactcagtgagcttgggattccctgcaacagacatttgtttaccccaacccaaatacccaacatgaaacacgcaacatagaatggcaacgaaaggtagcttgtcgaagcaactacataaatatgcaatgcattaagactccagttttattaaatcttttaaatagggccggatatgctgccaaacccaacaccaaacacacactcccgtgatctcccgcattacaaccacaaaggtatgcaatcggagcatcactaccaaacgctacaccgtcgtgtagacactcggccaaggtaacaacgttacaagaccccaaaaatagcacggttcactacgaaggccagacttatcacgatcttggcacgcttatagtctttgcctcctaccacaagcaccacgtaccaagaccccaaattttaagatattatgaaacatatgattaaatcaacacatagaatcatcaatatctcagcacaacctctcaaccataagcaatagcataagaatctaaagatcacatatgcaatcgaatataaccattcaaacaattcatataactcatgaaatcaatcaagaatgcatgaggatatgattatgaaacttaaacaattatccagaactcactcagtaaccaacggaaagcttctaatgattcaggcagagttctcggctatgggaccctaacttggatcgaacagacgggttaaactcggcagcctctcactcccacctcaatttctcttcacaaatcaaatgtggtcgagttgggcttttataggcaagggattggcgagtcagcatgtccacgtgtcatgagtatgggcgagtcaccaatccacgtgtcatctacccgcgatgacacgttcgctactcaagcggatgagtgacacgtggccacctaaatttcggctccaagctactaatattcgattccaaacaacttttcttgggccccaagttagccgagccacgcatccttggcgcggtcaacagtcggtcaacgcttggcaaggcaaactttcgcccgtggcacgcccgttcttgcccaaacttgcccatttgtgcccattcttgcccaaacttgccctttgatattctatggtgttttgggcacctaaggtcaattggccatgcattcgggcaactttcgaaaattcggactcttgcccgtggtcgatgtccttacgcgggtcactacactatccgtttgagattatgtgtgatgcatcagattacacagtaggaactgtactaggccagataatagagaagaagctt

SEQ ID NO: 201 - DNA, 80450 bp, Arabidopsis thaliana
aagcttctcccatttgtttgtagaattggtaccaccgatatctggtgagccgccgccacaatcgataagaggaatcgtggaagggggagagagagagagaaagagagagagagaaagagagaaagagagaaagagagaaagagagagagaaagaaagagagagaaagagagagagagaaagagatttcctttatttctaattacgtttagttgaattgagggtaaaaaagtccaaaaaaaaagaattagtgtaaaaaagtgtctattccctagaaagtgcttcaaacagaataatattttctaaaagtgcctaatcctgtcacattccctaaaaaaaatagcaaaataagaaaagtaaactgaaagtagtgtttgatacattaacataattttttatatttgttttcttttaagtgaagatatttagttaaaagtggaattaatgaatgattcaaaacttttaatttttatcactaagttttgttactttttaatgatattaatttaggatgacatgtggtactcacttgtgtgatgatttatcactcatatggagagagctggccaactttcatatatatgatttatttttcccaccttttcggatttgaatgccactggggacagtgtcgtttaagtctgagggaggttcttactaacattgcctttatttttgagttttattattttcgttttttagtttatttagtcaggtttctaacagaaaaaaaaaaatattttctttagtttagttaggaatcatgatctatatttctcttgatgattccttgattgatgaatgttgcatgtttgactcaatccgactattggaaaatctagatggtaaaccaacagaattcaggatatcctggtttccaacacaatccactaaggatggagctaatctcactgttcttccttttacctcttcaaacggttagtattcatagatcttgactccttgttcatacctgatattgagaccaatgtgataaaaagaatgtgttcctctccccttataaaaataaaaagaaaatgagagattgacaggattttcagatagtgtataggggtaggaatatttcctatgaccccagtattatacattatttagaatgatcaattacaaaggttggaaaaatgccgagggtgtcgatccagtatgcgagttcccctttgtttactctctaaaaagaataagtatgggggagagaaagaacaccaaagaaaaacaaatataaagaatggtcgatttatcaaggtatagtacgggaaagagtctagaaggatcttgaatgttagcttgtttgatgagacccagcgatgaaagcctggtagatatagttgtggaacttaggtatggaatccagaatattgtgtaagcttgcagagaagtacatgttggttaggatttgattagaattgctagacatatggatttggttagaatgatcatggcaatagactagagaatgttgggagttcctttgttttcaaacctcttccacgggttcggcttttgtgttttgcttgagggcaagcaaaagctaagtctaggggagttgatataaccctatttttatcggctttagctatgatttaggtataggtcttagagtccttttgttatttctagagtcttttctagtctttttcaggtctttacatgtttgggattcatttggagataatgaagcattctagagaaaaatagagaatttatgcagttgaagaaatctggagacgaaaatgcacataggtgtcgaacgacaccacccttggtgtcgagcgacaccaatacctgacggcattttcaagacgcaacttattgatgttttgaagatttctaaattcggcccagaactttctcctatgtttaatgaaggcccatcacgtgttttagacatataattaggtttttaagatcattgtttagacctaagcttggagaggctattctctatctcttttgtactttgggagcaaaaccatgtggaaacttcctttggatctttcttactctattctcttcttgttttattcattgatttctattctaatcatgttgtttacttcattcatcatgcttgagtaatcttcttgttaggtttagggtttctcattagggatttagatgatttagtagatcgcccccttgctatgttatctgttaggattcttcatctttaattgttcttaatgctagatctagattgatcatctagaacttgaatccagacaatagatatgcccgccataggtatctgtatttggctctattacttgatgagcctggtttataggtgtgtaataagaattggcctatctactaaggtgaacaatcgaactcgtttagaatgcatgtttaggttaataatctctcggcttctccggtcattcttagctatacacatagagagtttcgcggaacgccaccttttattccataattagagtttgagtttaagaacggttcgttaacaacctagctatcactagatctactaatcatctatctcctgagaataccctaaacctgactcttttcccatctgatttacattttgatatttattgcttttctttgtttcttatataatctattggtctagcttgtttgaaaacatcataagtctattgtgtgaacatcgagagctcagtggaatttgacccttaagtgctaacgacgatctcttatttgagggagtaagcttaaggcaatttgagctatatcattagtttgtaaaccggcgatgttgtgtggagcaaaaaaccaattccggacttctagaacttatgattcccttctctgtcttttagccacgcagtgttgagtatcttctgtggcataggcctggcgcatgttgcaacacaccaagggacttccatagttagacgttgaagaagaggcttcagttttcctctttttggcgcattttggtgttcatcttcagtgctctcttccggatgttgctgattcattggaccatgaacttggtcagggttgtctccaggaacatcgggatggtcttcatttgcgtcattatcatcatcatcatcatcatcgtccgcatgaggaccttggttcccggaagttggacattcggaggcatcatgactcagcattccacaagtggtacaaaaattcttgagtttctcgtattgaaacttcagaacactgacttttctccgaatcggaaaattctctgaaagcgtagtggatcatcaatattacacagaattttgaccatgacatagtccgtgaggaccacaccatcgcgacccaaatttgtctcaaggaacagacccattctttcaccaattgaagtaataatccttgcagtgaggaagcggaggggtattcctctgatttggatccagaatgggattctcttgaattctgcatccgagtgcaatttcgtccatctttggatgacgcacatccaatcattaaacgaccatggccctcgacggagtattgagaacatggattcttcagattggaaaaggaattcgattttgtgaatctccaggattctgcctaccacctcttcatctacgctccaaaggcgaggcaaagcactcagcattgctcggagattctacttcttagggcaccggttttgtaatgaggctaaattgggtttcctgagcgcctcatcacatagttcaataaggagattgatagcttcctcttgtactcctagcgcaatttcttgcatctgtctttggagattatccgccattatcaatatgaacaaaggaaattgtgaacattcactcttatcaaccaatcgagaacagagacaatcgcaaggtataaataggttgggttgcgagtccgttattggatcttcaaccgttttaccgttattcacccctgaagaaaccactggtaaccggcaagaacactttcggagaccgagagacagcagttaaaggcgaagagatacaaccgttcgtatcatcgcttttctctcatttcgtttttacacattttaaattctcgatattaaaacttttatgaagtttcaaatattataatatttaaactttataaaaatgattcgatgatatttaatatcatatgacgaggttagatggtgggacgggttgggatccatattaatatgagacagtatattaccggtgaaatcataaaactaacaatctgtataaaattggcaataaaaataaaattctacaatcttaaacactaaacaaaacaaacaatattaacaaaacaaatacaaattaaagttttaatttttaattagaaaatatcgtcatgcagaacctttaaatttcaacctaatttcaacccactctaatgtaaaaccttttcttctatacataaaatattatataaaaaaccctgtttcttcctctaattccactcttctctctcgacagatgtaatgatttacgtaattcttcggtctagaatttaaatttgtttgatttttgctctcttaaacctaagactcgttgaggattcatgaatgttgaagtaaaaggagacgactttacttgaaattggaaatctttgcagattgttgtggtgagtaggaatctaaaggctacccactttgttttctcgacgcatcaaaattgaatgtattttttggattcaattattgatttcggtaatatttaccaattgatttggattttgcattagagcttgaaaatccagaaatccaagagaagttatacaagtagattaaaagcgtattgaaagaataagagaggaaaaagattccaatttcagtttcaagaacacatgaaacccagaagctacttatgatcttctaatccaaattgagaactcatcgcttaatccgccattgtcggcttgatagtttgtgttgattcttttcttgtttttgtaatttgattcccgattgattttagatgagaaattgagcaaactaatagataatgcaataaaacaagttttatgatagagatattgatttgggatagttagattattgtatttgcagcgatgcaattgaattcaataacaacacagtaattaatggcgttttcaaaaacaaagatatgattaaggcagtggaggttgttaacggttcttcaattttctttcagaaaaatggaatttgaaaacaaaggataaagaagagacgaaaaaggggatgcaattctaacaaaaaaaaaggggacacaattttttttcttttctttttaacgtctgttattaattttttgttttaataatactcttttaaatcaaaagaaagtttgatacaagtggtttggtatcgctttgattggtttctatcgaattgaatttataaaccgatttaacccaaatttatggggaaatagatgaaaactatagattcgggaagacatatgttgaaaactattattttatggacattaggaccaaagttaaagtttgggctctatctattatgatgtgatagttttcggggggaaatagaccgtttttcggaaaatgggtaatactagtacaacatgaaatactatgtcttgtctacgtgaaagtatttatttgtaagtgatagagataaaaaattatttgtttgagtatttgtattgtgattttttattttttttcatcaactgcattttatcacacttttaagttaataaattaattttgacttgtacactattaatattggacaatttttactgttataatactacatagattcatgaataatcactatgaatgcctttcaacactaccctttttcaatagggaatgtgacacgtttaggcacttttagataattttattcctttagaggcatttatgagggagaggacactttttccattatttgacttctattaagacatttttacccctaatttaaccaacaacttttattttaaatttaatacaaattaaatactttatctctcttccacgatccttacgcaaaataaaagaaatctctctctctctctctctctctctctctctctgctctctctctctctctctctctctctctctctctctctctctctctctttctctctccacgtctctataacttctaggtttgattcctcttatcgattatggcggcggctcaccaaaaataggtggtaccgattctgcaaataaatgggagaagtttcttaaacaattcgatctcgattatctcaggaatttggtaaaatttctatgtccataagggaggtgaaggtctctgcaaactgtataaaaaaatttacaaacaattttttggtgtccataataacgagtccatttaaatatatccattcggaaacctttttactgattcatatccaatctatataccatgtccataataacaagagattcgattaaccgtggtttgtatagaaaccaaagttccatgtccataaggtcttgaaggtggaggtcttgtaaactgaaagaaaaatcaacaaacaattttttggtatccatattaaccagtccatttaaatatatccattcagaaacctttctactgatccgtatccattctatataccatgtcaataataacaggagattcgattaaccgtgttttgtaaagaaaccaaagttccatgtccataaggttttgaaggtggaggtctctgcaaactgaaagaaaaatcaacaaacaattttttggtgtccataataacgaatccatttaaatatatccattcggaaacctttttactgatctatatctattctatatagcatgtccatgataacaggatattcgattaactaaaatctcgatgttacgtagatgaaacgagtttgacatatgagagaaagcaaaaatcaaatgaagccgccgttgttgaagaagaagaagtttcttctcatattttacggagagagagagagagagagagagagagagagagagagagagagagagagagagagagagagagagagagagagagagagagagagaacgtgggttaagagaatattttagttaagaaggtattttagtaaaaaaaaacatagaaaaagtatctagtcttttgaaagtgcctaaacacggaaatagtttttaaaaagtgtctaagagtgtaatattctcttttcaataatgtcctttcttatttgcgatcttcatttatgccatctcttaatttttaacgatcattttacctctatttataaaatgttttaggttaacaaaatgaaatattgactttttccccctatattcagaaaataaatttcccaccaaaaacaatttcgcgccaaaactttttttccaaaaacattgttcccgcaaaaaacaattttggcaagaaatagatttttaaaatgtttaaaagggttttaaaagattcaaaagagattttaaaagacttttaaaggttttaataagatttacaaggaattttaaaagagttttaaagaatttacaaagagatttaaaattcttaaaaactcttataaatattcttaaaaccttttatagaggttacaagagttttaaaatggttcaaaaatcattaatgggtttacaagggttttaaaagatttttaaatagtttacaaggattttaaaggatttataaaagatttacaagggtttttaaaatccttgtaaatcctttaaaaactcttgtaaattttttaaaatcattgtaaaaggttttaaaataatttataaaagttttaaaacgagtttttaaagtatttacatataattaaagactttataaagattttaagagattttaaaatgatttacaagggtttttaacaactttacaaaggttttaaaaaactttacaaggtttttaaaagagttttagaaaaatttacaaggatttctaaatgcatgtgttttagctgggaaaacttttgggaggaaaaaaaactggccgaaagttttttttttgatcgggaaaaaaacattttggcggaaaatttcagtttctaattacatgttctcattagatgagtgtaatttggtcattttgcttaaacgaagaggtatttataaaaatggataacaaaattaggtattattgcaaaagggtagtaaaaaaaggataattttgcaaatcttcctagattcatggttgataactctatagaatgatattaaaaaattaaaaaattttgaattctaaactcacagatgcagtttttacagtaaattattattttatcaaatttttaagtgctagtaatagcttttatacatgtagaattgggctactgattgaaaatccactaaaaagcacaaatagaatttttggttacaaattaaaaagacctctctctcttaacccactcttattttccagagagagaaggagatttccggttaaccagaaataaattccggcgacagcttgttttttgttttatacatagtttccgacgtttgacggatctctctttccaattagtcggattttaataattttttgcttagcttggttcgttttccggctaagatcggattatgttttttgtttttctctcctctttctacatgatttcagtgtaaatcccgcttgctgtcaattggtttatttcatgttcatctgttggcttgaatcttctccaaagttagagaaatatcttcgccgtaatatcttcatcgttatgcgaagtggacctttctttaggtcttgggcggagattcttcctttgaagttggggttgagatgaagatctacactatctcctattattcaaggtggaaacaacagatccaatttgatatgcggcggtaatatctttaggaggatgtctccaagagcgtgaattgaagctttcacctggtggttacgaccgtcgtcggacgtgacagcaaattgaagatttggcggtgagcaaccaaaggtgttccggcggttttctcgcttgtgccacatgaatccattaggttttagcatcaaacacgtgtctcttacgtatcttctttgtgtaattgagtttattttaaaattaggcttcaaaagactttgtatcacgtatcttgtaatctgtcctttatgagtttcgtttttttttaaacgatttatttcattagttgaatcaagtgtgattacaatgtaaagcagataaaatgaaatatggaacaaaataatgatattggaatgagttgtcatttgttattctgtgttataaaacgaaaattgccgacaaaaaaaaagaattttcggttacgaaaatataaaatcttatagatatagaaaatgtaaaaggtcttttgtaagaataatacttttctactaaaatattaagaatatagcatattatatatatcaattatgtaaataacatcaaaggtatgaaaaatgactaatggtggtggtggttattccggtgatggtagtttcagcacgattccggtgaagattccaacggcacaagttcaggcgatattccgaccatagattttcatcgatgatattccaacgatatagatatcagcgatggtggttgcgaagattacggtggtgattccagtgatagtggtggtgactttgtgatggtgatggtgatgacgtggggatgatggtggtgccgttgtggttgtgatggtgatggtggtacagtggtgatatgatatccatgataaatagtaacagtgtggtggttttagtagtgagaacgtggtggttacgatggtggcggtgatgacgttgtgatggtagtggtgactgtggtggtgatgacatagagatgatcacgttgtaataccggcgtcggtgatagaggtgactataacgtcggcgagttaattggtttggcttaggatcaattatttccaaaataccgaaaatacacattatatcattaaaccatttttttggttagttacataatataatatttttatatgttatttatgcaaatttcccaaatgtaaatcacttgggcacgtgtcaagagaaagcgcgtaatcatcacgtaatcaagcgaaagggttttgcttacaaaatcctgagccgtctttcaaagcccaataactggcccaaacattctcagtaatatttcgacctaaatccttatttagacgcatctttattcgataaaagataataacaaaacttatctctttgccttgtctgctttttcatccaaaggtccaattagcttcttaagcccaaatctctctctctttctctctttctcttcctctctcaatctactcgccggagatcggctcgattcctccgtcaccaccgcatccgaccggagatttccttccgttttctttacttcacaacgcagagcttcaatttctccctcgcaggtattcttcgcgaaaccctaaactctcactaatttcccctggatctaattggggatttttgagttttgcctcgattgtttgttaaattgttagcttttgtttgttaagtttaaatgttttggtttcactcatggaggcaaatcaattttgaaaaaaacttgaaattgttgtttgtgtttgtgtttgtgtgatataaagaaaaaagcccgatctttttttttgtttgattaaattctgtgttttgtttgaatcagtttcgttgtgttgaaaactttgtaatctgggctctagttttctcaagagacatggaataatcacaatgtcaacgaatcagttggctaagcgatttcggttaggttagtttccggttaacaaaaactaatccgacccgattaagtcactcctaggccttacccgacccggctcatcgattagtcacacgaagcttgactttaccatttctttcgagtttctctgttgagtatcgagaatcgagaaaagaactttgctcaatctttgtttctcgtttggtaatcttcgtttctaagaattggaatggtctttttcataggattcatgatagtttttggctgcaattttgtatctttcttctgattatgtgaggaatttgattttgttgtcgttgtcgttgtttcgtcttagggatttgcgagaatcattgaacaatttttcaactttgacaattaatagcacgaaatgagcttcagatttatgtgtttgagtattcaaagatatagcttttatatttgcctttgtgggtttcatggagctgaatctgtatacttatagctcattagtaaagtctgttgttgttttcccatcatttgcttctggtttgacattgtgttgagtagtaagattagagctttcttgctttacatgaagcatttcatttgtggaaagtgcttcaatccatttgggtttctctctgatttggaagatatgtctggtgaaaactttatctgggtattgcttcttttcagtgattgatcaaagatgggaagtcagaagaatgtgaaacacctcgaggaatgcactgtttccaagttagtgtctttgtttgctaatcattagagagagtaaggaacatatattcagtctttgtttcttaactgtgatattgaaatttgtgacttaggaatcatacaaagttttatcagcgagtcattagttattagccactgttacttgttttcacttgttacagttctcaccattatacttaatcactattcactacattgcttttgaattggaaaaagaagtaaccttagcatctaacgggtgtattggtgtctagtatcttatggtgtataacagtgtggttgttgttctaagttgaagcattctaaagtgtagaaaatttcaaattcttctggtgtataaagtgagcgtttcttaactgtgatctaggaatcatatttttgtcattgagtcatcagttacatagcccactcttagtcgttttcacttggtcatgccaccatgcttaaccactacattgctttgatttgctaaaagatgtaaccttagcatccaacattggtatctagtatcttctaatgtaaaaacacagtgtgattatcgttctcgaagttggaacatcctaaagtctaaatatatctatcttttttgggtgcagtgcattgggaacttgggtattctcagtcctaggcgcattggttgcaatcccggtaggcatcaaacgcaagtctctaggtccacttgtgttcttcggcacaaccggaacaatgctcgacattatcattggtgtgagtcaatgcgagagagaacacgcagaacaccaaacgaagttactccaagactctcaaaatgccacaacaacaacaacaaccaccaacacagagactgaggatagctcttccatgtcctaatcttttttacatctttctcattgatgtactttgatgctactcacaagttaaacttttttcaagatattgtgattattccacttctcttgagaaaacaaagaaaaaagcttttgatgattaaaaactgattcgttgacattgtcattagttaattagatgctaaaatgttaaccaactagattataatctgcggtacaccgattgttgtagtacatcaagggctattacgtaattacctacaaaataattgtagccgttgttacatattgtaaattgctactgtctctaattaacaaaatgccaactgaataaacaaaaaatacaaataaatgttaccataaaaccaacaccaagggggaacaaaataaaaacttaaaactaattaaccgtgaaaatttaccaggagttggcttaacttgttgagagctacttcctagcatcaatgcacagacgaatgattcaacatcggtcttaaatttttccaagtcattttccccgttgtaaaactccttaaaataagaaaataacaagaaatattaatttagatcaacttactgttatagaatttaacgaaattgctttagctatatatactaaccgatgcctgcgaatttgttgtcccaggtaaattcattcacggcttggctccaatcttttttgcttataacataatttaagtaattttttcccccttttgctttgtataaccaagtcgcagcccacaaaagttcatcctatttttacccccaaaatatttgaaaacataaagtatcttgttaagtaactcatttacgtaaacatgaaaatatatctatgtgtatcagtttcattatctggtagcctgagtgtgagcagtagaaggggcaagatgcttggtaagaacctctgtacttatcagcaaattcaaatagctgccacaaatatctacacgttaccttatgattaaattgatgtaatgaaattttatggacttaacatgaatatatactcacgaatttagaatggtttagtaacgtggatgaataagtagaatccaccggtttgaaaacaagtgaggccgcggcaagagcggttgcggcttcagcagagacttcggaaccaggggaagaagaagatatattgtagagagttctaggtgtgtccatatcttttcgcctttcccaaccactatgatctgaatttccatctcccaacttttttataaaaaaaaacagtgaatttgttgaatattatagagatagtacataaaatacgagatatatactatttgggatatttaacataaaatgaaatattttggaatatttctctatacaaaagttggtttacctgtgtatatagcatgttgggcgaagtatgagcgcggaagataaaattgcttccccatttgatagtagaccggaggtgatgcggacatccaaatcaaaccaaaccgggagcataccaaaccagacggtacatttatcaaactgactaatgaggagcattttggaggactcttgcccaattggagtctcaatcaagcacaaggcctagggttaattattcaccagcaaattaatcctaagaagacaaatgaaggttcaagtggagtcaaagaccaaggagccgagtcaccttattatgggaatatgagtgttgcacttttttcccttatttagggtttgtcccaatgggtttacatagaaaggtttttaacgaggcaacatcaagtcatcaaagaatcatttacctagcaaatgattcaaagatatcaaaagtacatatagttgatgtacttgctgacagaccgactgaactacccgctgcactaccttctgaaataccacacgaaatgaagccaaacaatgaaatcttccttattctacacttggacgcacctcaaagctacatatgaaaaccaggagaacatctacaccaaacaagacatgtactatacgaactttggtacatcttaccacacaagaacccgcagagttactacttgccatatatggagtcgaaggagatcgatttccaacaactctttccatctttgtttgtgcgcttatgtgaaaatcttgagacactccagaaccttccaatacgtcacaacttcctccccaagttgacaagatacacgacacacctcacttcccttatttggacatattctacaattaatgtccaatattttctttaatgttttgtttctttctttgaagtcttagaacattgtactcagctctatataagttgaattctcattcattgtaaaggacccttgatcattttaaagtaacaaaaacgttttctacttgtgaaagtttgagtctttgtcattgttttgtagttttttgtgagtgagtcactaagtacttcaagattctgcggattaagtttgttgagtgattcaacatccttcatttgtttattgatcgagtgagtcgattaccccactgattgagcgagtcaatcacccttctatccatcaattctccttggatcgatcccacacgagaaaagcgatcgacaacgtgtcagatcaccaccttcatcatcccaccttccgtgtggcaagtttgaaactcttgatcatcaagtgatcaaaggatggattagctccaattcttgcatcatcttggtatcagagcttcaaaagctcatatccccaaggttgtatctcttcaacctatatcttttgatttttttaattttgttatttcatttttagaaatttaaaaaccaaataaaaattttatgttttgcttttggtattgtttatttgcttcagcatctttattataaaaagaaataaaaataatttgctttagtttattatttattttggattaaaaaaacaaaaaaaaactcataaaaccattatttgttgctttaattgattttttaaacttttacttttataaaaccagaaaagaaaaataaaaaaaaatcgttttctcttttgatattttagattctcgaattttattttttgtttttgcattgattttagaaaataaaaagaaaaataaaaagtttccatattttattttctttaccataatttattgatttacttttgatacatctttctcttgtttgtgcaaggaattccccgaaaacaaaggagcaaggatgacgtcatactatgtggaagaggaagaaaccaacctggagatgtgtctcaatgataattatgaagaatggtggcatgaagagtattctgaatcatagtttgaggatgaattaggccgtgaagtaccagaaccagaaccgcatgactcatacaacaccaataatggctattctaaaccatggattaaatttaatgatgatatttgcagccatggttcgaaatctccattgactcgagatatttctttcttaggaaaagagaattatgctaagcagggagaagtcttggagtataaaggggcaacgatgaaagaatacaattgccaacgtcttccaaggcatgaagagaagctcgacaatcacaccttgttatatcgagggcctaaagcctcacgtcaagcaaaaccgagacacaagttctttcacacaaatccccgagtagtacaggaagtgcttcaagaagtgacgcagagaacatcaatgtggggtaaaccatatccccgtgatagacgtgattacctagctgagagagattcaaggatcagtaatctaaggggaggcgagctgagtaaaaattttgatccacatggaacgaaatgacactgcagttgaagcgtgactatagatactaaaaactttattttaatttatgataactgtttgtacttaaaaacatggtttgacaaagacatgtcaatggaaattaatctcgggtaaatcctttagcatggagtttgtgaacattaattgtcgaatacatccaaccaaagtggtgtagttgtatacaccctgttgaaacgttttatccgcgttttctcataaccttttatttgtttgaagcttttacttaaagttgttcattaatcttatcgttttctctatgtgcaactgtcgatgggagtgcatttatggctcaagatttgtgcattctaaacacagcagggccaaagaagcggcaggccgtggctctccgtattagcgctgatgcgacggtcgtttatcgttgcagaatcaatgcctatcaagacaccctttgttgctctgtttcgtgaagttataagattaatatgttttttaaaaattttaagtgtcataagttactgtttgattataaaaatatcgtgatgtggcatagcatattggaatatacagctctattaaaaccatatattgaataacactttggttttagtccatcgttctacacaacttagggcattacagtagaagaacatatttttataaaaaggttttaagtttcctatgtttttaaaaaaacaattataggccttttttatgtatttatatttgttaagcttttcattcactatttttctttaacctttttaaagttaataaaatgttttgttaatgaacttagtttagtaaaagtttagacttaagaaaaataaatcttaaactctaagactttgattacaaaataaaaaataaggactttctagtgtaaggtgcttaaactttgattacaaaataaaaatttttgttttgattaatcaaataaatgagttagttttgctatccattaagacaactatgtttgaaaaattcgattatgtgaatttgatgaatggttttgcaggcaaaaatctaaatagatgtatatttaaagaatgtaattttgatttttcctccatttttgcttacaaaatgcttataatttttttaaaaaaactgttttataaagttttagtagaacttttgtatattattattatttgtgattatataaaaacaataaagggcataaatgttttatttgcgtacaaaattcctacatggcgggccggtcctggttcttctagtcatctcttgactcttttttttccgtcgtctcttgactcttatcatcctccatttcttgaaattaatgagatcacgtgtgacagtttaatttgtatgattgatttatttatgatcagtctcttagttgcagacttgcagtgatatgtgtgcaatgtgtgactcaacattccatgatacaataatgtggttttaaaagagggctaacatcttttgaaagaacgtgttttttcctcgtaaaatatagtatatatactaaaaaccttaaattatcttaatatatgacaactgtttgtatctttagaaacgtggtttgtcaaagacatgtcaaaagaaattaaactcgggtaaatcctttggcatgcagttggtgaacattaattatcgaatacatccaaccaaagtggtgtagttgtatatttgtactaggttatgaacccacgcgacgcatgggtctatttgtaaaacttttaataattttttgtgtgactaaaattctttattgaaaattttgaaagatatgtttttatatgtctacttgttgttaatattataaactctttgatttttaaaattaccatgacaaatagttacaatttaaatatataactaaaaataactttaatacaacttttaggtttacaacatttatcaaaagaacattcttttggttcataactatctctttatctttagatattttggataacgatgttctttacgtataaaataaattcttgtatggaaaataactacgacgactttcttattttggtacccgcaaatagggatggcagacgggcgtgtccgcggccgtttggaccgcctgcgatgtacccgcttttcttctgatccgcgacggacctgcccgccgacgaccgcgggttacaaaactcagtcctaacccgccccgcaaagcccaacggtttgtttattctcttgtgtagtaatattcagaagtgagctatagctgctaaatggtcttgagtttgtttattctcttgtttcacatcagagaatttaggatctttgaattttggtttatgtaacatttcatagcttgataattaatatatcagtcttagttatgtttatgtctgtgtgtatattttctggagtttatccacaagacccttgtttcaatttcctttagtgatttcgttttacatttaaaaagtttgacttattcccattgcaatcaattttcatgatgcgtaattctctacatttgtatcattatttactaactcctgttttgaaccaagatcacaaaatagaaaaacgttctctgttcacaaatcacaatcaaaagattgtgagctctgttttcttactctcttctgtggaaataacaattttccaacacaaactaagtgatcttcgatccaagaagtataaaaagtaactaagcagaagcattaactaaagtacttaactgaaacattaaattaaagtcataaactgaaaacatgaatctcaaactcaagatgtctcttcatcaatatcaagctttatcgtcaacatgaattaagagaaaggtgttttgagttctgagtctttgacatgagacatatttccattcatctgttgggttaactataacaaacccaaaattctcaatctctctgcttattccttctgaattttacagcctcaacagctcgcttaggagcgatcactgattcatagtaaaatcttagtttttttccaacttcgattgaacaaactacaaaaactaaaagaacaaaggagaattcgagaagaatagaagcaacaaaggaaattttacttcaggattcgagaaaaattgaagcagaacggattgaacgaaggagatgcaaaggttttttttttgtttgtctaattttttacgggtcgcccgcaaacccgcggcccttaatgggcatgtattgtttactccgcagtccaaacggaccctacccgctaggcccgctttttattggacttcactacatataggtccgtacccgccccgctatgtcactaaacggactagacccgcggacttaaggtccgattgacatccctacccgcaaatatagtattgtttttccgtttatcttcgctgtattagttagtatagctcttctaaaaataagatattatatagaaatatattcataagtttatctacatttaacaactcatatttttctcacattcttttcaatatgtatatgaatttctgtcttcacaatattttagtgagagttatcactcttcctatctttttgcaagcactcgttttatttgtttcattttttcttacaatgtctctttccatcctcttatgatttgtccaagcaatatgtgccataccttctaaacttttcacatgctccataattgttcttcgaaaatctcttccttttcttgttattatgattatttttcaagctggtcaagatgtgctctattttgttttctgttattcaaagaaaatgttttagcttctaaattgatacttaactctattacttctctctttttatgcagtttagatcctcttccccttcacgcttcctagagtgaaagacctcaatttatatcttcgagaatttgattcaaattgatacgattaaaaacaccactatcaaaccacgtctttgttacgtttctttaagttatacttaaaaatattgcattagttgtataaaatcctataaaggtttgggtttaatattacataattatatttatatagtttccttatttataagtttaaatttaatatttgttagttcacttttttattttaaattttaaggaagtaattactatttttaaaaatgttagttaattagatgctaaatatgttaattattaatgtggcagctcctgactggtcgtttaaaatccgacgtggacggctttagaagcaaatagttttatcaccaccttcatcatcccaccttccgcgtggcaagtttggaacactgatcatcaagtgatcaaaagatggattagctccattcttgaatcaggaggtaaccaatctgtttaacggaagtaatctcattttgatattcaagtgcagcccaactcaacaaggttgtggtaaatgacattagtcaaacaaattttacgttgtcaccagcatcataatatcctctaatcaaattcacctaggaaatcaaaaacacccataaatttgttcagtctataagagataacatattgccaaaacttatgaaataaggttccatttcggaaaacatatatatacatatatagagagatgtttaaaagtatagttggtttacattagctgatgcactatgagaaaggccagaatcagctcgccatttaaccctttggttagtcgggactttaccggatatttatagataccctatgcaagtaaagttgcgtacgtaattttagggtaattttgcatgcactttaattaatatttctaattgtcagcattttcttatctaatatattttcatcaattctaattacttacaaaaaggagaaatcttaggacattgttaatattatattttattaaaagataaatattttagttattgaaagtttattaaacggttagaatatttaacggaaaaacttttagaatatttataatatgtgaaatctttataaactaaataatcatttgaaagaaaactttgatttgaattataaatctttgaataaaagtattattaaaaaaaaataaaaaacaataatgtttaattttaccgaacatgattagatggtagaacgggtttataatgttataatatatgaactttacaacaattaaataactatttgaaagaaaacttttaaattgatttgaattatatatcttttaaatcaacgtattattaaacaaaataacaaaataatgtttaatttcactgaacagagttagatggtaggacgggtttagtcgatagtaatacgagacgatatattacgggtaaagtacattaaatatatttaatttcactgaacatgattagatagtatgacagttttgggtcgataataatacgagacggtatactacgggtgaaatcctagatataacagtcaaaatacaattatattatcttaaacactaagcaaaacaaataatattaataaaacaaatataatttaaatttaaattatatagttataatttagatcttaacttaatgaactatatgttagtgtttctatatttttaatcagtaaaaatcaaacatagtaattgtatactaaatatttatagatataagagttgtccatttggaaaatatataaaaagatttaatctattaaataaattatttctttttaattttttaaaaaatattatagcttcgcgctgtacgtatgttataatattgtagatctagaaaacaaatcacttagccacgtgtaaaaataaagcgcgtgatcttaatcaagcaaagggttttgtttacaaactcctgggccgtctttaaaagcccaataaccggcccaaacattctcagtagtatttcgacctaaccccttatttagacgcatccttattcgattaaagataataacataaacttatctctttgccttgtctgcttttcatccaaaggtccaattagcctctgaagcccaaatctctctctctctttctctctttctcgctttctcaatctactcgccggagatcggctcgattcctccgtcaccaccgcatctaaccggcgattttcattccgtcttctctacttcacaacgcagagcttcaatttctccctcgcaggtatttttcacgaaaccctaaactctggatctaatttcgcctggatctaattggggattttagagttttgcctcgattgtttgttaaattgttagcttttggtctactctgcgaaaatacgtttggttcatttactttatgcaattaccatactggatctgctaattctgaaataattcaactcataggacaattttactgggttgataaagttcttaaggtcgtttaggagccaagttcaaatgttttggtttaactcatggaggcaaattaattttgaaaaaaaaacttgaaattgttgtttgtgtttgtgtgtgtgtgtgatttaaagaaaaaagcccgatcttataaacttctgtgttttgtttgaatcagtttcgttatgttgaagactttataatctgggctctagtttttgatttgcagcccatgtttgatcgactcttaggaccttttaaaacttcagatctgttttttttctctctctctttttaagttgttggatctacgcgatgttgtcaaataccgattttgcccttataccaatcttattatttaccgttggtcatggccttttggaataggcccaatgtttaatcattgttattattatagtgggctttgtttgggtaacagttattttcctttttatgttatgttgcaaagaagatggaagtgtacaatgacgatactgaaatgaggtcaccagagacacaaccaatcaaggaaacagctttggaagtgtacaatgatactgctgaaataaggtcaccagagacacaaccaatagaggaaacagctttggaagtgtacaatgacactgaaatggtttcaccagagacccaaccgatcaagcgacgcaagaagaagtcgatggtgtgggaacatttcacaatcgaggcggtagaaccgaactgcagaagagctttttgcaaaggatgtaatcagagttttgcttacagcaacggtaacaaagtggctggtactagccatcttaagcgtcacatttttaaggggacatgtcctgcacttatccatacgcatgacaatgacaacaacccactgatgtctactccttacactcccaagactgacactccgagaaggcgttaccggtctcagaacaacgctagtccctatgttgcgtttaatcaggacaagtgtcgtcaagagatagctaagatgatcattatgcatgactaccctcttcacatggttcagcatccaggttttgtctcgttcgtgcagagtattcagcctcactttgatgctgtgagctttaacaatgttcaaggagactgtgtggcgacttaccttgctgaaaagcagaatgtcatgaagtctttagaagggattcctggacgcttctgtctaacgctcgacttttggacctccaagctaactcttgggtatgtgtttataactgctcactacattgacagcgattggaagatacaaaagaagcttctcaatgttttgatggaatcgtatccagaagctgacgaagccttgagtctcgcggttgcaaattgtgtttctgaatggggtctggagggaaagttgtttaacgtcacctttaaccacccggcgagtaactctgcggttgaaaacatcagacctcaactctgcatcaagaaccctgggattctggatggtcagttggtaatagggaattgtgttgcccgaacatttggtagcctcgctaaagatgtcctggagaaagggaaagatgtgatcaagaacatccgggacagtgtgaagcatgtgaaaacgtcagagtcccatgaggagaggtttactgagctcaaggaacagcttcaagttccaagcgagaaggtgctttctcttgatgatcagacgcaatggaacacaacatatatgatgcttgtggctgcttcagaattaaaggaagtgttctcgtgcttagacactgctgatcctgactacaagaaacctccttcagcagaggattggaggcatgtggaggcactttgcacattcctgaagcctcttttcgaagcagtctccactcttcaatctactggaaacccatctgctgttaccttcttccatgaagtgtggaagacacagtcagatttgtctcgggcgatagctggagaggatccttttgtcacaggtattgctaaaaccatgcaagagaaggtagacaagtactggagagactgtagcttggttttggcaatggccgtggtgatggatcctcggttcaagatgaagcttgtcgagttcagtttctccaagatatttggagaagatgctgggaagaacatcaagactgtggatgatgggatccacgagctcttcaccgaatacatggcgctcccgtcgccccaaaacacgacatctgaaggtgggaaagcagatggactgtcggattttgacacgtacataatggagacaacggggcagaatctgaaatcagagctggaccagtaccttgatgaaaccctgcttcccagggttcaggagtttgatgttcttgactggtggaaacagaacaagctcaagtacccgaccttgtcaaagatggctagagacatcctttcaatcccggtttcagctgcagcctttgactatgtctttgacatggaaccgagggaaatggatgagtacaagacgtcactgaggcccgagacagtggaggctctgatttgcgcaagggaatggcttcttgagagtaatgcttcttcttccgcagctgcgcaaaatgcaagtgctaccatcaaatctgaagcataggtgagactttgcttcattatctctaaatgttgttgttttctagaagtttatgtatgttgtcttttgtggttagtcttaaacccaccgtgtgatttgctattaggagcttccctctttaagatatctactgcacattttaaaatgctccttcttagatgaactctatagcacatcttcaactgaactaaaagcctcgttgaatcctatctttcaattccaaaactgaaagtctttattctaacaatttttacaacgtatatgagtaattaaagctctagacaactgttttggtacatggagattttttaaaacaactcttgaaagaaatataagaacaaaaggtattgtaatgcaatgactatagtatactatcaagaaggcaacctaatgttaagcctccttaaccaaaccgagtgaagaatcatgtggatcacatcaaatggttgagccggacggttcaccacaaaatgccttctaactttcataacatttcgatacatccttaaatatttgtcatgtggaatctcttgcaaaatcttcttaatatcaggaattttgtcgaccgggatctcaaccgagaacttgctccaatcaagcacgtcgttgaacggaagcgagtagttgtccgatatgacaaccgggacgcagcctgagtagatggcttcgacctctctaggactagccacctcgtagccactaggacaaagacaaaacttgctatgaccaatcaattcatgatagttttgtccctttgtgaggtggtcataaacttgaacgtctttatccttacccttccagtgactgaacaaaacttccctaatgtatccgtgagctcttcctgcgaagaaagccaagatcgtcctgttctcagggttttgtcccataaatggtggctttagcttccttttaggaatgttaatctccggtatagagaaatcgatgtttcgtctgaaaccttccgatgtgttggcgttgcatagtcctctcatgaagttcttgaaaaactctggtttactatctggcacatcgggagcctaattatatcaagttaagtagaaaatatttagtcattgttaggtgtaaccaatccaaattggtaagaaaaaaaacccaattaaaaccgaacctaaccaaatgatatgttgaaatgatttatagaagttatgtatacgttacccaatcgtggcaagagaccatgaaatggtcagcaccattgctttggttccaaaaagggtgcttgtgagccactacgtctacataatcgttaaaaatccggtggagacgggcccggttgaaatcggctggcgaggtaatgggttggtagacgtagtgaacaatgttggcaacggagaagggtaagaagaaggcatgggcttcttctggccggctagctctaaaccggccacttggtccgcccatcacgtaactaagctcgtcaatgaactgtccctcgattccgtagatatcatttaccggtccatcgtgaaccagtggctgctctccttctttgtacgaccacaccttaaatgttttcatcatttctatgtgactcctgttttattggttcaatatattatatctgtttagagttagtatcaatatgtaaacgacaaacaatgttttaccaaagaagttcttttatcaaatatcaggaacaattcttgggtttacccctaggggatgaaccattcattcatcccctttgtagtgaccaattagaatttgacatatcatatatttaaaatataaataaattaaatcacaaaatttaaaacctaaccattattttatcaacccaaatcaaaatataattttgttaatcacaaattctagaccataaccactattttatctacccatacaaaatataatttcgtttaatcacaaaatctaaaccctaaccactattttatcaatccaaaccgaaatataatttcgtttaatcacaaaatttaaatcctaaccactattttctcgacccaaatcaaaacttaaatttgtttaatcacaaaatctaaactctaaccactattttatcgacccaaaccgaaatattatttcttttaatcacaaaatctaaactctaaccacaattttatcgacccaaatcaaaatataaattcttttaatcacgtaatcgtaaccctaaccactattttatcaacccaaaccaaaatataaatttgtttatttataaaatcttatccctaaacactattttaaaaacccaaaccaataatttccttaataaattaaattctacagaatttgtttctttaatttattttattttattgattttaatttctttattctttaaataaatgacatgtcaaattctaattggttaatgaaaaaggggtgaatgaatggattcacccaagtatttttcaaatataagcacttcttagaaaatgtgatttgaagcatttttgaaaatttaatcttctattgaatataagtgtgagatttaaacgacccaaattacaatatacttctttctgcttctttctgcttgataatttcaatgagtttagggttttgtaatcaaagtttttcgttttttcgtgggcaagttgggtcataaaccctgctacaggggcgagcggtagtgcatcggacacccacaaggcaaggttctctcgcgtgtgctcttgcgccctagcctcccgttcccaagcttgctcctctaatcaaaattgcacacgttcacgcgataagcagaagctatgcagtggaagggaaggagcctaaatcgacccctttctcccatgattctcgtcgattttctgtgaaaagatcattatgatttattcttttagttaccaacgaacatgttcgcgggctatgaaatatttttgaatatgagaaactattctcgcaggcgctcgtgatagtctaaggccttttaacataaatttgtgagtgggtcaaaatgtcaatatatctcagttgaccgaaaataaaagaattccaatactcttcctcgagatatcaaaactagaaagaaagagtgttataatatttttattttggattaacaaaaaaaatagagaaatggaaacgttgaaagtccaattaaatttgttatattatgaattatgtgatataacaaattaagcaaattggcttctaaattaatttaaaagtataaaaaattggaagcgttgaaagtttaattaaatttggcatattatgaattatgtgatataacaaatgaggcaaattgacgtcttaattaattaattaagaaatggtagagttgaaagttcaattaaatttgcatattccgtggttccgtaacactgagtgagaatgacttgcactcaattttttcaaaacagtggaaagtttggtgaaataccttcaagttaggcaattaggcaatctcttatatactattaatcttggttcatgcatataacatcttaagatgataaaaaaaatggattcaaaacgtaaaaattaacaaaattcagtaaaataatatataagaataatatttttaaatatgttgtgttatgttttcaaactatggtatagtagtatcatctatagttttatcatcaaagtaattttattttgatattgacagtcttaaaagttgtcaaaatacgacaaatgcatcatatatttgaaattgtgtaaattgttttattggtttttatggtttccactgattcaaacgatcaaactgttgttcaataatataggttacattgaataaatagttttaacttttaaagtactttgttattaaggggttataatatttgtatgttgatatatataaaattacaaaacttaaataaatataattgtaaatatataataataattaattgtatattagtgaactcaaagtttttagtaaaatttcaaaggttacaaaaatttaaaatatatatttatttataagtagtcatcacaaaagaaaatgtaatcaaaagtataaacttaactgatgaaaggcaaatgagtttctgtagatctggcctgtggggatataagtaataacttcttcgttggacgtgcaattcttaaacctgacggctcttctaattgcagcccttgctttcctcaactcttcttctcttttctcaagattgctccttctctgccgacatttcatttaattttgttattacctttacttcattttcactactacaaactacgactgttttctatgtatatatgcatactatatataatatacacatgtacatgtcaagttgaccagaataaaagattagttatgtacgttccaaaagtcgtacgaatcattacaatatacatgaacatcgacatcgagtactaatatagcaaatgactaattcaaataatatataacacatgcatgaatcatcggaaaatcatgtattgattttgagaatttcaccatatagcatgtagatttgcaaacgttaatatatgaaaacatcagtatagtaatgaaagaggaaaactatacatatgaatccgagagattcttacctttacggtaatcggaggagagtataacgaagaagaagaagatgaggattgtaatgcatttgtgtgaacaagaagagaggacatagtaagtgaagagaagaactgttgaggtggagattcattattagggaacgaagaaaaaagtaagaagcttagaagaagaataagaatcaatggaaaccctaacaagcaaaaactcttggaagaattgtttgacatgtttttgcttttgctaaatgctttctctcgttgttcactttcatttggcctcttgaaccatttatatgcgacttcgagcagttcatgtttgactttgcgagttttttataccaaaataatatttttagactaacaaagcctttttagtcgacgtcatagcttcttcctagacgcaaaatcttttacaggtgattactttagaatggtttagtttaatccgttggttttgtcggctaattagacatttaattggtatggaaataattaatggcaaatatagtcatgtatttatgtgattgtgaagacaataaaataattttcagtacatatatatactacaatcaattactaatcgcaacaaatttgcgaggaaattggatttagtacgaaaaatttgagagatatataacttttcatttggagatatcgtcatatgttggatcaaattttattaagtcaagtgggctttataaaattaaattgtgtgaatgagaaatgggctataatgatttggtttgttctcactggagctccaagagtgtgttgagtggagttgaacgcttccatgagaatcagtatcttttgtttcacgtctccttgagactcggcttcattgtgagatcgttgcgtcatgctatcacccacttctcctggatttgcattggttgtggttgattgatcttaaaaattaaaccaatctcaaacctcaatatatggacgtttgaggtctttttcttaagggactgagaatttcatatcgctcatatagaaacacatatatccagcaatttctctttgatagaaagtattcaaaagtatcgtagaaacacttggttcgttagagctgttttccgaaaatagtttatagaggttgtatcatgggatccttgaatcacacagaaaccgtcacactacggatgattcaaagggttaaggacagagttcatcaactcgactcctctcttgtctttccgtaacatttgtgatttcaatttcaattgctttacgtagtgtttgctaattttagctcctacagtcttaaccctttgaatccgttttgttctataaacattaacagattggaattggaattttataaacgtgggaagcttgtgagtgtgtacattgagtttattggttgcgattggtaaacgtcaaactcattgtgacgagtggcgaggctcgacttggttgttctttcggaaacagagaaacatcaatcgaattcaccttgtataagagtattaagtaaatacttagttagggatatcaatgtaaattatgaaagttaactctaccctaattctctcatatgttctgtataaatagatgtaaaccatattctttgattaataagattatttcaatccttgtatggtatcagagctatcggtcctaaaaacctaaaaattctccattttttttactcagccgtcaccatggcaaactcaaaaaacacaaacgatgcaatatcgatcacaacaaacaccatccacaacatcaacatgttcaatatcacgaaactaacgaccacaaactacctcgtgtggaaattccaagttcatgctctcattgatgggtatgaactagtgcaccaccttgatgacaccacagaaattccggttgtcactgtaatagttggatatgtgacatccccaaatgttgcttacaccaaatggcgtcgtcaagataggatcatatacagtgttctcataggctccatctcaccgtctcttcaagagattgttggcgtcatcaagataggcttatatacagtgccgctgagatctagacgaagctagcctccacatatgtcaatccttcatgtacacacatccgctcactgatagatcagctcaaactcttccacaaaggtaccttaaccattgatgagtatatcaagggaatcacaacttttctcgatactcttgctcttcttggaaaacctcttgaacatgatgaccagattgagcacattatcgagggtcttcccgatgactacaaacctgtcattgatcaaatcgttgccaaggataagcctcctcaaaccacagaagtccatgaacgacttcttaaccatgaagccaagcttctctccaagcaagctgctgccacatcgatggttcctgtctctgccaacactgcccaacaccgcaacaactacaacaaccgcaacaataacaatagaaaacgatacaataataacaacaacaacaacaacaacaacaacacatcctagcagccttcgaacaatcagaccataccagacgaaagggtctccaaaccgtgtttgggcaattgccaaatatgtcaaacccaagggcatagtgctcgacgctgcccgcggtttcagtctcttcaaacatcacagagtcaccctcaaagctctcctttccgcccatgacaaccacgagcaaacctagccattgggtcacaatatcctgcctcgccttggttacttgattctggcgcgactcatcatcttacttctgatttcaagaacttggcgctacaccaaccgtacaatggcggtgacgatgctctcatagctgatgggtcaacaatatctctatcatacacgggttccactcttcttcccaatcaaatacgtgctttacttacttgataaaatattatgtgttccggatacacaaaatttcatttctgtatatcgtctttgtaacactaatcgtgttttggtttaatttgcttgtgacatctcctcaaactactgcgatggtttcttgttccggtccaaagacaactcttacatcttggcactcaagattggggcatccgtcttcttctattttgcattctattatttcaaagcattctctgccgttttcttcttcacaacaaaaacacttaccttgctcagaatatcttataaataatagccataagcttccttctactcaaactaccattgtctctacttgtcctctagaaatcatttttaccgatgtttggacatcacctctttattcctttgataatcacaaatactaccttgttttggttgatcactttacccgttatacttggttatatccgcttaaacgcaagtctgatgtccgaaaatattctaagcctttgtagccctagttgagaatcgttttcactgccgcattgggactctgctttcggataacggaggggaatttgttgcacttcgaagcttcctctctacacatggaatcagtcatctcacctctccatctcatacgcctgaaaacaacagccttgctgaacgcaaacaccggcatatagtggaaactggtctcatgcttatgtcaattgctttggttccaaaagagtattggacgtacgccttctctatcgcggtctatctcataaaccgaatgccaactccggttctctccatgacgtcaccatttcataaactctttgggatatcacctaattatgagaagcgtcgggtcttcggttgtgtttgttacccttgggtgcgttcgtagacgagacataaacttgacaatcgttctcaacaatgtatcttccttaggtactctacttctcatagtgcatatttttgctttcatccccctaccaagcgaatgtatgtgtcaaggcacgttcaatttgctgaatctgttttcccattcgtgaagcccaatcgagaggaccacaccaataatgtggtaaattccagctcgccgttgttgatattgctcgcaccacctcagatatctccgtcaccaccgtcgacgcctactgtccaacctgaactccaactcatccgctgcctagacataactcacgtgtttaagacgacaatggtcatcaagactcaccaagaatattgggctcaaatcaaacaggcccattccaatcaaataatctggcccaatacaataacccatcaacaacaagcccatcatccatcacccagaatttgcccaacaacacaacaactcgtacatcatcatcttcgtcttcaccttcgtctcacaccagagcttatcagatgtcaccggtcaccccgccaacttcgtcaacgccaccgggatccccgcactctggccttcgcctctcaccacaaccatcgtcatcgtcacaagtattatctcatatccctaactcttcctcatctcatatatctgagcctacagctccaattatacatgggtcgcaaatctcgacccatgcagaccctctttcaattgagcccattgctccacgccaaaatgagttgcaacccacaactcagcaaaacccacaaacaaatccacaaaatctaatccaagctgcgcctattcaaccacaaaaccaaattcataaaccaccacaaaataatcacaatatgcgaacttgagccaaaaacaatatacacaaaccaataaacaaactcagcctcacagtcactgccaataaacacaaatccaagtacaaatccaaggaactgacaacaattcaacaagccttgaaagatgaaaattagagttgtgcctcttctcatgaattcgatgcacttatgaagaatcacacctgggatttagtcccaccacaacctactcaaaatatcattggctgcaaataggtctttatgacgaaattccatgccaatgggctcctagatcgatataaagcaagacttgtcgctaagggttttcatcaacggtatgggcaagactacgcagaaaccttcagtcctgtcattaaatgaactacgcagaaaccttcagtcctgacatttcatacgccatcaatcgcctatcccaattcattcacaagcccactaatgagcattggcaagctgcaaaacgggtgttacgatacttggcaggtacacttacacatggaatatatcttaatgctgcctcaccaatgcttcttcatgcctattccgatgctgattggggtggtgatactgaatattacatctccacgaatggctacttaatctatcttggtcgtaatccaatctcttggacttcaaagaaacaacgcggtgttgctcgcttgtccagtgaagctgaataccgggccgttgcaaatactgcttacgaggtacaatggctatgttctctactcactgaactacaaatatccttaccgacagctctagtgatctactgtgacaacatattgccctcgactactgtgacaacatactatgacaattgcctatctttgcgcaaatccggtattccactcccgcatgaaacatattgccctcgactatcatttagttcacaatcaaatacatggtagaatgatgcgtgcagcttatatctctacacttgatcaactggtggatacacttaccaagcctcttccacgatcacgatttcaacaagcatgtgtcaagattggagtcactcaagtacctctatcttgagggagcgtataagagtattaagtaaatacttagttaagtatctaaatgtaaattttgatagttaactctaccctaattctctcatatgttctgtataaatagatgtaaaccaaattctttgaataatttcaatccttataccttggagattcaaaaaataagtgcagcgtttgttataactcagctttgaattacgattacaagcccgagtacgtaagatgcagccttttatctctcaaaagaatcaagaattggtgcttagaggttcaatatcagacttgaattgagattctattctgccgtatcctgcagctttgtatttgagaattgagattctaaaagctgttttgaaaccaattgttttggtattttgatcagactttgaattgtgtttcttagactgttgtgaccaacacattgttatcttggaaaaagatataatcacaagtgagtgttgttgcgtcatcgagacttaacctattaaacctgcagttttttttttgttttggattatctctagaaaacgagaattcatagtgatacaggactgagtttcaaagtctgtccaaaatcatatagattaaacttgcagtttggtgtttcaatctttacaaattgaaagtttagagacttattttgtcttggtttcaattctctgcaaattaaaaacattaaaacgtgacctcgagtttttggcttggaccatttggctttgcaaacactgtaacgtcgtattggttttgaatttttaattaacaattggctttaaaacaaattgcaattatttattattttacgtgaagtatacgaattctgcaacttgactttgctttcatttttgtgcatatagaaaacattcatcaatgtaaactgcagtttttgtattgactaactcacgttattaatctggttttgggtctattgtaaacatggcaagtgagaacgtttacaacgtcgctgaagtcgacaagaccataaccaatggggataaaacagaaatccagtttggaactgtccctgaggtgaaagacatgtgtgcggttgtcagcgaggctaatgttgccgaaagccatccaaaaacttggtggttcgataccggtgcaacaagacacatttgcttggataggtacatgttttctacctatatcaagaacaagagtgaggagaaactctatatggggaactccgccacttcaaaaagtgaaggctgggggaaagtggtcttcaagcttatctctggacgtgagcttaccttgacaaacgtagttcacctgccggacatgcgtaagattctttgtaggaattcgtaccggtgtataaggatttataaatactaataacgaaatctattgccaggaatcgtgtaaataaagaattaaatctagatcttagggtttaaatatacctgaatattctgcagcggaaaaatgaaccatattaattcgaggttgttttagcaccctaagtgttgtgcctctacccgtatcagatcttgaatgctaattcatttgagatcttatctcaaaactttataccaacttttgtgtcttatattttagggttcttgtgattaaaagtatatctcacaaacgttgctaatatatcatatatatagttaaacgtttaactctaactaattaggattaataatggaccaaagtccaataactttttttctcccttttgaaattcaagtacataaatatgtgtatatcatatataacatatatagtataataaatattttattatatatgcacaaatacaaatatatttgtgtatcttatataacatatatattatattattattaatccaacattgatttagtttacttaggtgtgtgaccctttatgtttgtataatattagaaatgagttatgactcatagattataagctgtctctagcaaaacattataaccacctaatattatacaaatgtcaaacctcgacattacaactttaactagagtaaagtacaactgatttcaggacatttccaacaatcttccacttgtactggaatcatctattctcatattccctttgtctctatatcccgatctcagcataaggcaagaaattgtcatccttattctgctagatcatgtttatcgaactctgatttatactgataaaacaaacgactgacattcacctcgtttgagcgcggccacacatttctcattatcaaatctttgataggcccaaagatatttctctccctttatatgggagggacaaatcccatcttgttccatctttgttccttaaacaattcataacgcgtccaatcactgtctttataattaccttttacggctgacaattgagagagtcaacgcgaactaatccatgaataagaaatcatgaagaactcatgtcaaaggactatactctatagttgtgatgagaaactcttatgacactcatataacaatcttgtagagttctcataacgggtcagtccaatactgtgttttctaaaatatatctaggtgattgactttaataccacatattaatgactccaggaaatttagtgaatcgattcaaattgccttaaacctactctccaaataagagatcggttgcagtatttaagggtcaaattttctcaaagttcttttgttcacacaatgaattagatgtcaagattaagttagcagagaataagtgaagtaaaaagtaaacaaagtaaaaagacaacagactcattggttgtgaaacgattaaataaagagctatgagtaggatattctcaagaaaatattggttagtagatctaatgaaagctaggttgttatcgaaccattcttaaactcaaactctaattatggaataaccggtggtattccacgaaactccctatgtctatagctaagaataaccggagaagccgagagatcttagaatacctagaaagactctaaaaagactggagaaataacgaaaagactcaaaatcctaaatctataataacactatattttactcattttaggcatgtatttatcatcatttagcttagtgatcactcattgtttcatatcattttgcatcacatttagcttattttgcacacttaggcatttaggatcatcttgcatacatattacatgttttggtgtgttttcaggtgcagaaggagcttacaaggaatctactcgaccctctactctatcaaaccaggagggaagcaacagagcaatctactcgaccagttacttgatccaggcaactacagaggaggcaacagactctactcgaccccctactcgaccagttactcgatcaagggcaacctactctacaagacttgttgatcgttcaaagcgtcttctgatccttctcattccccactcaaccatacatctgagcataagaataggagaggaagaagcaactactcgaccaattgatcactcggagcatggaggcaaaggcgcaaactttgcagcaccctctttactcgatccccaagatccagcattcatcaaaaccgcctcaagtctcttgtcttctagtgaatctagggttttcgagattatagtataagtaggttctttggagtttgtccaaaggaccaatcttttattctgtagtttttctttgtgttttagaatcttgaaacattaattactcttaatttatttcgtttttgcatttagttccttgagcaaagttgtttatcttgtttagatctacattttgatatgattttagtaatttctgggtttgtgttcttcattatgttgcttgagtagtgattagggttctttaggatggattagattagggtaatctctaggttagtcaggtggttaagattaggttagatcccttctggattcgttggcccctatgcgattttgactgggtaatgttggaattcgaccctaggtattccagcgtccaaaagacgttcaaatggatgcctgatctacgaataacaagagatttatagattctagcccaagagattggatgtttagactgcttattgactttggtagattgttgtttaaagtctgccttgctatgtttcatcaacgagagttgagattaggaagtggtaagtttatgaggatctctgtcacgagagtgaattgatctgattttgaatctatcatctagggtatttgcctttcgcatgttagccacctgatgaaccctagagttgcccttatcaatggatccatccttaggacttctattcttcttagatttatttgtattcatccgtttgttgcacttttattcacatgttatttgtgtcatcttgttgagttacctttattgcatttcagtacttaaagttctcatttttgttgtttgaatcttgatttaggattgttactagaaacccaccatcattataatctggcttatcttatttgtttctgtatacatcttgattgctaacaataacagtggactagattgacaccctctatagttgcatcgacatgttagtgtttattgggaattgaagtgaaccacagttcaacatataactaggtgtaaaaacctagttatcaatttggcgccgtagccaattcattgttgcattgttacattcaagatttcagaaaaagttaagatcaagttcttttacattactcaagttacttactcatcttttcatctacttgtttttgtggtacatgtactaatctttgtgcatgcaaactcgtttcaaaggttctgcacacctactacctttcaaagacagaattgacagaatcgctcatgagttacaagaaaccaaagcaaagggagcatgtgatcatcaaagaccagcttctatggatcaacagaacagaccagttgatatacaagacccaactaatgttgaacaaagaaacattggtgctggtgatccccgaagaaatcatcaccaaagacaagggatagtgccaccaccagttcagaacaacaactttgaaatcaagagtggtctcatctccatgatccaaggaaacaaatttcatggtttgcctatggaagatcccctggaccatcttgatagctttgataggctctatagcctcaccaagatcaatggtgtcactgaagatgggtttaagctcagactattttccttctctttgcgagataaggcacaccactgggaaaagactatgccccaagactccatcaactcatgggatgattgtaagaaagattttcttgccaaggttttctctaatgctcgcacaactagattgaggaacgagatctcatgcttcacccagaaaaacaatgaaactttctgtgaagcttgggagcggtttaaaagctacataactcagtgcccccatcacggttttaagaaagcttcattattgagcacactgtacagatgagctttaccaaagatgagaatgctactcgacactgcctcaaatggaaacttcctgaacaaggatgtggcagaaggatggcagttagtcaaaattctagcacaatctgatgggtgctacaatgaagactatgatcgctcagtgagaggaactggagaaactgaagatagacagaggaaggatatcacgaccctgaatgaaaagctagataaactgttgctggctcaagagaagcatattcactatattactcatgaagagcatttccaaatgcaagaaggggggaatgaataatgatcaaactgaagagctctgctatatccagaaccaaggaggattcaacaagggctacaacaacatacaagcctaacccgaacctctcctacagaagcactaatgtcgctaacccccaagatcaagtgtatccaccacaatagaatcagtgtaagccatttgttcagtataaccaaggttatgtctctaaacagcagtttaatggaggataccaacaatagaatccaccaccaaggttcattcaacaaccacaacaaaccccagcatcacaagatactaacacaaaacagttgcttcaacaaattattcagagtcaaactactggagctctagttctggaaaaacgattggctgaaattaatagtgaagttgattgttcctacaatgagctaagaaacaaatatgaggacctaacatccaaaatgatatacatgaaaagccaagctacttccaatacctcctccaagtatacatggctggccacatccaggaaaagccattaaaaattccaaagaatatgtacacgcagttacacttcgcagcggccagaaactacttaacaaccaaaccacaaaaaagatcactgaggtcagtgaagttcaagaagggtaagataatcatcaaaacaaagttcaaattgatgaaccaactaaacttgatcagccttcagcctcactcagccctctactcgatccatcaaagccaacttttgagaaaagaaaagctgcggttgctgaaaagaataaagaatttgctctgccaccctacaaaccaactatgcgtttccgtggaagattcaaaaaggaaataatagaaaaatacaaaaccctttttgataaacagcaaaaggagattgaactaagaatgccgttaatggatgctttcatgctcattccacattcccacaagtacctgattatggaaagaatcaaggaagtacaagggatgatggtaataggccatgaatgcagtgctatcatccaaaaaagtataataccaaggaagttgggagatcctggatgcatcaccctacctttctcagtaggaccattatctttcaataaatacctatgtgatttgggtgcctcaattagtcttatgcccctatctgtaactagaagactgggtttcagtaaatacaagcccagcagcatccaactgatattaaatgatagatcagtcagaatttcccatgaagtcctggaagacctacatgtcaaagtcggatcaattgaaatcccacagatttcgtaatactggagatggatgaggagacaaaagactcattaatcctaggaagaccgttcctagcgacggcagggacaattatcgatgtcaagaagagaaagatcgacctaaacttagggaagtatacccaatctacgtagatgaagatgacattcgacataaacaaaggtatatatgaagaaaccaacaattaatggacaagtcttttggatcgaagagatgatatattggctgacgaattactagaagagcttacagtgcgagatcacttagcaagtgccttaaccaaagatgtagaagaagggtaccttcacttagaaactcaggggtacaaagaatatctagacgcccgcaagccaatggaagaaccagaagagtttgaggaattgattattccctcagaagaagtagtatcgggatgcaccattagcccaattactgaaaaaacaaactctaccgagacactcaaccatgttggagagaatgcaagttcagatgactggtcagaactcaaggctccaaaggttgaccttaagccttttccaaaaggtctgaggtacgcgttccttgatccaaacgatacatatcccgtcattattaataatggattaagtgatgaacaagtgcatcagttcttaaatgaacttagaaagtataggagggcaattgggtatccattagctgatattaaaggaattcacctagtttatgcactcataggatccatctcgaaaatgaatcatatactagtgttgaaccacagaggagattttatctggatttaaaagatgtggttaaaaaagaaattcttaaattacttgatgctgatatcatctacccaatctccgatagtacttaggtctctcctttgcactgtttacctaagaaaggaggtatgactgtagttaaaaatgatttagatgaactcattcccactagaactataaccggacacagaatgtgcattgattatagaaaactaaatgctgcaactataaaggatcattttcctttaccattcattgatcaaatgttagaaaggctagctaatcatgtttattactgttttcttgatggctataatggtttctttcaaattgcaattcaccctaatgatcaagaaaaaaccactttcacctgcccctatggaatttttgcctataagagatagacattggatgctcctggaactttccagagaagcatgacttcaatattctcggattttatcgaagagataatggaggtattcatggacgatttctcagtctatggatcctctttctactcatgtttgttaaatttgtacagggttctagaaaggtgtgaggaaaccaatttggtactcaactgggagaagtgtcacttcatggttcaggaagaaattgtgctggggcacaagatctctggtaaaggaattgaggttgataaagcaaaaatcgatgtcatgattcagctgcaaccccctaagatagttaaggatatcagaagcttcctaggccacgaagggttctacatgagattcataaaagttttttcaaagatttctcgacccctcaatagactgctgtgcaagaaaactaagttcaatttcgatgaagattgtcataaggctttccattcaataaaagaggcattggtgttcaagcacccaactaggactatccattttagattatgtgtgatgcatccgattatgcagttggagcagttctaggccaaaggattgatggcaaacttcacgtcatctactacgccagtagaacaatggacgtagctcaaacaagatatgcaaccacggaaaggagctgttagctgtggtttttgcttttgagaatttagaagctatttggttggctcgagagagaaggtttacacagaccatgcaacactaaggcacatctacgccaaaaaggaaaccaagccaaggcttttaaggtggatactattacttcaggagtttgacatggaaatcattgataagaaaggtgttgagaattgagttgcagatcatctctttagaatgaggattgaggattcaatcccgatagatgacactatgcccgaagaacaactgatgttctacgaccttgttaacaaaaacatcaccacaaaggacatactggatgaagcatatgcagttgaagaagaaaagttgccatggtatgtaaatttagtcaattatttggtaagtggtatgatccctcagagtcaggatgcatataaaaagaagaagttctttagagaagtccactattactattgggacgaaccatacttgtagaaaaagggaaatgatgggctattcagggggtgtgtctctgaaggagaagttcacggtatattggaacattgccatggcttcacctatggagggcatttcgccacttttaagattgcccagaaagtgttgcaagcaggtctgtggtggcccacaatgtttaaagacactcaagagttcataacaaaatgtgattcatgccaaagagtcgggaacatatccaggaggaatgagatgccacagaatcccattcttgaggtagaagtttttgacgtacgggggatagacttcatgggtcggttcaatcctccctcatatggaaatacttacatcctcgtagcagtggattacgtctccaagtggatcgaacctataacaacaaatgatcacaaagtggttctaaaaatgttgaagtccattatctttcccagagatggtattcccacggtagtaataagtgatggaagctcgcacttcataaacaaagtctttgaaagtttattgagaaaacattggggttaagcataaggttgccactccctatcatcctcagaccagtggccaagtggaagtgtcaaacaggcagatcaaagctatactcacaaaagttgttggtaagggattggtcagctaaacttgatgagaacctgtgggcctatagaactgcatacaaaacgtttattggaagaaccccattccagatgatatatgggaaatcttgtcatttactagaagaagtggaatataaagccatttgggcaaccaaacttctgaacttggaaatcaaaggagctcaagaaacagttgacctgcatgaactagaagacattaggctggaagcatatgagagttcgaagatctacaaagaaagaccaaaagcctttcacgacaaaaaaatccaccaaaagatttcaacgttggagaccaagttctacttttcaactccatgctcaagttgtttccaagaaagctcaaatccaggtggtctggacctttcaccatcaaagaagtaatgccatatgtgggcagttactcttatcgggaagggaagttctgaatttactgtaaatggacatagggtcaagcgttacatggcagattgtcctattcctgaaagaactacagttcacctccaggagtccattagtgcctaagatagtaagaagtctagcttaagactttaaactagctcgcttgggaggaaatcccatgtctatctctgtacatatttaattttaatattttgatatgcttcttagtgtttttggaatttaggaaataaatcaggatttgtggagctgtggagtctgtgatgaagaaacacctactacaaaagcaattttactctatcaattggtcgagtagcacgtttaaacgaccaagcatgatgatcgagtggctcacttgtttcccaatcactatattactcagcggataatgcatgtacccatcatactcaacacgatttggtcaaactttcttatcccaacaagaaagtttcggagaccatcctcctccactcattcaaatcgacatcaaggataagaatttcaatcttacttctttttctcttgtgagcgcacctaactatcatctctctcacttgattcccttagcaaaaccattcccaacatttcaatcttgagttttcattagacatcactcatccctatttcactcgatcaaacccatcgattttcttttttgtttttgactcacctattaagcttcggttttggtttctaaaagttcagtttcacaatgagttcaaacagcaacggatcttcaatggacgccgagcatgaggctgaatcctggtatactaggtctgagagggagatgaaagagtacaaatggtttaatcaacaaaccgccgaagctcttgctcgtgaaagaaaaagagctgagattgcaataggaaaaagagccatggcgggagagagaagccttgtggatgaagaccttggtggggatgtagactatgtcactgaaataactccaagagccaccaaatccttgatgaagaagactaagctatcgccggatggatactatgagcttttggcggttcatgatttccatggcactcgataccctcactccccaactatgaataagcttggcataccagaagatgtcgagtacctctttgaaaagagtggtcttttgggtctcatggccaaccctcactcagcctacatgacaaaagcgtttcagttccttgcttcactaaaagtagagttgttttaggggctatctagccatgaatcgagagaagaagggcttgggtatatcaccttcaaagtctatggaaaagactacgttttggccatcaaaactcttgaggatatgttcggtttccctagaggtactcatgttaaacccaaattcaagaaagaggagctttcagatctttgggtaacaataggagatgacgcctacttctcgtcttcaagggccaagagcaacgcaatccgcaacccctgcatctgttacttccaaaaagcaatggctaacgttttctacgcaagggagaagactggaccgatcaacaatggcgagttagagctgctggacattgcactaaacgatcttctagtctacaccaagaacaaaatgcctatgaagggtgacacaaacgatgcttcaccatccacgcgtttattgaatcaactttgtagttatatgaaatgggcactagctaataagcacaagagaacaatttctataggaggggtgataacacttatactactggcttgtggagtgccactttagtcgactccctttgccccaagatggattgacattcctcaccggaaatgggccttgttcattgagcatcaacatcatatagggatgcacattctcaagtttcatcacaaaacggccatggatggtaggattgtcctaccctgccaagagctcacaaccatcacagtaagaggtaacatcgatttcaacacgcctagtgagacgcttttcttcatggatagggcaccccgacaagagaagctctagacaacaaagaaagggctgaggttccattttaaggaacacaatcctccatcaagagtgagtaaaagtttgagtgaagcacacaagaacattggttcagtaaccgcttggaataagtttcaagacaagatgttggcaaaatgtggcaagaccatatcagcaattcaagctgcattaagctgctcatcctcaggcgccaccatgataagagagaatcgacctgaagaagtagctccaacaagacacagagtttcaccgccaaggcaatcggcctatgagcaacgggaggtaagtcgcccccaagcttctgcaagacatttatctcatgagcaccgcgagcagaaaatgagaagaagaacaagagtggttcgcccaaggagcaaggaccgtcttatgagaaacaggagatcactcaaccaaagtgctcaacgtggtatcgagcagagtgtcaagcacgatctgtaggctcagaatgagcagagtatcgagcaagagtaatgggatcaagacgggcagtactcgaggatgaattgggatacatagtatggcatcaatgagcaggaaaacacctctgaccgctaaggtaacaccaccacatccattgtatatataatagtttttttttttttctttgtttgttctttgttttggtcttaaattctttctcagatttttattacacaatggattgtgtaatttaagtttgggggaggtttcaagacatgtttgacattatgttctcttttcttatttcaaattttgcatcatctaaggcatagaaaaaaccataaaaatttgattttttttcagaaaatgatatcataaaaaatagagggtcatgtagattacatatcattttaggattgtaagagtgtttgcatttaggattgctcatttgcattggggataatgatgatttcaaaccgttgagtatgtaaactcaatgaagttcaatgcccaggttgttagttctctgttgtataactgattgtttctctaaagtaagagtgcaccctgcattgaatttacaacttgactttactgctttgatttgaaactcgctaatctgatgccattccctatctattagaacctgaactgaatttgcaattatcatgtcaatgcattgtttttgaactcatggctaccatatacatacttggtttatcttattcacttcaccaccctttgttaatccatgtagttgactctcatctttagagcagtttccattaccctgaacttaaccttatttcaagccaaagatcattttgtgtgtgattgtgagttcttttttagatttagcttggtataacgtgttaggtatgagccgacaagagtagtctttcatgtagacctagctcacgctatttgggttagctaggactaggtggagacttgtatttgggattgggattgtgtatagaatgaatggaaaagagaatgagaatgaaaaagaaaacaaaaaaaaaaaagagtaaaagtttagagttctgaagggggatacaaaagaaagtgttagtctagtaaatggtttggaattcaaagaaagttaagcattttcattcaaagaaaatgataaaacgccctctgtgctaagattagaagaaaagccttaaagttgtcaaagtgtaaaaccaaacccgcgagactcttgaatcgttttaaagaaacaccccttagaacttgaaccaaaagagagaaagaatgagtataagtgtagagttaggacatctaacggactgagatcatcttctgagctttcatactttatatcatttggtagatgggagtctattcttggatgtgttcgttggctctaacctttaacattctgctaaagctcaatcttttctataagagtcccctgttactcggccaattcattagagggacaatttttgtctcttagccttagcccctaaaccaaatgagttcataaacattgcattgcttgatccactgttcgtgcttaaaaatgttaaaggaaattcgctaatgtgaatgcttgaatagattaaggcagttgttaggttgcactatgacgcgtattgtagcaccccttatagggaagtaagaagtctggaggagttgagcaggattttgagcttttgcgtgagttaagtaagcttccattgaaggagaaggggaagagcaaaggtgaactccatggaagaagaaaaaccttactggaggacaaagacgagaagaaaggtgattatgttgccctcgctttaaacccgtctcaaattgaattgaaatgacttgacccgcgagagtggttcccaaagcttagagaagtgagaagaaatccgattagggaagaaagaataggatgaaattaaaggattcatcgatcgagagatcaagctgaatcacccgaccaagaaatctatggttgagagcttggattcagaagaacttttgagactttgaagatttttgaggagaagatgattatttttgtctaagtgtttggaatgaatgaatgagggttgcgttatttatagaagagaaggaaacttggagccgaatccattcaggcgaagccatgcaaatcaaatatggcaaactttgtgaccaagtcggcttgcatggagccgaagcgaacaaaacttggcgccctagtcccttggtcggacgccattcaaaatgcttgccatttgttgttgccacgcggccgaattctcttgcatgtgcgagttgtagaacgtgcctcgccaagtgtcaacggacgtgagccaagtgtcctaggacgctaactctcgccaaacgatcggaccgtatatataaaccaccctcttcagttccgaacattcctcttgagaatccaaaaataactaagaagtttttaagagtttctagtgagttttaaagagagtttccgagagttctagggagagtttttgcgagagcttttagaggagttcaagagaggtttcatggagaaggcggaggaagatcttgacgagaaagtcgggtaaccaagatcgccggtgaagcattccgagccttaacctctcgagccgtttctagttctatgagttcgcgtccaccttttcttgttgcattctcatgctagggtttcattcattctcggatttggttacatgttgataagctatgaccttaatgcatatagctcacttagaaacctcaccgttcatttcttcactacatgtctaaaatccggctaggttaaatgaatctcatacagaactcatcacccatcatgcttgtctttgttattcttaatccagctaggttacgttgtgtgttgcatttagttttctagggcttgcttgtttgtttgtgtgtttctttgcttgttgagtcttgtaagtcctgcttgagtgtcgccatcttcaaatccttgtcggatgagagatgtgcatttttgtattgttgagtctaggtgatcttggacgcggagtccatggatcgtagatcgagtctagtttagggtgctgctatttcctgcctgtgtatgtggaaccttcgagccttggtcccaagggaacgatcgttggttagtctcagaacctaggccgatggtgcatgacgatgcattatgggcttattggtatcctgtgtgggttcaataaagtcgtgatcttgttggtttcttgtgtgggttcaacgagtggttggtttgtttgacggatccatgtaggagaacttaacttccgacgttttgtgtgaggaggaatagagcacaggacccataggtcgtgtctaggtcgagtctaggttgagtcataggtcgtgtctaggtcgagtctaggatagatcaagtcttgtcatgtttgtgtgtcttgtgtttttctttgcttccgcatgtttttctgatccatgttgtcttctttcttgcttgctttcgttcattaacctccctctaggattgaactgcattagacagcttagaattgccataggttgtgtgctgcatggtcccgactcacttagtaatgctagattactcatgattttacttgtctttcaggcgcctgtagtctcggacgtcaagacgaaagacgaacgcaaggccattcggactaggttattatttttctttagttgcttttgtaaaacctcattttgtatctctacgagttttatatgcggatccgtttactaatcgtttgctttttgtgggttttattcgaataagtacaaagggttttacaaatgcggatgttttgagatgatacaaggctttgtccgagccgcacaacactaggttcatcgcaagggctggcaaacctacgcggggaatctcgtggggagatgaccggatgcggtttggccgtggacttggaaccccgagactttggccgagttgcgaatggttctctccatctgtgatgcccacccgagtcaggcgtggttagtccggtcatggccaggctcgggggtgttacaagtatggctaaagtttttaagaaggatctatcaccttgcaacctagaattagctacatggacattgatctcacccgcactatatgcatgcttcggtttttgaatccccaccttcaatcctctccttcaacttaagattttttgtttgcttgagggaagcaagagataagtttgggtgagttgataacactgtattttactcattttaggcatgtatttatcatcatttagcttagtgatcactcattgtttcatatcattttgcatcacatttagtttattttgcccacttaggcatttaagatcatcttgcatacatattgcatgttttggtgtgttttcaggtgtagaaggagcttacaaggaatctactcgaccctctactctatcaaactaggtgggaagcagcagagcaatctactcgaccagttactcgatccaggcagctacagaggtggcagcagactctactcgaccccctactcgatcctctactcgaccagttactcaatcaagggcaacctactctacaagaattgttgatcgttcaaagcatcttctgatcctcctcattccccactcaaccagacatctgagcataagaataggagaggaagaagcaactactcgaccaattgatcacttggagcatggaggcaaaggcgcagattttgcagcaccctctttaccagatccccaagatcgagcattcatccaaaccgcctcaagtctcttgtcttctagtgaatctatggttttcgaaattttagtataaataggttctttggagtttgtccaaaggaccaagcttttattttgtagtttttctttgtgttttacaatcttgaaaccttaattactcttaatctatttcgcttttgcatttacttctttgagcaaagttgtttatcttgtttagatctacattttagtatgattttagtaatttctggggttgtgttcttctttttgttgcttgagtagtgattagggttcttgaggatggattagattagggtaagctctaggttagtcaggtggttaagattaggttagatcccttctggattcgttggcccctatgcgattttcactggctaatgtgggaattcgacactaggtatccagcgtctaaaaaacgttcaaatggatgcctgatctacgaattccaagagatttgaagattctagccaagagattggatgtttagacttcttattgacttaggtagattgttgcttaaagtctgccttgctatgtttcatcaacgagagttgagattagaaagtggtatggttatgaggatctttgtcacgacagtggatttatctggttttgaatctatcgtctaaggtatttgtctttcgcatgttagccacctgatgaaccctagagttgcccttatcaatgaatccatccttaggacttctaatcttcttagatttatttttattcaccccctgattgcacttttattcacctgttatttgtgtcaccttgttgagttaccttttattgcatttcagtacttaaatttgttgcctatatggttttgctcgaccctgtgatcaagtagggtacttaaagttctcatttgtgttgtttgaatcttgatttatgattgttactagaaacccaccatcataatttggcttgacttagttgcttgtgtatacatcttgattgctagcaataacaatggaatagattgacaccccatatagctgcatcgacatgttagtgtttaaggggaattgaactgaaccacatttcagcatataactaggcgtaaaaacccagttatcaatctaaaacatagataaactcagaaaaaggattatatcacttagtcatcaatcacctcacatactagtcattcttagttattaatatcccattttaataaccttgactaggaacttcaataatttatgtcattatccccttacagggtttcatgatcaagtcacgtacttgatgacctataagaatgatattaattatttaggactattatttaatcatcaaataaataaataatattaaaacaaatttaattaatttgaaaataaatccaaacgtattttaacatgaacatcatatcataaaataaaaaacctcccactagaaataagatcacatctttataaatctaatgccaatcacagcagtatgcctctcatgcttcggctgcggaagaggttttgtaaaaagatcagcaacattttcatccgttgaaactcggctaatcttcacatcacctctaccagtaatctcatgaatgagatgatatcgcctttgtatgtatggatttctggtgtgatctaggttcttttgcttgcgcgatggcaccattgttatcacaccaagttcagtaatgaacttcctaatccaaacagcctccttacccgcttctgaagcagctatatactcaactttagttgtagagtctgccacaatgctttgtttggaactcttccaactcattgctcctcctttgagacaaaagacaaatccaaattctgatcggaaatcatctttgtctgtctgaaagctggcatcagtataaccactcacaacaagttcctcacttcctccatagaccaaaaacttatccttagttcttctcaagtacttaatgatgttcttgactactatccaatgactttcacctggatgagattggtatcagatcgtcatgctcaaagcacatgcaacatctaggcgatgagcataacatacatgatagatcctatagtagaagcatatggtatcttactcatccgctctcgctcatcatgtgtcgaaggacactgagtcttgctaagagttatgccatgagacattggtataaagtctttcttagaatcatgcatattgaacctgtgtaagaccttatctatataagtatcctgacttagtctaattattttgtttaatctatctctataaattcttattccaagaatataggcagcttcacttatgtatttcatcgagaaacaacttccaagccaagtcttaacagactggagcaaaggaatgtcatttccgaggaggagtatgtcatctacatacaataccaaaaatgtgactgcgctcccactagtcttcttgtaaagacaaggttcttcttcgtttctaatgaaattaaactctttgattgcctcataaaaacgaagattccaacttcgagatgcttgcttcaatccatagatgaagcttgcataccttcctagcaacttcaagaacagtgaaacgtttaggttgtctcatgtacattctcttcgagattttcattaaagaaagctattttcacatccatttgccaaatctaatagtcataatgagcagcagttggtaggagaatccgaatggacttaagcattgcaactagagaataggtttcatcatagtcaataccatgaatttgcttgtaacctttcccaatcagtctagctttgtgtatctgtatattaccatccatgtcaattttcttcttgaaaatctatttacactctatggcttttcacaatcaggtaaatcaaccaaagtccatattttgttttgtgacatggattccatttcgtatttcgcggaacctgttttaggaatcagggcccatcagcgcttcttcgtatgatgtaggttcatcactctctataataaatagatcatgatcatccatcatccaatctccaaatctatcgggttcgtgatggctccttttggacctacgtacctcaggttccacaagtaaaggttctacgactcttcgtagatccaactgatgttcatcctgagaatttggaacatcaccatgtggttatcaaacttctttgagtaatactttactcccacaagtttcttttgaaagaaactctctttccaaaaaagcaccatttcaagcaacaaacactttgttgtcagtagggtggtaaaagtaataacctttggtctctttcggataacctacgtaataacacttatcacatttgggtccaagcttatcagtaatcaatcgtttgacataagcttcacaaccccaaattttcagaaaagacaaattaggaacctttccagtccatatctcatatggtgtcttctcaactgattttgatggacatctgttgagcataaacggagacgtttctagagcatatccccaaaagatggaagatctgtgtgactcttcatcgatcgaaccatatccaataaagtttgatttctcctttcagacacaccattccattgtggtgttcccggaggcgtgagctgtgaaacaattctacactctctgagatgatcacgatctcatcgacgagctttaattgatttgccaagttgattttgtatttcattttggaactcttgaacttttcaaaggattcagatttacgtttcataggataaacataaccatatctactgaagtcatcagtaaatgtaatgaagtattgatagtttcctctagcacttgtcgtcattggcccatatacatctgtatgtataaggcccaataagtcactagccctttcactgtgtccagtaaacggggctttagtcatttttcccaacaaacaagattcacatgtttcataaaattcataatcagttgagttcaaaagttcattactatgaagcttttgaatgcgtttctcgtttatatggcccaaacgacaatgccagagaaacgttggattcaagtcattagacttaaatctcttgttacgaatgttatagattggcatgctttggtttagaacatatagcccattctctaatagaacgctaccataaaacatatcatctcgctcaaatgaacaacatttgtttttgatcaaaaagtgaaaaccttcaagtccaaacatgaaacagagatgatattcttgtttaaagcaagaacatagtagcagttcttgagctccaaaactatgcctgaaggtaaagacaacgactatgttcccacgggcaatgtagagacttttgctccattagccacacgtaggtccacttgtcctttctcaaaagttctagtgttgtttaggccatgcgcatttacacaaatgtgagcaccacaaatggtatccaatacccaaggagtagaaccaaaagtagtaacattgacttctataacatagatactcgaagaatatatattgaatattttcttcttctctagatcttccaagtgttcaggagggtttgatctattcaatttgtccttcttaaggacatctcgaactgaataggaactttgaaggtttgacataactgtcgaaaaagaaagcagaaattaatatgatattcataaattttgaattttcgacaattaagaaaagtaacactatactcaaaacaaatttcctctaatgagtacaatgatccaagatccatattttgtaggagctcagaaaccgaattgagaaacaagtacgaataaatatatgacagtttgatatgatagttttttccttaattcaataaattggccgtaagtgctttttggacatcacgatttatgaatcccaggatacaaccgatcacgaactaatacccgagcacataagtattagactcaagcgaacttgatctacgatatactctcaaaactactaaactaagaacttacttttaagaagcaatagagaggagagactttagaatttagagtgttttgtgtttgagagcttgagaaataatgagaggctgggtctcttcatatagtagagggaaataggattttgggagaatattctcaggatatgcatgacatattttgagactatcctgagaatatgaaatattttgagaatatagaatattttgagaatatggaatattttgagaatatttccataagattcaactcagcaagcccaataactcacaaatatgacggccagatggtgaacatgatgtcttgaaccatccgaagtttaatgcaaacttagacaacaagtataacacaacttcattttctcgtagaacgaggttctctgtttgtgttcattgtggccttgaacatgtctggttaatcatgagtgaacttggagagtatagcctcacataatctcctagaaacggccccatttcacactcacaaggtgatttactagctgcttgtatttaaaaaagtatcctgtaattacttcacatatcttacaaagctaggttcaaatcattaaaagcaaatgcttaacctttacacatacaggaagcactatacatcatgttaggaactaggaagagacaacagtctctcagtgcttataacagatttagtttgatttagttgtccctttgaacctatgtcatgggatctccaatctttgtaggtggggttaccatcaaacttcctcttaggtggtaggctttaaactcattcctcttgatgatcttgcaacttgatctcgatttaaaccttttgtaaatggattcgctaggttgtcaactgacttgatgtaatcgattgtgattactccagttgagataagttgtcgaatagttttatgtcgtgttctgatgtgactagatttaccattatatagggtactttgtgccttacctatagttgattggctatcacagtgtacacgtattgcaggcacaggtttcccccacattggaatgtcttccaagaaattatggagccatttggcttccgctgcagttgtatccaactctatgaattcagattccatagttgatttcgctgccacaatttttttgctagatttcgaggatactgctgcacctccaagtgtaaagatatatccaattgtggatttaaagtttttggaatctgcgatccagttggcatcactataaccttctaaaactgcgggttctttaccatagtgcaagccatgatctttggtataacgtagttagttcaaaactctagttatagccttccaatgcttatgtcctggattgcttgtgtagcgactaagtacatttactgagtgcgctaaatccggtcttgtactgtttgtcaagtacattaagctgtcaattactcttgcatattccatctgttgcacatgttcacaagagtttttggtcaagtgaagttgaggatctactggaatttttgtagtcccattagagtaatgcttgaaacgatcaagtatcttttcaacatagtgggtttgagacaaattaaggccttcattagtactgatgattttaaacccaacataacatctgctagatccatgtctgtcatttaaaaatatcttttgagcatgtttttagtttgatttatgatatctgtgttgctctccaagatgagcatatcgtctacatataaacataacaaaatgtatcctcttggagtaatattgaaatatatgtatttgtcacattcattaatggtaaaaccattagacatcataacactgtcaaacttctcatgccgctgcttaggagccagtttgagtccctataatgacttcacaagtttacacactttgtgttcttgtcctgggataacaaacccttcaggttgtttcatgtagatttcctcttccaaatctccattttaaaaagctgtttttacatccatttgatgtatttcacgatctcgtaaggctgcaatgcctatgagcatcctgattgaagttattctcgttaccggagaataggtatcaaagaaatctaaaccttctctttgtcaaaatccttgtaccacaagcctagctttgtaccacaagcctagctttgtacctatcaatatcaccattcgtttttccttttaatagtgaaaatccatttactccccaatggtttagaaccttgtggtagatctgatatctcgtaagtatgatgttgcaagatagagtctatttcagtattgactgcttccttccaacaaggtgcatcaggggtagacatggcttctaaataagttcttggtacgttttcagctaaaaacatcatcaagaaaccatcaccgaaagatctctctttgcgagctcttttgctccgcctaggttgttcttcaggttcctgttctgtttttttcaacagtaatagtatccaaagaattgtcctcagttcgattctttcgttcagcaactccgttagattctggtgattagggagtagttatttggtgtataatgcctttttctctgcaaaatgaattgaatggctcattatattctcctcctctatcacttcgaactatttttatagttctttgaagctgattttctacttcgagtgtaaattctttgaattttaccagagcttcatctttgctatgtaatagatatacataacaatatcttgtgcaatcatctatgaatgtaacaaagtatttctaaccacctctagtttgcacatattttaaatcacaaaagtctgtgtgaattaaacctagaggtccagttgttctttcaactcgtggtgagggagttttagtgagttttttcgtgtacgcatacttcacatttttcttggttagttttgaattttggaattaaattcatgttttgcattttttgcattgttttataattgacatgtcctaaacgtttatgccaagtagtaaacgactcaaccaagtaagcaataggattttcattcatttcaacaacagaagcagaagctacatttttcggaaagactgtcatttaagacattttgactagtctacctttaacaaaactctttcccagatacactccatgtttcttaagaactaacttatcagactcaaagttaacggcaaagccattgttgcttagcaccattccagagatgagtctttttaagcatgtcaggtacatgcttcacgttttgcagagtaagctcacgtccccaagtcagcttcagaaccactttgcccttaccttccatcttagacatcaccgttttaaaaaattcaaaaaattctcaatccgtctaaagcgataaggtaaaagtggatttattgaattaagattgtaggagcacaaacactgaattgagaaacaagtacgaattttattaaataacgataatgataaattacaataacagtaattaagcacataaagtaaatcacggaggtaagatatgatatattttttcttaattcaataaatcggccgtaaatgctttttggacatcacgatttatgaatcccaggatacaaccgatcacaaactaatacccgagcacaaaagtattagactcaagcgaacttgatctacgatatactctgacaactactaaactaagaacttacttttaagtagcaagagagaagagagactttagaatttagagtgttttgtgtttgggagcttgagaaataattagaggctgggtctctttataacaccccaaaccgtacatcaatagcccatcctattgttttgtcaaaaaaaaaagcccatggagcccacttaaattcaagtgaagcaaatcaataatgttaaagggttttgttacgtgtattgttggttgcacatatatattggtatatctatctccctcttctccaagccgccaaataagaatcttaagaaagcaaatccaaagcatcaacacttgagttctagagtgtggtcgttaccagatcggagagagaagagagttcaaaggtgaaggaaaccgaaaagattcatgccaccgttcctaatctgagagtcaccgcgtcatcttaatcttaaccttaattaaaggtctgccactaccgttgttgttgagtatgttagtcactgtggaacgcttgaaaagaagaagaaaaaggaagagaaagagaagagatgaaggataatcgtgaggaagatgagagaaagcggagacgaaggacgatacgttgcggaggagaagagatcatcaccaccgcaaaggaaaggcattaacagatggagatttcttttgtgacagtaaggagaagtgagatgaagcagatcctaataaatcagaaaaggcggctaggctaaactagaagcatataaggaagaagataaagagaaaagagtagtttcaagttgaggttatacaaggatgtttcccgtcatactagaaagaatcagttgctaaataagacatctctacaaagatcacgtgccatgaagccatagcaactgacagagtttcaatcgggtttatattcgagaagttatacacgtttttttctggacaagtaactgccaaagctgtccaaatctatgctaagtagaaatccagaacagtgtgtgactactagttttgtgatacgttttccagatgtactagaaggaattatatcgatatcaagacgtttatggaaagatatttctttaaggaactcatagtagctgacaacttgtccatcggatttaagctctctctggaattgaccttagaagtttgcccataatcatctcaagttgcagaaacctagatatcagttctgaggcagcatcttcagaagaatgtgggagattcatgtgaaatctgatagagataaaactttgtgtagacgttcatgttgctactgtctaactattcaacggtgggattacattttgcacggttagttattgatgtatgtatatgtttccgagactgataattatggggtaaattgtgatggtttgtgttgttgttttgttaaacgagcttggtttgaagccaaaccttacaggagcttttaagactcagtgttttacttcatggttgatggagagccaagatggtgttcaatagtatgagcttggaagcaaactagtaacttgtctaaaggataaaggagaagagagttgttcttcatcttcaattaggctaaggtgagggtggtatttgcggatatgtagtaaactctttccttatatactttttgatagttgctgggtataggctcgagaattgtccttgttgatttatgtgaatttgtgtgaagctacgttgttagtaacataatatttgaaatgcattggtgacatgatttgatatatttaatatatattaaattacaaaacttcttatgtatatgagattataaaactaaaaagtatgaaaaatatatttaaggatgttggactgtaattgggctgacaggcccattacagatcattaaccgctgacaagcaatgagaggaaggatcgagctacggccgtggtcttccaaaaaatatgcttgagtagccaaggttaataggcttgagtagccaaatttaatataggcttgtgaagccataaagttaaatactaaaactaaaaacgaaaataaaatataatgttgtgagcaagacgcatgtttgtttgtttaattgttagacattctgaatctttgctaagtaatggttgttgattatatttggaacgtttttactgtatgtccagtaggcagagttgatcccctaactaagtaaacttgttttactcacccctttttcccattttctccaggttagtaagtatcaaaagttgcggttgaaatttgttcgttggtgaattttaaataaagaaaagttttggcaagaccggatgaataacacgctatcttagcctgtatggcgggacatgtgttatactctttatatagtagagggagataggattttgtgagaatattctcaggatatgcatgacatattttgagactatcctgagaatatagcatattctgagaatataaaatattttgataatatggaatattttgagaatatttccataagatttaactcaacaagcccaagaactcacaagcatgacggtccacaagcctgacagccctcgagctgacgacgggacgacacgacaacccgcaggccggttcggttcggtctggtttggtccaagtgtcccactttacacccttatttctcattcaatacaactccgtttttgacgcatgagtatactattttgtagtactctttaacagctttccaatacactaatgacccgataattccgttcaaccctttggtcggagtttgaccagaaagtcaccggaaaagttttgtgtcaaaaaagttataacatatttcactagaatccaagtgagctttggcttcacccctaaatatctagttatttaggtaagtaacaccttgttaattatatccagtataattcttggttgtggatgacatctaatgtcttatccaaccctatatctttaagctcaaaaccgttttaatagtttagtcaaataaaccaattttatttcacatggtaactgttaccatatgcctcactctcaaacaattgcagaccactgctttggcagacccgctaaacaacaatttaaattttaagagttgataaaattgggaagacatcaaatacttggtattagctgaggaattaattttataactcaattttatatttaaaatttatatccaatataaataaaatatataatacatatctgatatgtaattcattaaagtataaaatttttaattaatcttaatcaaattaaattattagttttaaaaaaaattgatcttaattaatttttaataattctaatcatattaaaatatattataatcgagttaatcctaatcaaattaggatttatcaaattattattatcacaagaatgattatgatcaaatcaaaatctttacacaaatattacggtaattaatttccctcttctcaagaaagtaaatcacaaaccaaaaatattctataatatttatggtaagaatcttttaaataaggaacaatttcaaatcaacaaaaaatctcattattactcgtaacatgatatatatattatattaaatatttgattataattactttaatccggataaatatggaaacacatatacgatatatacattgaatcctgacattatatttaaatatctatgtataatgattaatggaaatttcacgtgatcaaggtaaatgtctaatcaaacttcataaacacgtatatctttatatattatacctttattaatacttaacattaaagcatatctaatttatattatataaaagttgaagctatttgtttttaaagccatccacataggatttaaaacgaacaatcggaagctaacacatcaataattaacatatttaatatctaattaattaacatttttgaaaataaccaattaggagctgccacatcaataattaacatatttagcatctagttaattaatatttttaaaaatagtaattattttttattttaaaattcaaaataagaaaggaaaataacaaatattaaatttaaacatataaataaagcaagttatataattataattatataatattaaacccaaccttataggattttatacaactaatccaacattttaatataatttaaagaaatgtaacaaggacgtggtttgatggtggtgtttttaatcgtatcaattttaatcaagttctcgaagatataaattgaggtctttcagtctgggaagcttgaaggtgaagaggatctaaactacatcaaaagagagaagtgatatagttaagtactaatttagaagctaaaacattttcttagaataatagaaaacaaaacagagtacatcttgacgagattaaaaaatgcttatactaacaaaaaaaaaagagattttcgaagaaaaaatatggataatgtgaaaagtttagaaggtatgacacatattgattagacaaaatcataagaggatggaaagagacaatgtaagaaaaaattgaaacaaataaaacgagttcttgcaaaaagataggaatactattagctctctgtaaaaaagttgtgaagacagaaattcatatacatattgaaaaaaatatgtgaaaaatatgagttgttaaaaaaaagtatagataagcttaggattatacttctacataatatcttatttttagaagagctatactaactaatgcagcgaagataaacgaaaagatagtaaatttgcgggtaccaaaattagaatcgtcgaatctattttccatacaacaatttatttcatacgtaaaaaacgtcgttaacctaaatatctaaagctaaagagagagtcatgaaccaaaaaaatgttcttttgataaatgttgtaaagaatttttctagttatgggggaaatcaaatctcaaagagagaaaaatatatctttaaaaacagtctccttttttataattttacaactttttttttgtagattactaattaattgtataattttcttaattataaaagtatatatagataacaatgtaaaacccaaaactttattttctgctttctgaatcaaatcagatttcaaagagagaaacgacgataatgtccaatcttccgtcagatttgttagaggaacgatggctcatgcaaggttcttgatgaaagcggcaatatcgacaatgacttgcttggtaaaagtgtgtctttgaagggtaatacttaatggtgtgctttggatatagaacacataggctataaattgttactcagttttgtttttacagcaagaaagatttagacgtgtcttctgccaaatcgaatgacggtcgcgtggttctatcagttcttagagaaaacaaactctcacttctagatatgagttttgttacattaaagattgatatatgggtgaccaataagttttatactgtagttgcaacgttgcagtggaccaaatactttacaatggatacacccattgacattaagcttcctctgtattttgtcagttttgcattcgacgaggaacaaaaaaggctttgtattgtgatcgaattcttaaggaaatggtatacattcttggagatatcgagaggatgataagtatatcaaattctttaattatgttccaagtttgattcatatccagcaagatacaagctagaaagaaaactacgaaactagagtcagagaaaaataaggaagtgatttcttgtggttccacattcttttcttttttgggtatacaatacaatttctttaatctttataacattaaatatattaattaattgattgactgttacaatgaattgatatattatattactttgattcctttcttctttgcattacattcaatttttatttttatttttggttttaacattttttgttaaattttgtcaactctaagactgcaagtcttacgtaaataacgcaacatctttataggtaatttacgtaaataatttatgaaagagtaatttatagtataatatccgaagactgttaaggctcacgttgaaatggccaaagatgttgattcatttcttgcttatccatgaggccgttacaccttcgagatgatgatgaagtagataaaggagagggaaaatgaacaattagctacaacgtgttttgtcgttcaggggttgttgtacgttttgcaattggttgtcttacaagcagctccgtcaattcaagaaggctcagtaatagacgagactatcgagtctgattctgaagaagcggaagacgatgttgaagagggtcctcgagagtccgtcgctttcaagcttgggaatgctaaggacttggatgcaaattgttcggtaaaacatttatcaattatctttgatatctgttaatacaataatagtggataagtatcttgttaattgctaacatttttgccatgtagttatccgtggctgatttgattatcttcgttttctgggacatgttcgtgttgctacgattatttgtcctgatatgttgatggatccgttggaagatttgtcatagtctgatgatgaggaagatgagggtgtcgataatattcttatgctggctggtcagggtctaattttcaagaatgatatgtttggtggtggatgcttcccttcttagatgcaattgccatcttaaaaacaaaagcggggtggtaagtctaatattagtcggaataggaaatctggcaaacctataaagaacaccggtgggatcaggagcaaacctcaaagacccatacctgaggaaggcagtacttcagagtttttgtcgatcgacgctatttcccgtttgttggacgagaagcttgatgctcagaaaaattaatcatcgctggtttgattgattggtttcgcaaaaacactgttattgaaagtgatcgagcgaaagctcctgctagtgggattagtcggcccgagaagtctaccccggttggtaatgttcgagtatccaattctgaagatattggttgtaatgatggcaatgatgagtttggttttgattctctccgccgtccttgtcccaatgttcggtttaacagtcgtgatgcgaatgctaatgtcgattataatgttgatgagattttatcgttttacactgacaaggtttcaagtggtgttggtggctccgagtcggaggtaaatttattgtttttattagcagttaactttgttgtagttgtgaaaatttttgtctcatgttttttacctttacagcgggacggagttgttccaatggaggaaggtaatctcactgagggtgacgtcgttaataaccaacaggtgggttgcttgttagtcgaacaaatttatattttagtaagtatattatttagaatgcaaatcttgtgttagcgtggcagctgaaactataagggttttgtacctttttcatcaatatacattgtgttatattgtttctaggccggtaacgatgctggcgttgacgttgccccgactacagaagctgccactgaagataactcctgggttagttgttaagttctcctctagttaacagtgatttaaacctctaatcttttgtctgtgggtttaatcctctcttcgtggaccccgcatgcgcaattaatattgtttcttggttctagcgcgaggacaacacccccattgatgtggatcctatagatcatgcgggtatgatccatgattcgcaggtgggttgcttgttattagaactaatttataatttagtaagtatattatttagcatgcaaatcttgtgttagcgtggcagctgaaacgataaggggtttgtacctttttcatcaatatccattgtgttatattgtttgtaggcctgtaacgatgctgacgttaacgttgccccgactacagaagccgccactggagataacttcggggttagttgttaagttctcatctatttaacagtgatttaaacctctaatcttttgttcgtgggtttaatcctctctttgtggcccccgcatacgcaattaatattgtttcttggttttagcgcgaggacaacgcccccattaatgaggatcctatagttcatgcgggtatgatccatgattcgcaggtgatgtgcaataaaataaatctgttaattattacaatagctgacatttaattattttgttaacttctacataaaaccattaccctaacttatttgtgatttggtactgtagggcccgaactctgtagatgtagatgccgccccacttctgggcgatgaagaaaacacagaggttgatgtagatgccgaaacccctatgggtgatgaaggaaacgcagaggttagtagttatgtgtgtagtgcactaatttatgttgtaaccaccttttcaattccctcattattcccccttggaatatttaaatttgtaaagtagttggggtaggatcctaaaaatgactcagcaaaagaatagcgccctcccattggtgttggtgaccaggtttggttttaccatactcctacattttattatcttaccaaagataactcttaggttagatgttaagttttttagcgaactatcttttgtcttaacgaccagtttgaacacttactctattttgatctgttaactaactgtttttattggttcagcgtgaggacatgcgctcattgatcaagattctccatctcaatccggcctgttacatgattcgcaggtgaggtagtaggtaacatttgggattttatttcgataagtgttataatagctgttaagttgttagtgagtttacacttatattacccacctaacgcaataatgaattatcgagatgaaagttggttagtaaatgtaacgtcgctgtatgtgtcttgtagggaccggtcaatgttcctgcacgaactgacagcactctggatggtgaagatatttcagaggttagtagtgaggttggatattgcgctaactattgttccaccttttcatatccattcaatctgtaatctttcatatcgaggagaccgtggatattcattaatgcgggtttgtgtctgtagtgctgctgaaaaaggcaattccgaggttagaagtttatgtacttaatgatctaagtattctgttacagtataatattcgcctgtagtaatcgagtcaacttgttgcatagcagagtaactatgcttccgtcaaagtcactcacacccctgcatctcttgttaatgaggttagttaataatcttttctgtatatcttattacctttaatttacccttgattactctatgctttaagatttagaatcgaatgtttgattaatttgaggattttcacttttgtctaggttggcgagattgtttcagtgaatgaatccatactatctccaaaggaatccaccattaacgaagaggttagcaattatcccagtaacgaagtcattatcatcttactgtagttatttgtgttttttttacagcgtcttaccatatgttaatttgcttatagagtcagattcaatgtgctcagccgacaagtggagatggggtccatctttccaatgttgttgaggaacgccaggtaatatggctatattatattagctcgaaaggacatcgtctttcttttgtattataaattatccgttaactctttcatctcttcgctgcgaaggtgtgtcctgtgtcggatgatggcaaggcgtctgcggagaatctggataacgtggttagcagctaaattatcccccatatgatatagtttctcaggcttttatttagatccgattcttgactccttgtaaagattaagtatgggacgataacgattttaggtgctcaacgaaactctctcaaaactgttgcggttgtttgaaatacttttttttaatcattatgagttagttattctactctattgatttttccatattagccaacgctaattttatttctaaaggttaacatttattttaaactgatatattaaactgtatgggcgataacattatacgttgttgttatcttaaaacttgtgttcatttaaaaaactttgcaataggctgccttaccctctgatggcggggttgtattacccccgagggtgattctattgatttattaggaacaaatgaactggttactaagtcaacaagtacctgttgattattcccttacttctttcactgttattagatactacgacatttcaacaggctgtcgccggtaatgaggattctcccagggaaggggttgaaaccccctacaagtttaatatgcaggttaacgaataacctcgtttttaattgataaattatatcttttattatttgctaacgactttgtatacctgtataaataggatgttggcagaggcgctccttctgtggtttcaacagtttgcgaggtatgattttttataagttagtgttctagttcctaataatttatttatcctataaacgtcggattacctaataattttggcgtttttgttgcacatgttaattggtgatcataggattctgacgaggtagtcactaacctgttatccatttaatgttggtgttatgttttacaatttatttaacaatgtttacccattttcaggattttacgaccccccccctcccccttcaaaagctgcaaagggctccctccaggtaaatttgtttgtttatttggaacttaaaataggtgtttgccctctttatttgttaacctattgcgattcaggatgatgtcaatgctactatcccgaacgggatatgtgggagaagaagtaaacggctatgaaccctttctagcaagttagatggtcgtttccagtatgacaagaaaaccaaggtttagttggtcatccatcccttgttctcaaccaagcaaacatttttgtggatcccgaggaacgttttcaaaactctatgaagaaactcaaagcgataaggtttgtgttatctgttataaataattgtagctactaactgatttccattttctctaggtgatttataattgcttatgtatttgtatatggtaacagttctattagcatttgtggcggtgttgcactgtctaacaaagatatcttggatttaattgaccggaaaaaaactcttacaagcaaggtagctgatctctctaaaaatcctaatagttatttagttatagtcgttgccttaattttttatttttttcaatccctaaggtaatggatgccctcatcaaatttagccgtcatttgttgagtaccgatgatgctgatggagagaaacttcgggttgaagtccttgattccaagtttgtttccttattctgctggtagcacctaaattttctcgctgcaactccaaaccggacttccaattcccaccagcttaagccggacttccgactcaaacatccaacgtcgcagagattctgttattcaggcagagcttaagccactagcagtaatggtgccattccttttaaacgatgttctttcaactctaatatgagtaactttctgctggctccattttttgtagatggccaattgacatcccccaggtagcttcacttgatactagaattttttctatattccttatccatactcatgctacaggcggtataactgaatgtattgaatttgatattggcggtcttcaaagtgaagtgaagaagttggtatcggccttaattctcgctggtggttactaactaacttttatgttaccctaatactttaccatttgtgttttgtttccttaccctcttcttttcacctcctctaataacgttgaccttcgttgtgttctcattgttgcttgtagtatccgtgtttattctgggatatctatgccaaccgtcatttaacgttttccagttgtttgatattatctcgttagcgataagggtttagaagtaagcatattgtctcgaatagttattaccattactaataatagatatgggattaattaaaattatattgtattacgaatccacgaaattaccttggtatcgggtataaagctacaacaattctgttgactaacaaaaattaacttatccgaaatctattattaatggataagagattatctctgtatatttgttatccaggtatcttttttgtattcattgtctatcactacctgttagttaatcactggttttaagcctattattttttgtccctaacatgtctaatatatactattgtatcgcgataatatgattcttgtcaaaacataattacacaacgatatcgttatatgtatagttacccgttaacagattattatgataattggttactttttccaagatatttgtttttgtttaagatgtgttaatttactacttctagttggtaagaccaacatcacgatgtcaaattatctggaaacaatgaaacccaacgttttgttaactcgcgatagtaatggtataaccgtgaatatcgtctgtgttatcgcattttcgaacccaatggcgcggtagccgttaatattatactgtccatctggtagccgttaatattatagtgttttgagcatttagtacatatgtgtcagataactgacactaccttctcgcgttagagttatcgtgtttcgatgtgttatagtattactgaatgcatcgtttttatcttaataaagcgatattaatgttattataaacaagtgaatccctttagtaagataaaaacgggataatcattcatttgataacccgatatctgattgtcttcaaatatcgggatatgagcctaactgatatcgcgatgtcgcgatatttgattgtcttcgagccatcgttccttcatttagggacataaacccgaagtagataatgaacccgtctcactctcactccttcatttagctattcttcgacccccccccaaattgaaatctaaagaaccttcaaatcggatccaacgatcttcgatcttcttgttaagtatgagtaatcaatcatctagttcttctggatctacgggacctcagggtagaggaaaagttgttggggtgccaaaaagatgttggtgccgggaaggagtcatggcactcatttcaaaatcggatctgaatccttgccagagatactatcgctgtgggtttgctgcaaaacatagggtaatgttactcatcaagttcacctatatcatagatttattcaatcttcatgtttagcttgttcttaattatgtagattaatgttcatatgtagctaaggaacgatgaacacacttttaaatgggttgataaagctttgctcaatgagatcgaaacattgacagacaaaacacgtgaatttgagcaagagttgaaagagcatagaacagagaggatggtgtttgaaagaatggtttcggagaaactcgaaatcaagatcgagaatgaggttcttgagaaagttgaagaagctttgtctgaagcgaaagcaagcagtattgaataaatgcgatacttttgtaactactaactcgaataatgttcgtttcttaattaaatgttttttggtctaaataaaaatgaagattgtcattggtattagaataaatccgaagtcggctaaaaaaactatgattattatactctaattactaagcaggaccatgagatacaaaatataacaacgtgctcaatatagctgctaacaatggcaatatcgaaacgttaccagataacaagacgaggaatcggtaatataatatcacagcaaaacacgttaacgctaacacgagaaggtagtgtcatttatctgacacacatggataaaatggtcaaaacactataatattaacgactaacacgtcgttatattctcactgtaccattaacgactaacacgaccttgaattttgtaatgcgataacatagacgatgtacacagttattaaaatatcgttattaacattatctttatcaacattaccacttccaggatgttgtgtatgtgatttgctaagctcggctaagtagtttatcaccacgtcaagtttgacaaacgataagaaaatttttagggtgacacactttttaacgagtaataaacaagtaggttgacacacttactaaacaggaccgtgagatacaaaatgtaacaacgtgcttaatatagctgctaccaatgacaatatcgatatgttaccggataataagacgatagattcggtaatataaatcacgatggaaacacgaaaacgttaacgcgagaaggtattgtcagttatctgacacatattaacgactaacacgctttttggattcggtaatgcgataacacagacaatatacagagttataaaaatatcgttactaacattatctttatcaacattaacacttccagggtgttgtttatgtggtttgcttagatcggtaagtagtttatcacgacgtcgagtttggcaaatgacaagataatttgtaggttgacatactaattaacgagtaataaacaaggcataatatttgaaataacgaaagttggatgggttccgatatatatacatttgggaacagatgtcgtacgtatgtacattgaaaattttcttatctcattggttccttatttatttcacatggccaggtcagttcctgttaatcctggcaacctccatccttcaactttgctcgccaaaaaagttcttatcttcttcgttatggttcctgcattcaggatatgtattttaatatcaagtaattgatatgataatccgtaactcttttattaccgtgattggtccattgcaggttgccctgttatgacctaacgacttgcatcgtgagcatctttttcttgatgttctctacaaatgtgtcagaagtttataacctaataagtttagcatataagaattatattagcggttacaagctttagttaagctagttaccttgaactcgcctctggagaatagtcttcgtttcctcgggtgacctggtggtctccaagcatacggtggagctagtttaccccctcccacatcatttggtgaaggagtccgcgtctccgtgtctggaaccggcagcgcttgatatgacaatctagttgaggggtggtgtgatggattccaaccatcgtgtccactaagagtccttcctgtattgccgcggctatggcatgagtgcaaggaatcgttagcagctgaaactccctacaagtacatgttcgttcccacagattaacagcaaatgctgcacctcttctctctggaacttcatagagcccatccccaatttttattacagcacatcctgctcccttctttgtaattttcgatcaccatgtcgtgtacctttggcggtaggatattctcctcaaactgggctgcttgcctccggagtgcaaaccatgtgactagagtagttcgaatggactctaatatcaagattaccggataatctcgtgccataattaacacattgtttagtcatgtagttatacctgtttccaacaaaatgtaccagataatgtttaagttacctttcgcataaatagaggagtgtctgtcggacataaacactaactccggatcatctggtattgctgccgtcagctttgtcatgaaccaggtccaagcttcgtcattctctctgtttacaatcccaaatgcaatgggaaacacttgaaaatttgcgtcttgcgcactagctgctattaagcatcctccagagcgtcctcgtaggtggttccatctattactatcaccttcctcatgtaaggataccccacaacacatgcatgaagcacaaaaaacaagtacttgaacctctccactccagtattatccttttctatctccatggcgacaaaggagttgggatttgtctctaaaagcttcttgaagtagggttggattagtgtgtaactccccatagctgacctcattgcattgtccatagctatttctcttgccctccacgccttccaataatagacgttgaggctgaactcttgccgtaacatccttctcagcacattaggtctaggtccccggcctactccaatatatttcgttctcatcaacttccctataacagccgttgaagcttgcttatggaagtctcctctagcatctacgctacatgtgtgggttgaagttgtgctcctaacctcgaaacgatcgctatccggtaactcgccaaggacatgtatcgctgacacagacagccgccaccacattagatgaaatggaacttccgatgaatcgcatgaattgctagtttcgttgcacaatcttctttgtttttaccttcctcccctgggtcgtcgaaataagatggggcatctctgtcatacaagactgttgcaaccggtgtatccttcacgatcattgcatttctctgtaactccgtaacccttggattatttgaacttgatccaatctccttagagggtaacacgtcttctatcattattgttttccctttatataccattgtgatgggttgaggctccataacgagtgggccgtcattatcagaataaacgtgtgccagtgtttcctcacttgtgagtaaatattggaaggatggttatcgactaacataacactaggttgattagcagataatattgtatgtattaggtaacccacctacgatcgataaggtcatgttgttcgacgattcagtatcatccataaggtcttcgctactgaaagaagcgctcgtggaaattgtggttggagtcccaaatgtcgaatcactcgaagagactgcaactatatgtggtccaacagattgttccactgatcttgcaaggaacaaactcaaactttcacttggtcgtacgtttggctgttcgccacttccgaaatgaagggctctcgctgttttctctttctcggaaacgttttttttctattgtttgagttcctcctagggtcatttgtgttgcacacatttcacgccgcatctcatcttgttgattttttcaccacagctcgaataaccgatctctttcaatatctccgtcatcaataaccttctcttttcctttcaagcttgcaattgcctctgattgtatcaccgtacttggtgtcccggttgttccagctgaaatatccatggtgtctcgtattataacccctgcattcgtgttgtgttggtccttgcctttgcgtatatccagctcggtgtcactccccatgttttgcatatcgtctctgttacctataatacataatattctctaataagctggtatcagctaacctttctgaacacaaggtattatattctcggaaaaaggaaaaatattcaatatatgttttgctgataacataactaaaatcgtttaagtttagagttatcaggctcacctgaaaggttccaaagcagcattcttgttaaagcggtcccccacacagctcttccagtatttatccgctatttccttagaactcaatccgcttagatcaaagttactccgataactattaacgtttcgaacatttccaccccgatttatccttacgcgtagatgcacttcatctagatccgcccttatagccatgaacagagtcatgtcttcgtcgtctagtatgtcgattgggttgcacgtttccaatcaggccccatcatccactgcggccactggtacgtcagctcgatatcgtcgtcaggccccagagctaaccttcttttaccgccataaccactttgacaaacccgtctttctcgctcagtcgcactcccagtgcaaagccatccacatgcgaaacatgttcgaaatatccgttttcatccctcttccattccccaggaactaatctcaccacgaatgccattgttatctgcaggttttccgtaaataacaattttgttagcgttctcataattataacaatagtctgacaaaccctaaagtaaagaactttccaaatgataactttaaagtacaaaatactcagatctttaacttttacctttcagatttcaattctctgtgtttagctccttcttgcatttaagatgtcggaagctaaagaatttagtatgatagtttttcggttgctaacagagtgaaaatatcaccctaataaatagcatagcatgtgtaagtgatatttccgcaagcccgtaaatatcagtaataatttcccatttctttgatgtttccaatgccggcacatagtatcttccaatataacctcgatatcttgagcattaaatggtgaggcagatagactactaactgttatcgttttttcggttttgtaggggtattaacgggataaataaaagcgccgaagagagagggctaaatatgattttattatgcatggtttcttaatttttggatcgtccgagcatagactttaatatcacctttaaaataaagtctatcgttacacatacttataaaatatatgaatataatatcatcaagtctcaataaatttattaatatgtcatcttagtcacaatattaggagtgcacattttagtttcatgttaaaaatgattcgttctaacaatctaactagagtttagcttattatttataatattttaagaagtgacaacaaatatatatatatataatttataatgtatataatttatacattgagaaacgaaaatacaaaaataaatggaagaaatataataaaataatatcggtgtatgggatgtttaagggatataagagatctattaagatttaaaatactattaatttgatcttattatcctacaataagacaaaatttctaataataatacataacgaaagataaagataatttttcttctcagagaatggataacatatattgacttgaactaacatgtgaaacctacaacaatgatttttttataatgttaagaaaagcatatcaatggttgtagtctagatctttaaaaaaaacatttagttttagcgagctgtgaggaaactaggtatttgcagttgtttaatcaaaatggttatctaaatcctaaactatattaaaacaattaataaaaataaaccttcgcgtagcggaggttaataacctagtatataccaaaacatgttgccgtgtcattgtaaaaatttactcaataccataatcaaaatatgacccttaacaaaccgtatatccaataaacataaacgaatttcctctaagtgaattatataattttattttaccatgtttaacgaattaaatttcacaaatttcaacatgataaaccataaaaattatttatctatatcataatatagattaaattagattcatattcagtattaaacaagtaggctctgctacaattgaagaaatttgtaccggtttataacgatttataaaaactaataacgaattctatagccagaaaccgtgtaaataaataattaaatctagatcttagggtttaaatattcctggatattctgcagcgaaaagatgaaccatattaattcgaggttgttttagcactccaagtgttgtgtctttaccggtatccacacgcacaaaatgtgaatcagatctgtaatgctaattcctttgagatcttatctcaaaactttagacaaacttttgtctcttgtattttagggttcttgtgatcaaaagtatatctcactaacgttgctaatatatcatatatatagctaaacgtttaaccctaactaattatgtatcatatataacatatatagtataataaacattttattatatatgcacaaatacaaatatattatatattatattattattaatccaacattaatccaatttgcttaggtgtgtgatcatgtaggtttgtataatattagcaattagttctgactcatatattataagcggtctctagcaaaacattataaccacctaatattatacaaatgtccaacctcgacattacaactttaactaaagtaaaattcaactgatgtcaggacattaccaacattcttatctcgggttctcgcctgagcaagcatggcttcgctatcgagatcgatgcagataagctt

SEQ ID NO: 202 - DNA, 129021 bp, Arabidopsis thaliana
aagcttaacgcggtctacaatcaacttgtggaggttgtcgattatgttagtagcagaggttttccgaatcagagatttgatcaccaacaaggctacagaggttcctatgggaatggtccaactagctacactcagaattctcagttccagcaaccgcttcagaatagcaatagtttcagcttcagaaggaactatgatcttgcttcttaccaagccccccccccctccacccacacctaaaagcaagatagaatcactgctggaacagattctggaaggtcaacagaggatcttagagagacctatccctagatggaatgagagcagcctcactacttctcggcattctacttcaatggaaagtgagtatgagttagtgaagattgaggagagtgacgattttgcagttgcagaggcagtgtcgatcgacaccatcgcatatatacgagacatcaggctgtgacgaagtagaatcgaccaggctggacattaatctccagaatcgctcgacacacattgatagtgtcgaccgacaccacctgggtcaaaatgtgtcatgtaaacctataaatacagtttatatatctaataaaagtgtgtggttttcgttttacaaaaacagagaaatatacagtaaaacaaaacagagtaaaatatatgttgtccgatccttaataaatttgagagttcaaagttctacatatcttagattaaggcgaggtcaagttctccaaaaagatgactctgtgggcgatctgttgatatattattccatacgagattctcaggaaatcgtccctgaggcgagctggactattccaacggattgtagtcttaacaaactatttatgatacagaaaaccagagataactctttgtagaggtaactgatcgaggagtggttcagttctctagaaagctaatatccggggcaatccgtgaacatattactggttgcgagattcattgagacttgtcggaatgtcaatcccgaggcagagtgatctattcagacggatctgtaaagaaacagacagtaacgacttcagcaaaacagtgataactctgagcggagatatcggattgaactatggttagattccatggaaagctgatctccgtggcaatccgtgaacatgttcgtcgtcacctggttcattggactttgacggaaggtcgccccaaaagtagtcggattcgattgtctttgcttgttgagcgtacatcgaatacttggatgaatgatatgcgaagagaattttttgtcgttccccacagacggtgccaattgttgaaccaaggattcacacaatagatttgtttaaaagggaaaacaaattaagtaagttctcttcattaggtattccatccaagacttgattacaaagactattctaatatcttgtgaaaaacgttagagttttcctcaagaacaaagaaagaattagggtttttagaaggtgttgcatctatggtggattgcctacgtaccatgtgaagggatgaagccatcgtagttctcattaggtataaagttatgtgttctttttgagtattgaattatctcctttgctaagttgttgataataggtttttagtcaattatcgtaaaacaccaatcctgtcgttgtagtattttaggttgtcaatccaaatgggtgtgatgctaacaatcaagatgtgatcagaagtcactaagtcaagccaagcaataacaggttttggggtgttctaacagtcctaagtgaacatgcaggaaacagaaatttaagcagaaaaaataaaacactcgaccaacacagctcgttgcagagcatagggtgtggtcgagtgcctggtcgagtaacaagcagtaaaccaaataaagatactcgactgcacaatctgttgccaaacaactgggtggtcgagtatcaggtcgagtaacaagaaagaattgtagaaactaaacaacatgtaacaagatgcagtaagcaacaatagagtaaacaaagaaatcaattagataataggtttctaaggatgggttagagtagtttagaattctctgtatgctaggtggttgagtttgattgatagatcccttctggattaattgtttttaatgtgtattgctttttgatcaactggaatttgagcacagacatttccgcgcccaaaaggtgttcgatgaaatgtctgaaccactaattccagagatttgtggctttgtaccaaggtattggttgcagagagcgttttggctttaacttgttgattcgtaatgcctgttaggtaaactctcgtcaatggtgattgagtctgggactagtttaacttgagggtctctgttgcggtggcacttatatttggttaccgaacttgttgtatagggataatttattgagcatgtcaatcacctataaactgaggaaataaaagtactcaattaccccatcctcgggaattctttatctaattgatttctttgtttactctactgttgtttactgcatcttgttacctgttgtttagtttctgcatctctttcctgttactcgacctgagactcgaccacccagttgtttagcaacagactgtgcagtcgagtatctttgtttcgtttactgcctgttactcgaccagtcactcgaccacacctagtgctctgcaacgagctgtgttggtccagtgttttattgtttctacttgattttctgtttcctacatgttcacttaggactactagaacaccccaaaacctattattgcttggcttgacttagtgacttttgatcacatcttgattgttagcatcacacccatttggattgacaaccgaaaatactacaacggcatgattggtgttttaggataattgactaaaaacctattatcaatttggcgtcattgccaattgggtgtttctttgttacatttgagatttcagacttacttatatcaagttctttttcaatattcatttcggttactgactgtgtgtttttcttgttgtcttcttgattcaggtacacctctgttgtatgcaaactccatcaacaggcaaccagaaccttcttttcaacgacaacatcgaccgaatagctcgtgaactcaaggaaaggagaaacacagtcacccttttaccccagcaaccactcgaaatggctaacgaacaaaatcaacagaatggccctgccaacattggtgctggagatgcaccacgggaccatcgtcagaggaaaggaattgcacctcctgctatccagaacaacaacttcgagattaagagtggtctcatatcgatgattcatgggaacaaattccatggtcttccaatggaagatccacttgaccaccttgactaacaaaaatcaatggtgtcagtgaagacggattcaagatcccgttgtttccattctccttgggcgacaaagtacacatctgggagaagaatctgccacatgactcaatcaccatctgggatgattgcaagaaggcttttctagcaaagttcttctcaaataccagaactgcaagattcagaaatgagatctctggcttttcacagaagactggtgaaaacttctgtgaagcatgggaacgtttcaagggttacaccaaccaatgccctcatcatggcttcaagaaagcttctatgctcattactctatatagaggagttttacaacgcatctgaatgcttcttgataccgccagcaatggcaatttccagaacaaagatgttgaagaaggctgggaattggttgagaacttggctcaatcagatggtaattacaacgaggattgcgagaggaccatcagaggcacagcagattctgatgacaaacacatgaaggagatcaaagcgctgaatgacaagctggacagaattctacttagcgagtagaagcatgtgcacttccttgttgatgacgagcagtatcaaatctaagatggggaggggaaccagttagaagaagttagctacatcaacaatcaaggtggctacaaaggatacagcaacttcaaaaccaacaaccccaacctctcctactgcagcacaaacgtcgcttatcctcaggaccatgtgtatcctccacagcaacaacaaggtcaaataaaaccttttgttccctacaacaaaagttttgttcccaaacagcaatttcaagggaactatcagccgcaaccaccacctggatttgcaccttagcaaaaccatggtcctgctactcctgatgctgacatgaaacaaatgctacaatagctgttacagggacaagcatctagctccatggaaattgctaagaagttatctgaattgcaccataagctggactgcagctataatgacctgaacgccaaagtggaggcattgaataccaaagtcatatacttggaaggacaatccgcatctacctctgctcccaaagttacaggacttccagggaagttaattcaaaattccaaggagtatgctaatgtttatgctatcaccataaggagtggacgagagttatacactagagagagacccaagtcagtcactgaggacagtgcataccaagatggggaggatttcagtctcaataaagatgaagttgacaaaccaactgaagtactcgagcccatactcgaccttgatactcaaccaacaaatccattaacatcatccgctgctgtaaaactagttgctggtaaaaacaatgagacaacattcattccttctccttacaagcccccacttccatttcctggtcgacacaagaaagagttaaaagataagtacaaagctatgtttgccaagaacatcaaggaagtcgaattaaggatacatattgctgatgctctcacgcgtattccggattcccaaaagttcctcaaatacttgatcatggagagaattcaagaggttcagaaaacaacagttctgagccatgagtgcagtgccatcatacagaagaaccatgtctcagaaaagctaggagaccctggttcatccactcttccttgctccctaggttcattgactttcaataaatgcctttgtgacctaggagcattagtaaatctcatgccactctcagtagctaagaggttgggtttcaacaactataaatactgcaatatctccttgatcttggttgataggtgtgttagactacctcatgggttattagaagatttgcctatcaagattggaaatgtagaggtgcctagagacttcgtagtgctaaacatggatgaagaaccaaaagatcccttgatcttaggaaagctctttttggctacagctggagcaatcatagatgttaagcaaggaaagattgatcttaatctggggaataattttgaaatgaagtttgatatcaataatgctatgaagaagccgacaatagaagaacagaccttcttagttaaggaagtggatcagctagcttgtgaactgctagtggaacttgaagaagcaaacaattcaaaaactgttttgaccaagagtggtaaagctgggtatctccctagtgaaactttgagttctgagaagtcattagactcacacaaggcagcagttggctcagaggtttacaaaggcttgatggggtctgatacaaaggttctgaaagctaatgaattaagttcaacacatgctcgaccaactaattccaccaacaactcgaagagcggtgctggccgctacatagctgatgaggtcgagtacccacatgctggagctgacacagaacagggcggctcgtctatggcctggaagcaatcacaggcagccattgatgaccaactccgttaattcttcgactgaggtaagcgcctcacttcaccattgtattatatcatctcttgtgatttgttctttattttgtttctgtgattggatttgtcctgagtactctcttccaagtttggtcacacagtggactgtgtgatttaagtttgggagagggctcaggaagtgtgtgttgcattgtatatactcttgagtctgcattcatcttaggcatagaaaaaccaaaaaaattgaaaaatttcagaaaatgatttcacaaaaacaaagtgttcatgtagttgcattacattttggatcgagtctagagtgtttcatttaggattgttgcatatgcataagggataatgataagataaccttgtaagcattttggttcaccggataaactaagtgcccgttgctagttgtctattgcatagtcaatgaaattgaagtaaaactgaaccatacctagattgctccactcgaccacactgtcatgatctgataccattccctatcaatttgaacctgaatctgatctttaatgatcacgtctgcatcaaatttgaactcatagataccctaaaatacttggattttcttattcattttgatcactcttgttaatccaagtagctgactctccttattagagcagttaacccgaacccaaacctagactttgtttcaagccatatatcacttgtgagtgtttgtgaggtcttattccgattaagcttggtagaaagtgttaggttcgtaacgttagagatagtgtctcatgtagttctagttcgcatttttcggactagataggactaggtgggcgcttatactttgggttgggatgtgtctaaaaaaaaaaaaaagggttgattcattgatgagaaaaggtaaaaaagtctaggtgaagtaagctaaagatgcagaaaaacaattctggaaaagactgttgggattacaaggaaagactggtctacaaagctcgatgatgcattatgggcttacatgacagctttcaagacccccattggtacaactcctttcaatcttctctatggaaaatcatgtcacctacctgttgagctcgagtacaaagtaatgtgggcggtaaaaacttttgaactttgacataaaaactgctgaagagaaacgattgatccaactcagtgacctcgatgagatccgtttagaagcttatgagagctctaaaatctacaaggagagaactaagcttttccatgacaaaaagatcatcaccaaggacttccaagttggtgatcaggtgctgctgttcaactctcgcttgaaactcttgccaagaaaacttaaatccagatggtctggccccttctgtatcactgaggtccgtccttatggagcagtcactctaactggtaagagtagagatttcacagtaaatggtcaaaggctcaagaaatacctagcagatcaaatccttccagaggtgacatcggttcatctccaggaacttcttcacgattaaaggagtaaaggagtcaagctaatgactttaaacaagctcacttgggaggaagtcacatgactatctctgtaaataaatttttattttcttgttatttttgatttgtcttagttgtgtttgttgttctcaggaacaaaggaacaacgtggagatagagtaaaaattcaaaacttttactctacagaagacctggagatcgagtgaatagcccgttggagtacaaaattttgaaaatcttctgttgcacctggagaccttgcactcgagtacatcggtcgagtatgtgtgatgtttaaaaccccaaaacttttaaatcattatcttactcgaccaacagaagctatagagtcttacaaggagtttatcaagtttacagtagatttcctgcagtttttccagtcaacagagtgtggaccacgcgctgaggataagatggagagagaatctcaaactcaacctagccattccttttgaaatttcactcgaccatactctcttctgttttccaccactcgatcaaaacaatcaactccacctcataatccctagccgcactcgacctctgccgcctcagccgagttcaacgattcactcgacccatctgtctactcgacctccgagaatcactcgacctccgtgccgccgttcaccagttcatttcctctgtcactcgaccttatcacttcgccgttctcactttgccactcgaccttctctgcgccgccgcaatcgagtactcctcctcgttcaccgtcgaagtctcagggaccactcgattacgacaagttttcactcgaccacaagttttcactcgacctctgcaacagcaactcgaccttttgttcttgaaatcaacaaagccttccaacttcagaaagattactcgacctctaggcttcaccggctgaactcgacctccacgcttcactcgactccctggagcagatccactcgaattcagagaagttactctaccacggtctgtacattactcgatccaattcgtctaaggggaactcgggaacagctcagtttacccgggtacagaattgtacttgaccaattcggctcatatcattgcatgttgataataattttggtttcactgttatctgtgagactaacatattgacatttgagttttgagttctaaatttctacaggagaatcatgagtaattacagtggcagttcttctgttgatcctgactacaacatggaagagacaaagtcgtcgtcttcaaggccaaagagagaacagagagaatatgatagtttcagaagaaaagctgagatagcccgagggaaaagagcgatgacagagaggtatgagcttatagatgaggatctggaagacgagtacatgcctgagcatactcgcagagccaccaaacttctgtacaaacctgatgtattgcctgctgaggaatatattaggctcttcaaactgaatgagttctgcagaacgaggtacccttgctcgactacacttgcataactcggattgttagaggatgttcagcacatgtaccagagttgtcatcttgacactctgatggcgtatccatatgtggcatatgaagaagagacaattcagttcctctccacactgcaagtggaactttaccaaggtatgacctctgatgaattggattgcgaaggattgggattctagcgattctctgtgtatggtcatgagtataggttatcaatcaaacgcttggaagaattgtttggtttccctagtggaaggggaactaagcccaagtatgacagagaagagttgaaagacttgtggatcaccattggcagctctgtaccgctgaattcttccaggtcaaagagcaatcagatacgtagccctatcatcaggtacttccagcgttctatagccaatgtactctactcccgagtgatcatagggactgctactaattctgatatggagatgatcgctatggctttcaagggaactcttcgccaaactaagaacggcatgtctctccaaggtgaaatcgatgacacacctctctctgtacttcttctgatccatctgtgtggatacaagagctgggctgtcagcaataaccacaagagagcacgaggcgctctgtgcataggtggcgttgtgacaccgattctgatcgcttctggagtcccaatcacatctgatggactcgagccacgagcaatggatatcgagcatctacgtcactacaaactcctggagttcgcaatggttggcgacttgcaccagttcaggtttgagcactctacagataagagagctagcatccttctccctagccctgaggttacacggataatagagggatataacattgattttcggccagagattggacgcctctactatgagaacgctccgccattggatgaagatgatcttctagaagaggctgctgaggatgggatggatgaagacagagcagtggagttcgacactagcatgtatcactttggtgaacatgtgcctccagcaaaggagagcaagagcttgagtgaagctcataggaacaaaagtaaactgcagaagtggtgcaagaagcaggacaagctgctcgccaagtgtttcaagactatcaagtttctgacagataagctgagttgttcctgctccactactgctattccacagggacaacctcctttagagatgccatcgaggagattggatgagcctcagcacaggcctgagcttagtcagcagagagtctcacatgtcccggctaggcattcgtcattcgagtcccgggagcacaagagaagaaggaaggctacactcactcgatctagcagcagatcacgcctaattcactcgaggagatcactcgaccgcggtgctggcctcaacagaaggagagaggtcgagtatcctcagagcggtgttggccgccacagagctgatgaggtcgagtacccacctgctggagctgatacggaacagggcggttcgtctatggcctgggagcaatcacaggcagcccttgacgaccaactacgttcattcttcgactgaggtaagcgcctcacttcaccattgtattatatcatctgttgtgatttgttcttcattttgtttctgtgattggatttgtcctgagtactctcttctaagtttattcacacagtggactgtgtgatttaagtttggaggagggctcaggaagtgtgtgttgaattgtgtatatttttgagtctatggcatagaaaaaccttgagacgaaaaaaaaaaaattgaaaaatttcagaaaatgatttcaaaaaaaaaagagtgttcatgtagttggattacatttaggatcgagtctatagtgtttcatttttggattgttgaatatgcatagggacaatgatgagatagccttgtaagcattttggttcaccggataaactcagtgccctcgttgctagttgtatgttgcatagtcaatgaatttgaaataaaactgacccatgcctagattactctactcgaccacactgtcatgatctgataccattccctatcaatttaaacctgaatctgatctttaattgtcatgtctgcatcaaatttgaactcatggataccctaaaatacttggattttcttattcattttgatcagtcttgttaatccaagtagctgactctccttattagagcagttaacccaaactcaaacctaaactttctttcaagccctatatcacttgtgagtgtttgtgaggtcttattccgattaagcttagtaaaaagtgttaggttcgtaacgacagagatagtgtctcatgtagttctagtttgcatttttcggactagataggattaagtgggcgcttatactttgggttgggatgtgtttaaaagaaaagaaggggttgattcattgatgagaaaaggtaaaggactctaggtgaagtaagctaaagaagcagaaaaagtctagtaaaggttttgggatttataaagaaaagaaagagttctttttagctattgaagatgggcaatagccctcggttttaaaatgttaaaaacgggaaccttagttgttaaagaaatccaaaatcagctagatgtatcaaagtgttgagaaaacttctcctagagttaagagaaaagaaaagaatggttagaaaaagggcataaaggattcaagaattcaaagggtagagttaggttcttatattgggattggagatgggattaccattagagcttcatttgatatactttgggtagatgagatcttatctctgtatgcatagcttgggatttacctttagcattctaataaagcttaatcattttttgagagatccccttttactgaagcctattctgtaagagaccatctttgtctcttgaccttttaccttagccaaatgagttcattgatgatgcattgcttgattcacgttccagaactaatgaatgttaatgggattggtagatttgaaaacatgtgtaggtcgagcatatgagtcggattgattgataataaggcatggctaacatttttgagtagaattggatcatatcgcagcttagaactatcaacttggacattgatttcatctggtttatcttgtgctttggctttgagtccctgctttcaaacctcacctccagcttgttcttagttgtttgcttgaggccaagcaaagactaagtttgggggagttgataagtgtgtattttgcatgttttgaccatccatttgtcatcactttagcaccatatcatcactgctttataccatttgtcatcacttgtcatcactttacatgtttaggataggtttgcatgcatgttgcatatttgtgttgatttcaggtgatttggagctgttaacgagctaactggaagagtggacctgatcatgtcaaaccactcgacccgaaggtcgagtagaagtttcatgacgtcaacagaccactcgaccccctggtcacctgaccatcactcgatcacatcactcgaccccgaggtcgagtgtcttcacctccattaccagatcaccactcgaccacaccactctacctggaagtcgagtatcaccatcaccaccacttgactacatacattgcgagcttcagagtcttcttcattccgcactcaaccagacactcgagcacaaggaagaaaagaagactccagcatatcactcgaccacctgggtcgagaacaattcttaatccgacctagtactacgacgttttgagtattagggtttcagaatattttgctataagtagcatgtaccttacattttcgaagtaagtttttatctagttttattccgcagacactatgttctagaccttttgtaatccggatttctctttatctattcagtattcagtatttgttcttgatttttgtttactgttgttcatcctgttatcttctttttattactctgctgttatcatgttttcattccattcaacgtttatgttttctgtaatgatgtctgagtagtgaatagatttctgaggatgggttagagtagtgtagaattctcagtatgctaggtggttgagtttgatttatagatcccttctggattagttgttcttaatgcctattgctttctgagaatttgatcaactggaatttgagtccagacatttccgcgcccaaaaggtattcgatgaaatgtctgaaccactaattctagagatttgtggccctgtacaaaggtattggttgcagggagcgttttggctttaacttgtttattcgtaatgcctgttaggttagctctcgttaatggtgattgagtctgggactaggttaacttgagggtctctgttgtgatggcacttagatttggttaaggaacttgttgtctagggataatttattgagcatgtcaatcacctgtaaactgaggaaacgagactactcaattaccccatcctcgggaattctttatctgattaaattctttgtttactctactgttgtttacagcatcttgtcatctgatgcttaatttctacaattctttcttcttacagcatcttcttacttggctttacttggtgacttctgatcacatcttgattgttagcatcacacccatttggattgacaaccttcaatactacaacgacatgatactgctttaggattaattgatcttaaaaacctattatcacttgtatcgatcgacactgatgtgcgtaagtcgataccaactctacaacagcaagatctaactcgtccttagcattccattctttccagctttcctctttagctctgaccatgatcgtgtacaggtcttccttggattagtatcagtggtgccaggaagaaaaccctcttgtcttttgatagattgagcattttgagctacttgaacatctagcttcttcatgtgagagctcagattgttgatcttcccattatgatctgtgtaaataacgtcaaactttccattgaagtccacaactaacatggacggttcctcaagaatctcctcaagcattgatttcatcttattctcaacaaagggtggaggaagggtttggtaggaagaattaccataagtcctagtgaatttgttctgaggataggtcttctagaaggcaggttttggagtgaaacctgaagaactctggttccctgtaaacctgttgccacgttgtcatgtggcagtccaaacttcctataaccttgaccatcaatttagaagaatccttcttctgtttctggctcatgctcaatggtctctgcttgagtagcaaagtgtacatgattcttccctgtaagcaagttgtgaactgaatctagcttagcatgtccctcagccatttgactccgttgaaacagctctttcaatcttcctctcgaagtcagcgttcttggtattgttgctacatgcaaggttctcaatcaaaactgtagcatctgtcggatacctcgtattgaagttaccattgctcgctgaatcaagagccatatggtatctccaatcaactcctctaaagaaggtacctagaagttgtacctcactgaagtcatgatgtgggcagtcttgttgatattccatgaagcgaacccaggctgctttgaaagattctgtcggaccttgagtgaaggtagacaacttgctttgtagcttctcatacttagcatcatcatagaaattgttcaggaaggttatcttgatgcttctccaagtagtaagtgaaccagccttcaattgcttcaaccaagaacccgcttcccagcaagtgagtaagggaatagcttgcatagtaagtagtcttcagagactccattagccttaatgcttagtacgaggtcctcaaaacgctcgatatggtcatttggcggttcgtgacataagcaatggaaagggtgttggcctattagtgcaaagtagccatgcttgagctcatagtcatttctctgaaaaggtgggggtacgatcgcttgccggttagcatagaacatgttgggcctgttgaaatccgcaagagtacgacgttgttcagtagctggtagattagttgcggcaggattctttggttggtgtcgatcaacacccaggtgatgtcgctcgacatctggctcttactcgttctgacccgcgggtgtcgctcgacaccgagccctgctgcgtttctagcagccaactgcgcgcacttggtcctcattgatgtcttcacggtggatgagtccatgatcattcaatctctatctagcgacattgtaggcttgctaatcttcatccctcaaaactccttgatgatcagctcttatgactctgtcagccattgctaatttctaagtttttcggtttgtgcgttctagtattcccaaatctagcacaaataagttgatcaggtccttcttgtgagtctagtgatacaccttaaacgcgtgagtatctaacacagaaaagaagaaaaacaagaaatgcgtgagtatccaaactaagcctaatggtaattcccaagaactttggcaacgacaccaaatttgacaataacaatggcggtggtggtgatattgttcggggagaggggtggggggtggggtgggggggtggggggttgagggttcttgtgtgaattgatttggggggttgagggttcttgtgtgaattgatatagtataattcagtcggcaaaactaaaacagagtaattcagaacttgagatgtgttatgcaagagagagaagagagataggaagagagaaagagggcaaaactgggattaatacatgagatatgtaaaatatcaaccatttttttgttaggtgttagtttttgaattttaatatttttatgtgtttcttttacaaattttctctaatatgtgtcactttacttgaatttttttaaaatcatggattgtgcgggacgcagggaaatcatatatatgaaagttggccaactctctcccacaacttgacacatcagcacataagagtttgccatctagacttcataaaataaataatacataattagtaatcaattcaacataaaaactaaaataggaggatataattaatcagaacttgaacatcactctttctacatttttttaattcaatatatcctctttaattttgagatccaaacatgttacacatattccttgcctaaaaattagacgattattataaaagaaactaaatgaatatgcagattaaatatatctaagcttttcgagatttatgctaagaaaacaagtaatttgaaagatgtttgaggagctatccttatgactaatacgtaagatataagattatgacaagaacttaactaaactttccaagaacatcaagttgaatatgattagattggatatgcagaaacatgattaataaagacatgttatatttttaatgtaagaaataaattttctaaaatttcaccgtctcacaaactaaatatataaccaaaagaacaaggatatataaataaataaataaactgagaatctagaacaacaataaaaaacaactcaagcactttcgttttcagatgaactaatatagttggagtttttgaaaacaattacaaatcatatttttgtttcaaaaccgatgcattcaactttactttatatgaacagacaatatataaaacaatttgtaaatagtaatacataaatccgcacgtagtgtgggtactcatctagtttcataaaatctcaagattcttacgcacactaaggtgccaagtccatatctttgaagactctttctctcatattattaaacagtactcaagaaagcgggataggcggccgtttaagcgtcacccacctaggtgtttggcgtctatgtatagcttcgattttcttaaaatcggatttattacgcggtggagtagatttggcagaatatgcgattaaacggattaaacggttattaggcggggttaagcggggtaggcagatctaaatgtgtcttaatatttttaagcgtctatgtacagcttcgattttcttaaaatcggatttattacgcggtggggtagatttggcagaatatgcgaacattaagcaaattaaacggttattaggcgggcttaagcggggtaggcagatctaaatgtgtcttaatatttttaaatttttgaaaaatatatttaaaattgtttataaagacacatatctattttattattttatttatcttactttaaaatgttaaatttatattaattttgaaaattttgctaatattcagtttttttataatatttttttccttcatttcaagtagtagtatataaatatatatcattttattctaaaaccgtttaaaccgcctaaaatcgtgtaggcctcgactgagcattctacgcgttaaggggaattgtgaactttttgggaggtggtacaaccactttttctaggcacccccatcattttaggtatttgtacgaatgtactgtacctttccaaagttcatgtggtgactttgtagtcatcttacatggtattctgttgaggatgtagttagtggtaagcaaagcttccctccctctcgcccgtttttctcaggcgattccgttaacatcttatatattaaaggagaagtttaaagtgctcacgttcgctctgagattatgagcgtggtatcttttgattttccctatgataatattaaatctctcaaacgaatgtgatatagctaattacgttattaccttccatatattttacgttattatcttccatatatttcagaaaattagactttttttttataagttaattatattttcaagttttatattaatacatttaaatgttaattgatgatgtagttttgcttttattgttttatttttaacttcggtttagatattatacaattatgataaatacaaatcttaatattctattatagagtcggtttgttcgagcctatatcatccattatcgacatactcacatattcttaaaacctttcatacttattattatattgatcatggggtctattcttcgaattactttgtttatctgagggaaattaatcctgctctagaccgatacaagattaaaatacgtgtggttaggcttcggcgagcatttaaatctataggtattgttgtatttaaatctttggcgagcatttaaatctatagttgttgtggatggagaggtattgttgtattttttgttcttaactatttgttgttataatgtatatgttgtcttttatttgttattttttccaatctttgtattattaggaacgagaattcatgcgtccatcgaagagggtttcgttaagaggtttcagcactagtttattagtggtgaagccagaataatcgacactttcaattttgttgatcatgatggtaactataggacgagtcctttctgtttcaaaatagtcttctattgaattactacggtgataccctgtgacgattttccatctcaagttcccgagaaatattttaattaaggagtttgctgaaattttgtctgggaaattagacaggcagatattgtttggtttgtattaatattttaattggtatgtttttttatttctactttttactagcattatgccccctgctatgcagagagaaaattacacattagttacagtaaataagtgatttataccattaataatagcaaaagaacaaaggtagattttggactataggtgaagtcgaaacaaagactgtcaatccaaactaaattcatatatttcaattaaccaagaatctaaaacctctaaagaatcacagaatgtcaaaatatttaggttagcctaaattctcaaagtgagatgacattttcgtgatccaaaaaatacatgagattaaatttttcagttaaatatttttttacagaggaatgaaagaaatttaaaagaaaatcaatcattgtctccagttcatgtgattagcagtaatgaaatgaccaaagatctgtacttaagattgatgaatcaaatttgaatacaataagataaaagagattgtggtcatttttagtcaacatggagtactatgaagtagtggagcaaataaaggaggataaaaatcgtatgttaagtaattcaaatcatagagatattacgtattagggaagtagattatgcatattaattagggaagtagatgtcccttgtaatattttctgaaaatttatgaagttgtcgagaaaaacatggagtcgaaaatttatgaagttgtcgagaaaaacatggagtccgattggtgacctataaaggaatacatggaataaagagtaacatgactaaaaagaacaaacaggaaaagaaaaaaatgataaaataggaatgaagaggaataggtgcagaggaaaaaaagaacaaatgttactgtaaatgataaccaaaacatagaacaaatagtaacaaaaattaaaaaataaataaattattttttaaataaaatattaaacaaaatagccaagttatcatagactcaaacaatttcattgccaagttatcacgtaacttgtatggcttggttttctttcttactataagttcacaaaatcagagagttaattgtcgagtacttgatttgcgtttgaaaatatgagatcaactatttataaaagcaaatgatgtaattgagaactgataaccttggcatgtctttgggttagtcacgatggtataagatttttctttttctgaaaatgtttcacagggaaccctaaaaatgaaatccatgtcttgttacagtcagtttctcaaaaatatgtgattagatgagaattgtaataattcacaaagtataaagcaaaataatgttaaaactgaaaccagaataataattgcaaaacgaagagacatatgaatctcgagaatatgaacaaattgataccttaattacaattacacttgttttgttcttcagccataattgacatggaaggggaaaggagagtgaaaatgaattatggttcgagagatgaaagtggacaaaaatactgtaaaattgtaaatctgccatgacgtggagatggaggaagagaaagtaattgatctgaaagcgagaaatttgggaatcgtaattagaaaatccgcgaagaaaattaaacaatataattagcaagaacagttgcaagagaagatcgtgaggaagatgccgagaaagaaggaaagattttgggattaattttctgtaaaatttttattaatgagtaactaattattgttttacgcttcaaaacacaataaattgttactttgcttacgtgtcagatggagagagtatcagttattgtaaaagtgactgttgatttagtataattagatttgtttggttccactaaaacaatgggatagctaataaatcgaatactttaaagggtttcttctatgttggggcactttccaagtatttaagcccatttagagcactttgaagggagtaggcactttttggagattttctattgtttaataaaaatcaatacaattctacccctgatgacgtcaactgttgcgctagctatggttaatgatatgtcccggtttttactgatttctaacacagtttcagaataatttttagagtctttctagtttttttcgtacgttttgagtcattctaggtacactcagacatctgggaactatggagcacaataaggaattttggaagcttttcagcgataaagatcttgaaggacgtctttcagaagctggtgttgatcgacacagacttgctagttttagattgatcacctagaatttgatattagataataggtattcccgccataggtatttgttatttgaaccatcatagatgagcctacgcatttaagaaagaacagataggctcatagaagggcgtttagatactaggtgaactaatcaagcttattaacaatgcatgctttagcataggatttctcggcttctccggttatctaagttgtaagtatagagagtttcgtggaaggccaccggttactctagaattatagtttgagtttgagaacggtgcgataacaatcctgatattagctagatctacaatttatttatctcccgggaattccttagacctgacgctttaatcacttgaatctacaactcatttacttgcttatttgtctttattattcaattacttcatttagcttattaaacaacatcataagtctattgtgtgaacatcgagagctcagtggaattcgacccttaagtgctaacaacgatctcttaattgagggagtaagcttaaggtaatttgagctatatcaaatttggcgtcgttgccaaagttctcttttagttcaccattagactaggtgtccttttaagcctaaatacaacttttctaccacctattcacgtgattttttggctattggtctcttgtgtttcaggcaccttcagattgagactcacgttttcatgggagattttcacgacggtgtcgacagacacaactctggtgtcgatcgacaccctctgcagaaccagacggctacaataggcgattttaacagaactgatctcttctacacaaatcgatcagtattcaagctacctccttttgaaagagatgactttgctatacaccctgcctactatgatcttgtatctagtgcaaagtttagaggagctcccgatgaatcaccattggatcatttggaagtcttcgaagacatcgtttcctctattaaagaagaaggtgtaccagctgattacttactttgcaaactcttcccccactctctcgcgagtagaggaacatcatggttgcgtcaattggaaccaggttccttaaccaattggactgatacaaagaatgcattcatgaatcatttcttcgatgagtccgtgatagaggcaattcgttttcaaatttcttctttcacccaagctctagcagaatcccttagagcatcttggctccgattcatgtcttatcagcgtgaatgtccccaacatggtttccaagagagccaactcatcaacatcttctacaaatgaatagacaagccataccagattcaacttgatgcagcgagctcctgtaacttcatgacaagaacaactagtgaagcattaatcctaatcaccaatgctttaactggtcattcgacgtaggaatttgacaaaaaaccaagcatttcagctgagaaagctaccaagagcaaagacactcatgtttcagcaatttctgctcctatcccagcttcttgcaggccaaacagagcttaaaagccaatataattctctatccacagggtttgacaatctacgctctcaattctccaatctctcatctccatccgctactatcaatgtagttacactacgcagcggaaagcagctcaacccaatccttcagcgcgaacaatcggctcagccttcatcatctccaattgcagaaaacgaatcagtgtcgatcgatacaccagggtgtcgatcgacaccaattactcttgacgactatgtttttcctttgttgagtggaatcgataatttcgcggaagaggaggaaacaattcccgatggtgtgatcgacacccatctcctgtcgatcgacacccagttcgatcagacaatgtgcaaattccagcttcaaccaagttagcaaatcggcgaattcccttccccaagagtcctaaaaagtcaatacaagccttagatgatgttagatgcaaggctatgattgataggttgattgttcagatgcctctagttgaagctattcatctatctcctacaaatcagaaggtatgttaagacaatggtgactaagaatttgacgaaagaatgcagtgttatgatgatttcagagcaaggcagcgacattattcaggaacgaatcccgaggaagctacctgattctggaacttttgtagttagtgtcaccattaatcattattccttccaaggagctttatgtgatctcggttctagtgtgaatatgatgcctcgttcagttgctatgcgtcttgggtattccaatcttgagcctacctttatcactcttgtgttagtagatcgttctacccgaattcgagatggaattcttattgatgttctcgtgatgattggaaagagcatgattcctacaaattttgtagtcttgccttatgagaaggaacctaaggatccattaatcctagggagatccttcttgcacaaagctagagcaatcatagatgttcgacaagggaggatatggctgaatgcaattcgatatgaacactttggtcaagaaaccgatcatagaagggaaaaccttcttgatagattctttcacttcctcagcttcagatagtatttcagagatggaattagaagacccattagagcgagttttggtctcttccatagaggatagtgcagatttggactgcgaaacttcaacatatactaaggtgctggatgagacagaacatgtgatgcaacttatagttgaagaagctcttccatctgtgacttccacgctgactcctacttcagattgggatccagccaaagctccgaaaatcgaattgaaaccacttccagcagggataaggtacgcttttcttggtgaaaattctacttatcctattattgtgaatgcttctcttaatcccgcagagctcaccttattgctaagcaagctacgcaatcatcgcaaagctcttagctactctcttgatgacattgcaggtatatgtgcagatgtatgcatgcataggattcaccttgaggacgagtctaagtcttcagtcgaacatcagagaaggttgaatccgaatctgaaagaagtggtcaagaaagagattatgaaactgttggaagctgggattatctatccaatctcagatagtagttgggttagtccagctaatttggttcctaagaagggaggtgtcacagtagtcaagaatgagaaagacgagctgattcctactcggacaatcacaggacatcgaatgtgcatcgattacagaaagctgaatgctgctaccaggaaagaccatttccccttaccatttattgatcagatgttagagaggttagcaaatcataagtactattgcttccttgatggatactccggattctttcagatcccgttcatccatatgaccaggagaaaatgactttcacctgcccctatggtacatttgcttatcggagaatgcccttcggtctttgtaatgctcctgcgacatttcagagaggtatgatgtctatcttcacggatatgatcgagaatatcatggaggttttcatggatgactttttagtttatagatcatcatttgaggattgtttagagaatctctacaaagtgttagcaagatgtgaggagaaacatctagttttgaattgggagaaatgtcacttcatggtacatgatggaataggtctaggacacaggatttctgagcatggtatagaagttgatagagctaagattgaggtcatgacgagtcttcaagcgctggataatgtcaaagcagttaggagtttccttggacatgctggtttttataggagattcatcaaagacttcagcagaatcgcaagaccattgactgctttactctgtaaagaagtcaaattcgagtttacacaggagtgtcattatgcatttcagcagataaataggccttgatcagcgcaccaattgttcagccaccagattgggatttaccttttgaggtaatgtgtgatgcaagtgattttgcagttggagttgtctaggacagaagaaggataagaaacttcatgcaatctactatgcaagtagaactcttgatgatgctcaaaggaattatgcaactaaagagaaagagttgttagctatggtttttgctttcaaaaatttagatcttatctcgttggatccaaggttattgttcacacagatcatgctgccttgaagtatttgatgcaaaagaaggatgctaagccaagacttttgagatggattttgcttcttccacaatttgacatagaagttagagataagaaaggagttgagaatggtgtagctgatcatttgtcacgcgttaggatcgatgatgatgtccctataaatgattttttgcctgaatagaacatttacatgattgatacagctgaagacaatgactacaaacgtgacaggttgcaggatcgtgcttcagtgtcgatcgacactcccattatgtcgatcgacactcacatttcagaggaagttgatattcgtagttgcgcgatagtgtcgatcgacacccttgcatctgtcgatcgacacccttgcacctgttgatcgacactcttctgaatcgacaagaaattggtcaccaaccgagaattgcgccatcacagcggtcgagaaagattatccattgtatgctgacattgttaattacctagttgcagatgtggagcctgataatttcacagattacaacaagaagagattcctaagagagatcaggcgatatcattgggatgagccttatctctataagcattgttctgatggaatttacaggagatgcattgttgcaacagaggttcctgatatactattacattgtcacagctctagctatggtggtcattttgcaactttcaaaacagtttcaaaagttcttcaagcacgcttttggtggcctacaatgtttcgggatactcagaagttcatatcacaatgtgacccttgtcagagaaggggaaagatcagcaagcgtaatgagatgcctcagaaatttatactcgaagtcgaagtcttcgattgttgggctatagatttcatgggaccattcccaccttccaacaagaatttgtacatcctagtagctgtggattatgtttccaaatgggtagaagctatagctagtctgaagaacgattcagcggttgtcatgaaactcttcaaatctatcatcttccctcgttttggagtaccacgcatagtcattagtgatggaggtaagcatttcattaacaagattcttgcgaaatttcttttacagtatggagtccagcatcgggttgctaccccctaccatccacaaacaagcggccaagttgaagtttctaacaggcaaatcaaagagattcttgagaaatcagtgggtaaagcgaaaaaagagtggtcctacaagttagatgatgcactgtgggcctccaggacaactttcaaaactccgcttggtaccacaccttttcatcttctatatggtaaagcttgtcatcttccagtggaattagagcacaaagcagcttgggcattcaagatgataaatctcgacatcaaatcagctggagaaaggagacttattcagttgaatgagcttgatgaaatacgaatccacgcttatgacaactcgaagctctacaaggaacgaacaaaagcctaccatgacaagaagatccttactcggacctttgagcctaatgaccaggtacttctttatgattctagattgacattatttcctgacaaattgtcttctcgttggacaggtccctacacagtccactcagttaggccatatggaacaatcattctcgaaaacaacaatggcaaaccatttgttgtgaatcgactcagagtcaaacactactgggctgaagctgagattccagtagaaaagcctttggatcttcaggacccacctgttgattaagcaactccaaagtcaagctattgactataaacaagcgcttagtgggaggcaacccactggtaagtatttctccttttatttatttcattcatttgatttctaacttagaatttttgattttataggaatatccagatttaaaaaaaaaaaaaaaaaaaaaaaaaaaaaaaaaaaaaaacgtgttgaccaataacgcgatggtgtcgatcgacaccctcattttccaggtaagtcgttttaacctaaaacttcatcttcttcatttcatatttttctcaaaccgccgaattcactaaaacctccatagatccttcgattcttcaccatttctcgtgatttcaggctttaaactcaatagaatctcaccctctatcttcccaaagtgtcaattccatcgatttgcaagatgacaggccagaaaaagaaggctaggaagagtgtcggcccttcctcctccgccgtccctccacaccgtcggcgcttctccaccgccgcaggtcacagcctttctcaaccgaaatccgaagctgcagcccctcaacctcctattcatcgatttccatggccaaagcatccaaaagagagaattccttctcaaagggtttggagaaagatatcaacagggaattcactaaaggtgactatatcaatcgccctttttctccagattgggatgattaagatactctgttctataacgcctggatgaatgtagaaattttggctactcggtttgtggatttcggtttgatgcagcgtttgcagatagagaaatcagttttaggactggaaaatgacataggtttgggaaccatttgttgtaggcagtacgatttgtatcctgagctggttaaacaattcatggcctctgttatggtaacttatttgcatgacaggaaacgcaacgctcaggaaggagctcttatcttcttcattcgcggtgttcgatacagtttaccactgcgagacttgtgtgacatatatgggtttgacaatgatctcactggagtttccatgcctggtccgtttaaggattctcagattttctgagcaagtttggtaatggaatctatgattccaaggacatagttcactcagagatccgccaccctgttctgcgatatttggttaggttgattagtagcacactgttgtgcaagatggagcctggcaagatgagactctctgagttgctattgctctatcacgctcttcatgacttctttcctgacagccttggatttgagcaggttgaccgtaatgtcaactttagtgctgtgttcgctcatcacttggtttctctcaagaccaaaccctttacaggtagaggacacaaatctgatagagttggcagtcttctcactcccatattcgagcatttccgcatcagctttgagggcgaagaagtcaacaccacgcgtgtcactatggatgagacttacctgaagaactctcactggcttaagggcaacctactgtggtgcttcagggatgatacaggtcagcacatgattcagttacctcaccttgcacttacagagattataggagagcatgaggagataggctttcatcaggatccctcccttctgcatgccgcaccacgcaccaggcgacagagaggttctgctttaggatctgcgcctacacagaccgaggaagagttcattgaccctactgggggtccgagagttggatcttcctcatctgctcttccatatcagctgccttctcctccccccatcccgatggagccacaggtctttcagcagtacgtcgtcgacagtttcaagagcgtctagaacgccatagctacactttctcgctgcggttgtgttgcccccagtcgtcgtcgtcgtcgctctcccgcacccacctccggctttactttctgactttggttctgctttatttcagactcttggttatttgttttgaaacttgttgcacttattttcttatgctttgttgggactattgatatgtcttttagtgatttaacagtctaactggaggatccatgtgaaaacactaaccaaggctctacaccaacgagcagaattcacaaagcaatgcggaacgaccaaagtgtcgatcgacaccatcatggtatcgatcgacaccactctcaggtggcaactcacgttttctaactttttaacttttgactatttctctttcaattcctctagcttaataactttggggacagtgttatctaactctgggggagtcagttactaacttcatcttttcttttcttatgagtcagttgtgtcatttttaacttagatagtcattttattgagttaaaacttttgtctgaaattatgatctatctctcgagtttattgcctggattgtttaagtactgcacattcaaatcaatccgactaatgaaaaaatctagaaggccaatcaacaaaattaaggacatccattcccaaaataatccacaaaggctggagctaatctcactgctcttccttttacctcatcaaaacggttagtgctcataggacttgactccttgttcatacccgatagatcgactaatgtgttaaaaagaaaagtgttcctctcccaaaaaatttttttttgataaataatgagagattgagaagactttcagatagtgtataggggtaggaatatttctataaccccattattatacattatttggaacgatcaattacaaaggttggaaaatgccgaaggtgtcgatccagtatgcgagttcccctttgtttactctctaaaaagaataagtctgggggagagaaagaacaccaaagaaaaaaaaagaaatataataaaagaatggtcgatttatcatggtatagttcaggaatgagtctagaaggttcttaagcattcacttgattgatgagacccagcgatgatagcctagtggatatagttgagtgctttggcatagaatctaggatgttgtgtgggctagcggagaattacatggtggtcaggatttgattagaactgtttagttcatggatttggtttgtatgatcaaggtaataaaccagagagattgggagtttctatgtttttcaaacctctttcacagattcaaccttttgttttgcttgagggcaagcaaaagctaagtctgggggagttgatatctcccggtttttactgatttctaacacagtttcagaatgatttttagagtctttctagtctttttcgtacgttttaagtcattctaggtacacgcacacatctgggaactatggagtacaataaggaattttggaagcttttcagcaataaagatcttgaaggacgtctttcagaagctggtgtcgatcgacaccacacctgtgtcgatcgacactcttgtcgctgcgaggagaatattcgttttacaccaagtctttgagaagccctgaagttttccttatttgcaagatagtccctgcacgtttttagagttaaatacctaattgtttggtcattgttagacctagtttttgttcttgagcttttgttacactttagagaaaagaatccaatccctaaaaagagaggattctgaactcctttgctactattctcaattcatcaataaaaactattcagattatgatttgtgtttctattgtcatgtctgagtaatcaccttgttgggtctagagaatctcaatagggatttagatgtattagtagatcgaaaaccccttaggattattcttagagttcttcatcttgataattcttaatgctagttttagattgatcacctagaacttgatattggataatgggtattcccgctatatgtatttgttatttgaaccatcatagatgagcctaggcatttaagaaagaacatgtaggctcatagaagggctttggtttagatactaggtgaactaatcaagcttattaacaatgcatgctttagcataggatttctcggcttctccggttatcttagttgtaagtatagagagtttcgcggaacgccaccggttactctagaattatagttttagtttgagaacggtgcgataacaatcctgatattagctagatctacaatttatctatgtcccgagacaattccttagacgtgacgctttaatcacttgaatctacaactcatttacttgcttatttgtctatattattcaattacttcattttgcttattaaacagcatgacaagtctattgtgtgaacatcgagagctcagtagaatttgacccttaagtgttttggagagagaatcaatctgacgttattattaagagttaaagaagagttattgttgtgtggatagcgtcgacaatcttgttttcgtttttgctccccagaaggaaacatgagcgaggaggtaaaatttaaaaatgtatcgcgtttattaaatttgttgatggttgtggattcgtgttgatggttgtgaaatgttattgtatgcaggttccattagagagttattgtatggtcatttgcgggaatgggaatgctcggatctttcaagaatggtattttgaaatcaacaaaattctaatgtctagaattgttccaattattgtagggatgaatctttctggtttggaagagattgttttgaaagaattcatgactaaagatttgacattgggaacccctaagtttaggtatttgccatctaatatcatggattacacgagggggaagaagacacctccgatattgattactagtgaagtaggtttgaagttcttcattgagatgtttgggaggaacaagggtttaaatttgttcgttaatttcagcgaaatgattgaaataggaaattctcgtcggaaaaatgttagagaagaagatgttgctggttcatgtataatgaggagtaagaaaagagcaatttcatcatcatgtgaaggatttgcaagaagtgatgttgacattgaatgggaagcaccaactgctggttccaaaaccccaaagtttccgacaactcaggatgatgaggctgttatagcggaagttgaagtactagaagccatgtataacagaggcgatgaacaattacctagcagtggcagcgagaggaaaagtagaactagtgccaatagtgatgaatatgaagatttatttgggggtagtgagaaagatggagaagatggagaaaatgtagatgaagttactccgacaggttatgatacagagttttggggtcactttttggatgatgaattagatggttctaatgcacctgagatcatgtgtagtccaagagggactagaactcaagaagataaagtttgcaatgatggcaaaggaagtagtattgactcttaaaccatgcctaatggaggacggagaaatcgagagacaaagaaactagatgatattgatgaagagttttatattcctccactgtttgatgatactgaatatgaaagggacgagatcccggatcttgatattgaagatgataagaaaggtatctacaaagaaagggtatatgcaagtaaacaagattgccaaataagcttagctatccacgctatcaaggagcaattttactttaagcagtctcgtacaaagcgacattacttggtaatgacttgtgttgatgaaaactgtcagtggagaataatgtcccatgagatgaagacatgtggttactaccagataaggaaggctgatttagagcacacatgcaacatgggacagtacatgaagatggcgacttctagagttattgcatctgtctataaaggcaagttcagtaagttctctcaagggcatgtacctttggatttgcaacagatggtactagaggatttgagagtgacaacatcgtatgggacgtgctggagagcaaaagagaaggttgtggaagaggtgtttggtactaatgatgacgcatacaagtccctagaagcgtatttgtatgttttaaaacttacaaatcctagtacaattacagatatcaaaacagagactgaagaaaatggtgtcgcaggttcttgtatatgtttttggcatttggggcatctattgaggggtttctatatcttcgtagggttattgtagttgatggtacgcatttgaatggtaaatacaaagagtgttattcactgatatttcaatgatattgattcacaaataagcatgaagaacagtgattgtgctgcatatcatgagaggttgaaaacagggcattagacaagggtctatttctaaggtgaacaatataatctagtgacaagcaacattttcgaaactctgaacaatgccttaaggaaaggtcgaggatcccctatattggaattgttaaggtttatacgggctatgttaacaagatggtttagtccaagaaggaagaagtctgtagatcatacatgtgtagtgactccagaagtagataaagtgttgacaaaaaaccttgtcaaggtcagaggaagcaaaattggaaacgttagcacttggagttatgaaattgttgggttgttcaatggaaacaatcaggtatgtcttgatcgtaaacgatgcacttgcaaggagtacaataagttaaaaattccatgtgggcatgctatgttggcggctacaagtgttggttagtcagatagatcattaatagcagatttttacaagacaacagcttggagaacaacttccaagggtgtaataaaccctgaactcaacacggaagacgttgttgttccaaatgaaattggaagtcaaattatattcccaccaaggacaaaaaggccgtctgggaggccaaaacagctacgtatcaaacccattggcgaatttccggttcgtatttgtgcaattctcattattttagacttattatgtattccgtatttaattacaaattttatgtggtttaacaaaaatcaaagagtgttaaggggaagattaacacgtgtggcagatgcaaaaagactagacacaacatgacaagttgtactaatccaatctgaagatgttttgaaatcggctatattgatagaacgatgaccagtttatattgtttttgtgtttggacatggtaatttttggataaattatgttgtattctactttatatttttaattccgttttaattcatataaatctcgcaagttttataaagggaaatatattagcacattacagataatgttgaaataatggacatgtacatgtggataagatatcaatcatgtgggacagaaccgttatccgttaataatgaaagaaaaaacaaactattaaacattaaataggcaagtttttaattattgttcaacaaaaaaattcattcctttaataacgtaagtggaactacagatacattgatcggaacaaaccattgaaaaaaagtaaaacatacgaatagaagttatcaataatggaaacctcgattcggtgaaaaggtttttcaatcagtatttaaacagaaacatcttctattatccagaatatattactctagaacaaaccgtatccaaaactctcttcaaagttctatatttccaggagtttcttatggctaacaaccatatgcttcacgagttgtcacatgctcttacagggtggacattatgtgtctgtctactaagggtttacaaaaaattagtgtatcctaactcctatgaaatttgttgcattcttgtcgatgagacggtaattttataaatccttaaattaataaaataatttttatgatttatgcaatggaactatcatttttgttttgcatttattagggtgatcaaatggaagcaacaattgatcgtcggtacgctgctgtatatctggagtcgatgcaggaaaaagagttgaaaagattaacgacgttcattgtcagaaagatcatttcaccgattcgatctacatccaatctatatggaatatggtttatggataacactgtcgtcaccccagatgaaacaagagaaaccgtcctctttaaaaacttaacatctttcgactatatactcgaggactcggccccaactaatatcttggttggtaagtaatttattcatttttagtgataaattatggtgtgtgacatagcaatatttttaggaatctcaaacattttataaaaaccaaactatatttacttataaattaattgatggtaattatgcagaattgcttggggcgattgtagatgttgggtgataataggtttttagtcaattatcctaaaacaccaatcatgtcgttgtagtattttaggttgtcaatccaaaagggtgtgttgctaacaatcaagatgtgatcaaaagtcactaagtcaagccaagcaataacaggttttagtgtgttttagcagtcctaagtgaagatgcagaaaacaaaaaatcaagcagaaacaataaaacactcgaccaacacagctcgttgcaaagcactgggtgtggtcgagtgaccggtcgagtaaaaggcagtaaatgaaacagagatactcgactgcacagtctgttgccagaaaactgggtggtcgagtataacgtcgagtaacaggagaaaatgcaaaaactaaacaacaagtaacacgatgcagtaaacaacagtagagtaattgagtagtttcgtttcctcagtttataggtgattgacatgctcaataaattatccctagacaacaagttcggtaaccaaatctaagtgccaacgcaacagagaccctgaagttaaaccagtcccagacacaatcaccattgacgagagcttacctaacaggcattacgaatcaacaggttaaggccaaaacgctccctgcaaccaataccttggtacagagccacgaatctctggaattagtggttcagacatttcatcgaacaccttttgggcgtagaaatgtctgcgctcaaattccagttgatcaaaaagcaataggcattaagaacaactaatccaaacgggatctataaatcaaactcaaactcctagcacactgagaattctaaactactctaacccatcctccgaaacctattcattactcatacatcattgtagagaacataaacattgaatagaatgaaaacatgataacaacaaaataatagcaagatgataataggatgaacaacagtagacgaaatcaaaagaaaaatgctgaatactgaatagattaagagaaatccggattacaaaatgtcaagaacacagtgtctatggaataaaaacttagaaaaacgaaaatttaaagaacatgttacttatagcaaaatattctgaaaccctaatactcaaaacgacgcactattgggacgcagtaagaactatactcgaccagctggtcgagttagtggttgagtgatatattggagtcttcttttctttctcgtgcttgagtgtctggttgagtgcgaaatggagatgatgctgaagctagcatccgagtatgtagtcgagtgatagagatggtggtactcggcttggtggtagagtgatcgagtgaaggtgatgaaggtactcgaccatgtggtcgagtagtgtgatcgagtgaaggtgatttggtggacgtgatgatacttgaccagggggtcgagtgatgtgatcgagtgattgtcttggcggtactcgaccagtgggtcgagtggtgttgtgaagtgatgaggccatctactcgaccagggggtcgagtagtttgttaaagtcgtggaaccatctactcgaccaggggttcgagtgttttgcagtgatcaggtccgcttcttccaattatctcgccaacagctccaaatcacctgaaaacaacacaaatatgcaacatgcatgtaaaactatcataaacatgcaaagtgatgacaaatgatgagaaatgatataaaacagtgatgatatgacgctaaagtgatgataaatggatgctcaaaacaggcaaaatgcacacttatcaactcctccaaacttagtctttgcttgccctcaagcaaacaattaagaacaagctggaggtgagatttgaaagcggggactcagagccaaagcaccagataacccagatgaaatcaatgtccaagttgatagttctaagctgcgatatgatcgaattctactcaaaaacgttagccatgccttgttattaatcaatctgactgttatgctcgacctacacatgttttcaaatctaccaatccctttaacattcattagttctggaacgtgaatcaagcaatgcatcatcaatgaactcatttggctaaggtaaaggtcaagagacaaagattgtcccttacagaataggcttcaataacaggggatctctcaaaaaatgattaagctttagtagaatgctaaaggtaagtccaacgctatgcatacagagataagatcccatctacgctgagtatatcaaatgaagctctaatggtaatcccatctccaatcccaatataagaacctaactctaccctttgcattcatgaatcttttaagccctttttctaatcattcttttcttttctcttaactctaggagaagctttctcaacactttgatatatctagcggatttcgatttctttaacaactatggttcctgattttgaaattttaaaaccgagggcttttgcccttcttcaatagctaacaagaactctttcttttctttacaaatcccaaaacctttgctagactttttccgcttctttagcttacttcacctagagtcttttaccttttctcatcaatgaatcaaccttttttttttcttttagacacatcccaacccaaagtataagcgcccacctagtcctatctagtccggaaaatgcaaactagaactacatgagacactatctctatcgttacgaacctaacactttctacaaagcttaattggaataagacctcacagacactcacaagtgatatagggctcgaaagaaagtctaggtttgggctcgggttaactgctctaataaggagagtcagctacttggattaacaagagtgatcaagatgaataagaaaatccaagtattttagggtatccatgagttcaaatttgatgcaaacataataattaaagatcagattcaagttcaaattgatagggaatggtctcaaatcatgacagtgtggtcgagtagagcaatctaggcatgattcagttttacttcaatttcattgactacgcaacagacaactagcaacgagggcactgagtttatccggtgaaccaaaatgcttacaaggctatctcatcattatccactatgcatatgcaacaatcctaaatgaaacactctatctcgatcctaaatgtactgcagaaggtgctgctcttgctgctagatcgagtgagtgtggtcctcctctttctcccagattcacgaggctcgaatgatgaatgcctcatagggacatgcggaatctcctgttcactaggctcaggcctgcgccgacttcgctcaggcgcgtcatatctcctcgagggcatgtcacgagggatctgtccctgcggaatagctgtagtggaagaggagcagcttagcttatccttcagaaacttgatagctctgaggcacttggcgagtaacttatcatgtttcttgcaccacttctgcagcttgctgtttttcctatgagcttcgctcaaactcttgctctcccttgctggaggtacatgctcactgaaatgatacatgctcgtgtcaaactccgcctcatctatttcatctgtcttatcaacatcttctgtcgtatctccttcggtgtgactgatctcctcagttggcagactgccctcgaaataaagatcttcaagcgcaggcttgaagtcaatgttcctttcctcgagaaccctagtagcgtcaatgtaggggagaagaatgttggcgattctgatcgatgaatgctcgaacctgtagcgatggaagtcaccaaccatgtcatgctccaagaactcacatcggcccaaatgatccaaatccatcattcttggtgctagccctggttccttgagaggtactccacaagcttccacaattggcgtcacaacgccacctacgcatagtgctcctgttactttcttcttgccgtttatcaacgcccacttcctgtatccacacaggtggatcaatagaggcattactggtggtgcgtcgttgagatcgcctctcaagacattctttccctttgtacggcggagaatccctgtaagtgcggaatctatcatttccatgtccgtgttagacacggtgcctgcagactccctagaataaaaaacattgggaaccgagcgctgaaagtagcgaatcacaggactctagatttggttgctcttggaccgcgcagagtttagcggtacattgttcccaatagtagcccacaaatccttaagctcttccctgtcaaacttggggttggttcccttttcactagggaaaccaaacagttcttcccacttcttgatcgacagctcataacgctgttcatccactgagaacgtcaagaaccctaatcccatggtatccagcttaaagtctgtgagaccctgatacatctctacttgcagtgtggaaagaaactcgattgtctcctccttataggcagcgtaagggtaagacatgagtgtctccagatgacacttctcgaacacatgttgcacatcctccagtaaccccagctgggctaaagtctcataacagggatacctcgttccccagaaatcattatgttcgaagaatctgatatactcctccattgtaacctcgtcaggtttgttcagcagcattgtctccttgcgccatgactctggctcatactcagttttgatgtcctcatcaattaactcatatctactcgaaatcgctctcttccctctagcgatttcagctcttccttgactacgttgagctgtggagcgttctatttctcctctaaagctctcgtaaacgtgttcttctctctcgggtctagtggaccaagactaggcttcatctacattataattaggatccatagaggattctccactatagttactcatgatgaaacctgaaaacagatgaaactcaaagataaacgttaatacgttagttccagcaaaaacaaaaacacaatccaacagtgtataccgctcgagtaaaccggtcggttttgaatattttttttttttggattgtgagttgttggtcgagtctctccttggtgaacttgaagtggaacgatcgagtgaacttgagcgacaagacttcttgcggtcaagtgtggcgaatcgagtgagctaaaaaccggttagtgaggagagatttgatggggtcgagtgaactctttggtggagtgatgtgacgtgaccgagtgattctgcaaacaaaccgaaatgagcaaggatgaaaccttcaagtactcgatcgcgtggcaaatgtgagtagagttgtagacggttcactagattgtttggtgagctacttcttacacgcgatcgagtaagatgagagatggtgaagtgagttcaaggtgatcttgcactgaattgagtgattgataaacaagaaccggtgtggagatgttgaagaagtcgagtgattgattcggtggtagagcttcattcttcttctctttgatttggcaatcgagtgagcttgaaaactcgtgatggtgaaacgagacttacggtggtcgagtaaaggaggtgatgaagatggtgatgagagatcgagtgattgtgagaggcaagagaggcgcgatcaagtgtggttgctgaatcgagtgaaattgtgatgaatgagaggtggtgatgagctttcgtggagatgggagcagcggctttggaagcgatggagagatgagatggtggtactcggcttcatggtagagtgatcgagtgaaggggatgaaggtactcgaccatgtggttgagtagtgtgatcgagtgaaggtgatttggtggacgtgatgatactcgaccaggaggtcgagtgatgtgatcaaatgattgtcttggcggtactcgaccagggggtcgagtggtgttgtgaagtgatgaggccatctactcgaccagggggtcgagtggtttgttgaagtcgtggaatcatctactcgaccagggggtcgagtgttttgcagtgatcaggtccccttcttcaaattagctcgccaacagctccaaatcacttgaaaacaacacaaatatgcaacatgcatgtaaaactatcataaacatgcaaagtgatgacaaatgatgacaaatgatataaaaaagtgatgatatgatgctaaagtgatgataaatgtatgctcaaaacaggcaaaatgcccacttatcattgggagtttgagaaatgatactggcaacgttgaagacgttaatggttacacccttctgttcaagatcatggatcgctagagagtaaattatttttatattgtttatataaaatagtctgcataaatttgtatacaagattttgatcatacttattgctatagcaaagaagtattgtcgtgtgaggcttttgggcagacagctactgactttgaaaaaaaaaatcgattgtatggaaagccaaatatgattgttgcactagggtggtggaaggttttgaagtcaaattggagggcaaatggagtgaagattgtgagccatggatctatatcaaaagtgttttctaatgcagagattcgtgaagttgaagttggttatagattgatggttgattcaggaattgttttttttaaatattttatgtaataatttttggttaattcatgattttttttttttttatgtaataatttctcgtttaatgtttagcttgagattttaataacttatattatattcttatttttattttgattatcacaaaaatttagtttattttaaatatttttaattttatattcttaatgttttgattaccaattcgttatatcaatctacattcaagatattaatatccgtataaatcataaacttatatatacattaaaaaatcatataatacatatacctaaattggtaagataataatcatttctcaaaattataagttattaaataaaatgtccatcacaacacattcacattaagaacatatataaacctattaaattcaatagttttcctaaatagtatagactatattgtaaaatccgtatgcacaacacactattgggaaaccctaagctaaaatatctcatcactaaactctaaatcataaaccttatatcctaataactatactcaaaaccctaaacactaaaccctaaaacccaaatcctaaaccctattcttaatatgttgttagatatttgtgaatgacatattttaattaaattcgttataacaaaaacaatttcatgatatttatgtccgtattaatcataaaattatatctaaattataaaataaagaatatagtaatcagtcatctaaatcataagttattaaataaactatccatcacaacataaccacattaagacaatacataattatctctttaattcactagtgtttctaaatagtaaaggctatattgtcaaattcatataaacatagccctaaacctagactctaagccatataccatacacactatgcactaaaccctaatggtaaaccctaaacactaaaccctaaaccctaaagctaaaaccataacccaaaaccctataacattaccttaaacataatcctaaacctagactctaagccatatatcataaacactataccctaaacattatgcacttaaccctaacagtaaaccctaaaccctaaaccttaaccccaaaaccctataacattaccctaaaacctaaacctaatctctaaaccctaaaccactaatgtcctaaactataaactctaacgctaaacactaaaatccagacaataataattataccctaaacaccaagacctaaaccctaaacccaaaacccaaaaccctaaaccctaaaatataattcctaaacagtatttccctaaaccctaaacccaaataaataaataaactattaatacctatcacttaaccaattacacataattagcaaccctatatcctaaaactttaacctaaacaattaaccttaacacacagcattagctttatgttatccatcataacaaaaccacgtggtttgagaacccaaaaaatacctatagggcatatattgttgaactataaatatcaacgtggtcatatattttggcgggatatttccccccaaaaattttaaaatcaaattataaataagtaaaggtgcgattagggatcatatgctccaaataccttaaagatctatactatggtccccaaaatagtttgtgagaaaggcacttcatgcatcgttctgtttcaaccaataatcccaatcgttacatctgtagtagaagacaacaaactcctcgacggatggccgaacaaacttgtagtcaaaatctggaatcaatcgtcgggtttaaaaaaaaggtaagagttgaggcaatctttataaaagagtaaaacatacatttataaaaaaattaaaatccgtttttcacatgtaggggccttcaacaaacttccacatgcctgcaggcattcttgcaaaaattgttagctatatagctgaaggtgagattggtgagttaaagaattggattatctccggaagggagggaatggtagctgtatcttcaccagatagccagaaatcggtaaggttggacaaatctagaaattttgtatactagtccagccttgatagtgtctacaatccttttttttggaaatgtgtaaagcaaaaaatccttatgcattgtatgttcgaagcctagtttcggctttcctattttttgacatagaagaggcaattgagatcgccacatatactaaagaagtctacccagtgaccgaattattatacattatgttgaagagttgtgctggaagagaggaccgcgaagtttactcaaaatttaaaaagagatacaattacgaagaagaagagggattttgtgaaacgttgaggttccacataaacacgttgccccaaagcggtgtggaacgtatagtaagacgtggtgtttcactggcagcccaatttgttgggaatcacatcagattatgttgtatatacttctacttgtctagatatattatggaaatgacttaatttactaatgatgaatggtatgtacttagacatgttgtaaaattattgtttggattagatccaattgttctcttgttctctaatcaaacgaaatggtaatgatgtttttgtcttaaatatagttttatgtgatggaaataggatctgttataagaatagttaccattgtcacgtggatagatcttagctttgtttttgcttcaacccttaaaaattggcaaattttggtacatctatatctatcacacttatccatggcaatactacataagaacacaactaataatccattggtttatccggattgtgtaaaattctttatatttgatgtaaaaaaaaagaagataaattgaccaaagtttgctgtttaactttgagagggaaatttaccgccaaaacagtagaacatcaagtggtgggaatttaaaaaaaataatcatccacgtatagcctaatatatagcaatgttcatatggaagtatttaaaggttctgacgcagtttagatattggtaacatatacctaggatatgaaaaatgaaggtaacatcgttgtcttatctcattaatgatgataaatttaaaagaataatgaagaatttataatattttacaaatccacactaacatatccatgctccctaaatatttataattatataaatgaattataaacctaagcgggaaattagccatcaatccgaaagtaggttaaagataggatattggtttaatgaataaatattatatctctcttatattaaccgtagcatatacttagattaactaaaaatatttctcttttaatggaagactcacaagagaacataattatgtgtggtgtagaagaaagttgtggagaaagcgagggttccaatgttgttatgagggtatttaaaaccgtttttatgaataaatctatgggtctattgataggatgattttttaacattttctgtttttatttttgaaggtgatttcaatgacagaatttcacattcctccgccgttgatggagatcatcgtaagcaaggttggtgaagatgttgttgatgcgttgaagaacttcttgctggctgggagagaggggagagatgcggttctttcaaagaaaacattagcatccgtacgaattgacaaaaaccatcatttcatgtggtggtcaatgcctcattcaaaatactacactttcttcaaaaagtgtcttgacgcgaataatctttatgcgaagtttgtagataatcataaagggctggcatatgaatcgactataggatactttcaaatgagatgccgttggaaggtgtgccatggtaaacgcaatggtggtttgctcgacttgaatgaaatgaaagtgtgcgtggtgcaaccaccttatcaaccgaacagagttggtaggccaaggtgtcgtagatgtaagaaggttgggcacatgttgagcacttgtacagagtaatggtttgaggatgaagtcagaatgttggggaatagttcttgaatgttgtttttggatttctactaatgtaagtcgggtgagaattttaagcttctttgatggtatctttgtgtcatttaggtttcagtttgctatcatgtttatgttatgaactgtttgaattcatgggagtttatccatatgatcttggatttgtaatgcaacatttagaattatttttaaaattatgttcagaaatttggctaagaaatttgcatgaggtttgaaaattcaacattattgtatgtttgcctgaggtttgaaatttagcatattcccctaaattgaatgttctaacattattgtatgtaaaaggtttgaaccgatcagatgccattaggtaattagctaaaaggtttgaaccgattagatgcccttaagacacaatacttattaatttaaactagtgaaaagtggatgcgtatatgttgattatcgtttgtccattaaatatttagttgtcttaattggatacgtctatgtggataacgataattaccggcaaataataatatgttaagaaacaatacatattaatttaaacaagagatatgtggatacgtctatttaaatatcgataattgtttatgaataaacgtggactttattattgacccctatatatttacttagttagaattttatgcaataaacatccttatatccagaatagtttaattattagtattagtcaataaactatttagatttctaaatatttttaatttcattagaatgcataatcaacaatataaataatattatatagtgaaaatatgcgatatggatattgaaaccaccgcctgaccacatggagttaaaccgaattgttggaaatattaaaaataacgttatgatgaattttgcaggaaaagataatttagtctatgcctatagcgttagagtcgtgtgtaagttggtattgagaaccgttccatacagcggcttacaccaactattgacaaatcaatcaatctactggctaatttaattttatttccctcaaaacacattaaccaatgtatactcaattattaattgacttgatgctgtttactctttataattaaataaattcgtataatttttagttttatatcaattaatatcaatgttaaacatatgacattcgacgaaaactaccctatctatataatataggtaaccatgtggttacgattatgtatttatagtgcagaatagtcttagaaacttaggtaaacttagttaacatagtgtaacgctgagttttaggaggatcattcgttcgtacaacaaaaaacattacaacaaagagttaaacaagggatttaaacaagagacccttaaaacaacaacaaaacataaatccgataaaaagtcttcactaggagcaaaagaagactcagtgaacctttagtattcattaggcgaccacatgcaaaatcaatagatacaatatagagaagtcattaattagagttcatatcaccaagaattatagaaacccctaaaactagaaactggaccttccaattagcagtaatctagaaaatcaattttccactataattcttgacacccatgatttcattaaaattttcactataattctttccctatcttcaagcagacttctgtttgaaacctaacagaagagacatctcgcaagctcagcaacttaacacataaataaagcattttggtttcaaattacgacaagaaacttcacattcaaggtttgcagtaatcaaaaccaattatctaacttaaattcatgacagcagtgcatgccttcatttcgtatactaattaacataagtgattcatacgtgtaaatttaagatgagttcttaccattttgatttcttcaattgatggttcagggtattaagttgaaactgcaccatacctcacgattttaaccttgtttttgcgcccaccaaccagttcagactccctaaccaccctccaccaagccagtgccacaacaatttttggatgaccaaagccccggtaacaagtatcaaattctaatgcctttctcccagtggcctcacagtctagaatctctttgctggtgtagggaaaaatttaacaatgttaaacacaccaaattatcctattttattttatcttagacgaaaaacttactatatgtccattaatttaaaaggaacgaccatctcctcaacgccgacgtcgggatcaccagaatgagaaagaattccaacttcaataacagcacccaagagatctgtacattcatggtaagtttagaacaacataaggcatatatgtaccctcaaatatgttgtctctaagaattaattgaaaaaccctaatggtaacaaagacttaccgactaactggtcgttctcgaatgtaccctccaatatgttgtcgaaagaagtaaaattgttgaacttgataggggtgttcggatcacccgatgttacaaccgttttgtccatcaaattgataccatactcggcactcgtagtcttgactggatcagaattaggtatcaccttgaagttagttaacccgatccacttattttcaaagatcttgtcgaagtaaaaggcagaaaagcgtcggtggattgtaacctctatccccgtcccctattcagaatattaaaaattattaatatcaggtacatgcaaaaaacaaaacaaaaggtagcttactgtttgatcagctacgataactctaagttcgaacaaatcgcctctttggtatattcaagacaatcactcgtacagtccagccggtgatttgaggggagagctcgttgagtagatggtagttgaccattttttttcgtttgagtgaatttatggtcacctaatgggttaagcaacttccttaaataacatcccccataaccaacttccttaaatagcatcccccataatcaatcgtttgcaataacaactggttagtaataattatacgaattaacccgatatcgtttaggtatcatgacataatggacatgtaaattattttttttaacttgcttaaataagttttatacttgtatccataataacaaatccacaaacttggggttattgccattcaataaatcactatatatgtgaatccataagatgtcaaacatctgaagatccacgtggattacaacaattttatttgacttgcttaaaatagtagaatatttcttcgaaaatatttgaaccgagaagatggagaactctcattcggaagcgagggaaaattgtcgccaaaacaccaaaaaatatcaacttgttttaacttgcttaaataagtttttatacttgtattcatagtaacaaatatacaaacaagagtttatgacaaacaataattcactatttatgtgaatccatgacatgtcaaacatttaaatatccatgtggattacaacaatttattggaaatgcttaaaatagtaaaatcttccatcgaaaatatttgaaccgagaagatgggaaactctaattcggatgcgagggaaaattgccgccaaaacacaagaaatatcaacttgttgtcggaagcaaatatccacgcggattgtatttttttaatgaataactagactgatgtaagattttttaaatatatattatacaaaaaaaataaaaaccaacgagagatttagcaatattatacattgacccaactagttttaaaccacataatcgatgtttaagttattggtttaataaattctataaatagaacaaaaccttaaaaccaccttataaaaagatcaatcgtttaattgaagataaggtgtgcgatttacaggaaagcaagagttcaaattcctttgaggtagttgaatatttgtttataataatgttaatttatatattgattgtgaataaatttcttcatttaatatgtaggagattccaatgatggatatacacattcctcagccgttaatggagatcatcgttagtaaggttgctgaagatggtgttgatgctttgaaagaactggttgctagccgggagagagggaaaagatgctgttatgtcgaagaaaaccctagcctctgttcgcattaacatggacaatcattttatgtggtggtcaatgcctcattttaagtactacagtttctttcaaaagtgttttgccggaaataatccgtatgcgaagttttatttaatcatttagtctcattttcgttaaagaaaattattttgtttgttattcatataagtaaatctataatctccaatccatgaattcttatccatataatggttattttacaatagattgcaatgtaccctttttatttaataattttgtatcatttaagataataaaaattgtttggtttgttatccatataaatataaaattaaaatgtggaaaaaattgtttagttagagatgatatcttggacggagtgattcaagcctgcccacatgaataaaagcttaatagtggagttttccacaaattagcatcagaaaaacagacttattgacaatgggtcccttgatgtgtagcttcaaatccagcaatatccaacaaataaataaatgtaaagggtgtcagtaagaagtgataacctgatgtattaggtctaaaaagtaggaatagattataggtatatgaaataaatatttaaataattatgtactagttaacaaatacagagaaatctatatactatttttttatttttgttttaagaagaagacataaaaagtgaaatttggcttgaattatctactgcaagtggattacatgtcatgttcactaaaatatgtaactccgaaaattacctaatcctacccgttaggacgaatagattaaaacgatgatacataattgaatccaaatggttaagaaatgatggattgtcgaattatgtcttgataaatatattaacagaaattacaataattttgaaaataaaacgattcaaaaaataaagagcaaaaatataacgagaatatttttcatagatctaagctgcgatatcaggtcttcaatgtctttccaaagaacgaaatctaggtcccgcgtctcctgtgacaaagaggtaatcatggaatcacaaatatttagtcttttttgcaatttaagtgtagaaccctcgatgttatccactttttctctcaactctcggatcttttcaaggatacatgtattcgtccatttgaacaaatggttcctattttcttgtattatcgatcgttatttcggatatcaagtagtagaaaacgaatgataaattagttgatttacttacaggagatcctaggggacatgcataaaacaaacgaccagggttccttggagtagctgaggatttcatcactacttcctcgccacaagggcataaaatcgggatacctccaattcgatctaccatgttctagtggaatggtgaatgttgtacgaggaaaactaagcttgtttctataggaaaccctagaaatttgggttttatcaccatctgttaattacctcgttctgataaaactgaaaatgattaaaatataatataaaatgaataaaaataaagtaaaataattgtttctaggaatacaaagtcactagtaccaaatccatgaatattgaagtagtccatgaatacaaatccacaaatgactgacataatacaaaccgtagaaaatgactgtctgtcgttattgaataagagcttgacacaaagcaaatttccaacaaactgaaaattaaggtaacacaaagcacggatcttaaaaatataagtggggtcaaagcactcggggcaaaaatccaaactcccaaaatgtactaaatgacaatctgggatagagttcaaactcctgtacccccggtatagttgttgtcttgttggagccatgtcttgtatctgagtcatgacctgctcggcgcaataaacagcttcttggaaattattaaacatctccaaatacttttttttagtattattctaccatcctctggattagcgcaaacaacataaaaaataccaaaagcaaaataagaatgtaagttatgaactgcagcttcgccaagcatattcagagcttgaacagagggactaactagagcagctagtcgtaacccttcgatgtatttggccgtgttgttgccagactgtaaacacctaagcaaaaatgggcggtagggcgacccttcgatgcataaagaggagaccgtaataaactcatcaagaccaacctcctttaaaacttcatcagaaaatacaatagctaaccattcaggtccagcagcgatgaatggacctagattacgaaaactcgatatcccaattcgacgaactatgtctgaaaccaaaggaaaaagaatgtaagaagacatgtcggaggaactatgtctgaagctgtcaaacaaccgaaatgtctagaacaaatattatatcttaatgaagagttacttatatggaaagctgattagctggtgggcgattggtaaagtggtgcgacaagtttttgaaacagatctatagcgtactgacccctgaattcattgacaatttcatctgtgataagagccattttctctgcatttccaccagttgcataaatttttatgagcgtcattgagatcggtccacagtccccagaccgctcgttgacatagatccctttcattcatgaccaactgaaaggagccaatttatgaacttgagacagacgaggctgacataatttattaattaaatacgggatttggaccacaataggtgccatgaactcatcgacttgtcgatcatcgtttagctggtagtttgtatcaagtatgtcgacacaccagttccctaagttgattgccagccttacccaatgctggtttttcaaaatcatttgcatcaggatgagatcaatttcttcaaatcaatctgatagagaaccaggaatcatccgcttgaactggttaaaccattgaacgcgcaacttatttttgcggcttgaaaggaacggtatttcccttgtaggtaattgcccaaccacggtttaagaataacagcgcgttctttagagagtgtcaatctgtgcctttcattaaggaaatttcctagtacctccatgtgttgcaagttgtttagaatgaatcatgtaattagcatattgatccacatgaactaaaatgaattaatagagggtttgttttaccatggtatcaacccaattggtcggttgtgcaagctggagtaggaatctatgggttatcacaatatcacattttcagccaaggtcaagtcttgaatcttaatctccttgataagatagaagaggtataacattagcatatgagtaacttctattctaagaaacttaaagtaataataaaaatcctttagggaggaaaacctcggtaacatcattagaagatggtttcgttgcgatatcgaaaacagcaaaaggtcgaggagaaggcagatgctatagtaatataaaaatgtagttaggtatataatagttaaatatttttgactagaaatagatattcaaaaatctacctcgtctctagattttgactcagtgtcatagatgggttgatcagagcgagggagctcggtgctattagcagatataaacttgggtaatataattgatggagtttcatcctgaaaaagaaccatatgagaatatatgaccaatgttttggacacaaaatgtgaaagaacttaataaacaattactcgatagttttgtggggaatcaactgaatccttgcaggtctccatggatatctcatcttgtgtagtatagagaagttaaagtaaattattgactaatatctacgaatgtatgagcggtagatcaccataaccaccaagccactcctttttggtgaaattatggcatttgcttatctgttcaatcaaataaagaaccttcttgtctctcacttcatcatcccactctccccaacgatcctcattggtgtttacaaacagcatcggggtaacagtcaactgaagaaacagactcagaaaatgagaccaaatcaaaaaagaaatgagagcacatgaaagaaaaagataccacaacaatgtttacaattacttacattaggaacacgttcaaggagatgaacatcgttgatagtaagattgttcttcggaatcccaattgaatgccattccaaaaaggttctctcatctgcagaaccaggaatcttgtccagtagagcagaaatgttcctataagcaagaagttgcaaggctaaaggaaagccataaatagctatattatgttgttgcatctgatttgtgtattgttggatgggatcttctagcttgaatccaggacgtgacctttttctctttgaatcagccattgacggtttgtttctaacaggcctcatgatttgaataatcttcaaaagtgattctctcccccatgggaaagcaaggaatgagtcaatgtcctctaacatcttgacatacttgaaagttggacgatgagtctggttattagcaataaggactccatcaacaatcaaaagaagagctaggggagttttaaagggtcatcaatcccttttaaagtttggaacttagaagaaacatcgaccagtattgcattcttatctttccctatcaaaacatcccagtatcattcgtcctattgacacgtttatggaagaagtcaggttcatactcctccagaaattcaccacacgacaaaccagttatagaaccaaactcaactaaagagaatctaagtggttgtccaccaaaaatagtccacatttcgtatttatgttttgtaaccaactgtctacataacaaagcatgaactattttgcaagagattggacattcgctaacccttaaactaaacagagacccaaaacaagagtctaagatggtttccatttccttggtacctttcaaaacgtcacatatgatagtgagaatgtcgggtctggagtagatattgcgacgagcatcaaggtaacggtcggtttcaaaaagccttggagggagacgagtgttgaagtcatttatatcatcttccactacgcctgcaatcaaagggacaatttgtgaagagaaaattaccaatctggaattgagattttagaacaacaatggataaaagagaaaattacctaactggtaaagacattttagaacaacaatggataaaacgagaagataactataattggtagtagaacaaagaaaaacatagacgattacctatcatcttttttgaacggagtgaaaagtaataacgagggattttaatgtcgggagattaattacggattgcaaactaggaagaggaatctgatttactgggcgaggaattacagattgtgaacccaagatacggaggttaatttcaacacagttgccagaataatttcacacttaggtcaaactgatgaacaattcgtcgggtcgttttactttacgaagactgttaaaaatattatttaattcctcaaccataggatagtaactatggttaactaagatttgagggatttctggtaaaaaaacttagaaaagtgcctactcccttccaagtgcttcattgaacaccttcacaacttgaatactaacagcacttggtcctagaggtatattgttaaccttctctttggagttagatgagcacacaacaccttcagcaataacctcatcgtcttcattagtccaatcatatattttgcatcttcgagtttcaccttccttggtttgctaaaatgtgagaagctaatgattaaagatatatcatggacccttatacaaaagcactttaagaagcggctggacccttatacaaatgtaagaagctaatgattggaaaactttaccatggatacatcttcagaagcggctggacccttatacaaaagcactttgtctattgaccaaggtattttgcatcccacagcttcttcaagatataatacatctgttgtaggcctccagagagaagcttctgagcttagtgcagacttaacaaggacaaccattgcattaggaccaattggtatacgactaattttgtacatcggttcagcagaacagaattctccttcacctacaactacatctcctgaatgaatccaatccaatatttgtactctaactccttctttgagtccaccaaaactctcaaatgtttcagtatcattgttacttttctgagataaggaacaagaattattaaaaccaatccaattgaccattccagatgtttcagtatcatcattccctttaactgagataaggaacaagggcagattaccttttttccagctaagtctcggaccattctttaactcctgaatctcactttgcatttctgccatctttgcgtctctagcttgcagaaatgctaacttagtagccgtaatccctctaccaaacccccttactcgtccaggtttgtcttttcccaaaatcttgctcacagcatcttcccttatgttttcagaagctgatgtagagtccatttgactatcaagtgattgtatttgttcctgatcatacaaacatttaaaccaaaaaaaactaattgatcataatccattacttatacacaggccataacaagttccagaattctcaccatagtctcagcaaattgaggcttcacaggtctaccatcagcatgagtgtgtcccgcaatccatacctttctcctagtcaccttacttgggtctgtacacttttttttctatataaagtacatatatatcttagtaccaatttgttctaacaagaatacaatatatatatatatatataaattcaatttgtcattgtataattttcaaaatcaacagcctaccaagctgtgcttgaggacccaaccgtagtcgtggtgaaacgttaaaataaagttgtggcaagtaaaatagagtttgaacagtaaatcaaggttgtgggaaagattaaccaacattgaattttgtaccgctaactcagtcattactattcgaaagacgaggagctattggtctacaagtacaggcatggtgagtcataaactatcttgttggtaatgtaaaccttttgagtcacgaaaaagattcttcctttttgtattttccgaacaggggacagagaagttgactaggaaacgcggatgaagatcgtgactaggacacatctttagtcactctcttcaacctcctaactcatacactgcgaactattggatcctatgctcctgcaatgcttgagacagttgggcacaaggcaagtaattgtcaaattgaaggtatttgtgacccgacttgccttatacaagtaagtagatttttggcttcttacttgccttgtcaaaacgagtacttgttttgacaagtacttgtctaaaatatgattacttacaagttatttgacccgccttgttacttgacaaaattaaatacttctacttgaacctaaaatatttagaataaaaaaacctatttcatacaaaatatttaagattaatgagttttgttacaagaaattttggatttttagttttttatgggccaaatcaaaattataaatctattataataatttaagcattagtatttattaagagatatttgccctctgaggcactttttcaaaacaatttacgtgatacaacactttaaaaaaacaaggcactttgtccaatcaaagttaccattataccctaaaactgttttttatctataaatcaaaccaaatccgtattccctaaacaaaatttggtttacgtacacggcgactttacagttaccatcaaagtttattttcataattctataaaaaatctaaatctaataaaaaatcctaaattacagtttctcgactccggatctttattctaaaaacgccttcttcctcgttctccactctcaccaacaacttttgatttcagatctaaacgatgcaaagctccgccgtattttccctctctccgtcgatccctctcctacaacaacggcgactctctctccgccaccatcctataaccgccgcttcttcaagcgatctaaacatgtctccaaatgttcctgtctggactaagttgctatttgattcttgtttctaacggcatgttaaggatagtctatattagtcatcgcttttgtttgatttgtgtaagcataatttgtttattaaccttttttagaaacctactccataggtactcagtgctattgtaccaattgttggtggagttgcacttgcttcaatttcggaggtctcattcaactggttagtttgttgagtagtattgtgacatttaagtcggtggttatctattcttctgataactctcagatatttactatgattacttgttttgtggtagggctagattttcgagtgcaatggcatcaaacttgactaaccaatcaccaaacaattacatattcgagttttagttttggagtttgatttacttttgttgtgaaatgttgcaaacgtttgggttacttttgtcgtaaactctttgatttcttcttatctcgatttctgtttcattgtcgagagtctatataaaacaaaaattattatatgttattggatgttaaagtcgcttaatcttatagctttgaacgattaagccagactttgattttgctagtggagagtactagcgtcaatttagacacatatattgtttgattgggatacatttatctctttagttttgatacaaaaagcttacaagtgtttggagatctttttcataattctgtgataaagttcaagaactatttgccccatttgtttgaaattcagtacttgaggtcatctattggaaagaagatgaacacatggactgtaacgtttggactataacatttggacaataattaatggacaaccataccttttgtttgcatgaattatagattaagtagacggtttttgtaagattttgaagatctggccaaattgttgattattggtcgtatatacgtcgaagatatggaaccatttttcaaatttattcatttatcactccatgttttgcaaattataaaaatttaatagaaaccaacttattgattattggttttatataggtacatgaaaccatttttcaaatctgtttatttgtcactccatttttgcgagttttaaaatctttagaaaagccatgtaattttcatttagatacttcttaagaaagaatgactaatactatataatgatggaagtgtccatacacaaatgaataaatggtcaaagaaaaatgaacgatgtacgatgtattttgaattggcaattatcattcatgtataaacttgtgtattgaaatgatatactacctggtgaatcattaaatatggactagaccgcttggacaatcattaatggacacctatgtctttgatctactatcaatgtgttttatcgctctgtaaaattatcatttttttatggttatgatatactatatggtttagagttttgttttacggtttcaaatttagtggataaggattaggggttcatctagttttacatttatttgaatcatcaagacttgttgcaggctttggacaccatcatcaccacaatggattaagagatataaacactttcagattatccattaagattcaaccataaacacttgtccatttgaccataagcatttgttcatagaaaacaaaagaaagttaccaaaacacatgaaaaaatgatacaatattctgttaacataagcagatttaagtagaccattactcttattttttaaaacaagataagctaattaaacaatcattaccttatcttttaaagctaatttttaatgagaagagacatgtagagtaaaaaaacaaaacagagttgtgtggtaatgatattggcagccatgtaactaatgtgaagtttataacactaatgtgaaattatgaacacagagtttagcatttgatatataaaaagagtttaggctacacacctagataaagaactggttaatcccaagagagttggagtaacagtaatatcagaattgttgatcatcacttcctctttcaaagcaatatttgtgagtctcatccatcattttcttgcataggaacgacaaagctaaaacaacaaaactccaaaacccaacaacaatctcttacaagtataatatatataacactatgaaattgactgtcatctacaaagtctaattctcttagtttagatgtccaacaaagcatcaatttaccaagatagaatcaccctcgttgattttcttccaccaatctctttcgccttcttaatcacattctatgtcttgtaccttcctacgaattccaaaaccactgtttcccatctcccaagcttactagttagatgcttaagaaactgcttcttcaaatattgatatcttgcgcaagtccaatttttagtttcattcacatatccactttccttagactgtaatcaccactttttcgaaatttccgtcaccttcggtgtgtcaccggagaagcattttacggcagatcatcgccgctttatatcgtttattcaccgatttcctcctggatttgcgttcgttatccatcgatgactcatcgtgaatctgcactggatctaagatctgaccataactgacgtgaatcttacttcaggtgagcaactaggaccgacgaggaagagagagaaggccattagaagaacaaactcgtcatcaatttgtcgtcatcaacgactccgtgctcattagatctcgataatgcaaaggcaagggaaaaagaaaatgaaaaattgagaacgttaataggagaatttgattagtatagtgagaattaacaccttcttggctctcgccattgttgtgttggagagagaaagaaattgctctttgtagagagcgactattcttagatctgataacttcatcttaattatagtagattttaatccaacaatcgatattaaaccccatataacttaattggtttgttttcaagtgttcggttaaagacaatttgataactgacttttggttagcgtttctttcatcccaggggtataaaagtctaaaaaacacacaaacaacacaaaaagtgccctctccttataaagtgcctcaaacgtaaaaactttctttaaaagtgtctcattatgctacattcccatttattaataagtatacaatgctcaacaattaacgaggtaagtaatagaaaaaaattatattcagacctaattgttagtaatcccacaagttacatgtacaaataacgagtaacagagcaagtaacggggcaagtatctaaacgaaacaagtaacgaggcaaatatcaaaaaatatgatgatacttaatacttggcttggacttacaagtaataaaataaaccgacttgttacttaacttgcttatgacgggtacttgaattttcaagccgagtacgagccgagtgacgagtaattgccaaatagcaatacttgtgcccaggcctaatggagagtaagtcaaatatcagatgtttatagctttggtttggtgattctcgaaatgctaaccggaaagacaccttaactcagccaggtcttgaggatcagcgtgtggtcattgatcttctaagatgggtttggtctgttgtgaggggaaagtggactgtagaggttattaatgtcgagctcttaaagtttcagaacatagaagaggtccaagaggagatggttcagatgcttcagctagcgttcgcttgtctcgcaaggatccagagtggaggccaaagatggaagaggttgcaaggattattgaagatgtgagatgtgatcagtcgcagcaaaacaggacatccccatgagctgcttcggatgtctctgaatgatttttcattccgaccaaaactttctttgatcaattctagttctacttgtcttattgaatcgtagtttcgtgcgtctaataaaattctctttgaatttgtgttaataataatttcgcgacctgctgaaaaaaaaaataaaaaataaaaaaaaataataataatttcgcgacctgtgtatttatttatctttcatctccgcaaccaaaatttaaaaattgaaatgaggtcgacatgaataatgaaaaattataaccactgcttgcattttcatcacaaaaacaaaaaaaatcataaccctaactattgtttggtttgtttctttcctcgagcatgctttgtaccttttgccaaagatttggtgttcgttaaatcctattcgaccatgagctgtaaaggtcagaatatttggtgcatcaacacggtagtaattttttcgtaaaattagctaggtttttattttattttgtgacacgtgatttctcatctaatcctaataataaaatatgttcttctcaattcacgtgtttgtatttttgtttccggtaccggatttgtttccttagtgttttgtggacaaatcttatagtcaaacacggattgatttcatcctatcaaagtatctctaatatcaaatttgttaatctttctgttactaattcctttccattagaaattccttttttttttccttgtataaagagccatcacttgacgtattatgacatcgtggtcgtggctatagatttgtgatataaatgaaaatgtaacggcaaattttaatattatgtttactttaaataatttgcacaatgtcgatgtttttatatatgataacaagcctacatgtccggttaaaatttcatgtcaagtaaaagtctacaccaaatgaagaaaggtatgaaaggatcgattaagttaaaatcgaactatctaatccaaaagatcattagcgatcgccaacgcttcctatgtcatcccccagttattgttttctgaaatgcatttctgttcttaaagtcttttcagtctaacataggaacaaaacactcgttgtaaatattttttacaggttcataaatcagttaaacatttcatccaaaaagaaatttgtagggatagaaaatgatagagtaagaatttcacccctattgaatcggcggataaatgatactttaaatttttattaataatgactcaaaacctcgttctgccatataaccttataccgcaatataatctttcgatgtatttatattatttttatttgttcagttgttcataatattataaaacttgtattgatattagatatatcaattataatatgtaaacattttaaaatttaaaatttaatatttttggtaaaacgaagcaattaaactaaacgcgaaattaaacagtatacaaaattttaaattatgatgcttgttaagttaaacttcctgtttattcggatttgaattcagtttgatcatatttataatattcttttgaatcattgtctaaacattttagctgatgtgggacgttgaacacgtatctttttcatcaattagataatatatgtccgttttaaaatttttgaatcacaaagtatgcagaaaaaatattgagtttttcttaacttaaatgtattatatgaagatttaaaacttttaataaataaaaataaagataataggatatcatagttttaaatcttaaccacatcttctaaatatctatattgttaaatatgaaaaaatttattgtaagaatcggttattttttaacccgatccaaaagattttcaatgaacaaatttgctttaactcgcaaataccatttgtatttgaatgcacttttacccacccaccaaaaagttacttgcaaaaatactatagagattttaaggaactcacacatgaacaatacactccattcttacgtagtgttattggttcctaatttacaaggattctatgactctaatcaaatcatagaaagaaaaaaaaacgattataaactattaatagagagtttttttataatcttgttgattaatttttcataatcttgtaaagtttttcaaacaatctctctgttttgataatactttccatgattttctgtgactttattttgtaaagaaaattgtagaaagacatgaatcaataacataatactttaattcattaacaattagagatccgtttgttttaatttgaataacacaaaaaatttaaatgagtaacacaaaactaactttataaaagtatgaatccaataaccctagatttattaaaattttagattagtgtttacaaatctcaaatgaataacacaaaaagtttaaaaaatcttgattgcataacaacatattatacatgcatgatactttatgtcattaaaattattttgaaatcataaaccaataacacccccttagtataaattatttatgatacaagacattttcaataaatttcttttctataaaagataatttaaaatgtaaacaaaatctcaaatggaaagagcatttaactttgagtcaaacctttgactaaaaatttctgttatggaaaccatattaatgtggaagatcttatacatatatatgcatacacatggcctacatatatatatatatatatatgcatagactgtgttcttagtaacatattaattttttaaaaaaggtaaatcaagtttgaaataagattttgtggaaaatcttagatgcctatcttttttttttttttcttttcatgtaaaacagtgaaaactaagtttatgagcaaattttcttgaacttttttgtcatctggagcaatatttctaatattgacttatttgaatattatttttctatacatttttgtttttcaggagattggattaaatcgagacgaagacttgttttaccatttggaaacacaggcaatggaaacgaaaaaaatctcatattttctattaccttcgttgatgatagttgctctcatctttcagcctatgtgttcaggtaacatatttattagcttcaatatgcattgtctaaaacggaaaaaaagaaaaagaagaagattaaaactccatgtgaaaaatgaattttacaaccatctgtgaaatcatttcaagaaaagcgtttgtttacgtttaatagattaaaagattgaattcactatgttgtgtaaaattgttgttaaaattgtgaaccaaaatatgagatcatgggcttcaattgtctaaacgatttcacattcttaaacaggattccaccgaaaccttcagagtccaacaaattgataaaatgtgaaactaccaaatattattttatcaaccccacattctttataagtttataactagattctacaatatttcactcatctactttgtcgcagtttgtttgctgttcattttttttacaatttttcttaatttatttagttttacgaattttctcgttttaaagatttttctatttaatgattgatttatcttgtttttcagctttcacgatagctgaaccctatatccacccatgtatgaagggattttgtagtttcaaatcagaatgcgctaacaaatgcatatttatggggcatcacaaaggaggagattgtattggaggtttagatggcatatattgttgttgtttagcataattgtcttaaaatgattctcccatatctagccttcctaactagtagcccattctatatctatatgtagtctcaattaaaatatgaataaaattatatattcaaatatttctaaattatcttagccaaataggtacccattccaccttcctttgtgattccaaggaaaattttaagttactttttattttggtttgctacccgcttaccaaacaagaccgatgatttattgaaatttattttttgccctaaagttttacaataatttacaataatatccatcaccgttttacattgctctgtatctgctttacagaaaaatagattatcatccgcaaagagaaaatgtgaaataggaggactttgtttagctattttaattttggtcagcttcttctctcgctttgcctttttaatattaacgataaggaactccatacataaaataaataaataattaaataagtgttaaattaatacataatttaatgatttcggttttgtattatagtttgagttaaatgttgtattaagtatttaattaaaaatatgtttttaaaaacgtatattgccaagtggcccaataaggagagactgaaatcttacttatatatatataattttctattggatcacaaaatctaaatataatgatccatatattaaaagtgatttacaaaatttatttgagataagaaagaagtaagaaacattaatttggtaaatgtcttataataagtacataaatatgctagaaaataatgaaatatccaaagtagataatagagaataaaatggatcttttcaattttatttcctagttgcgatgattcaaattgatacttttaactctctatcaccaataaacctgaaagttttcttatagttatcaatacattaatttttaatatgtgaactgaaattagaaaatgaaaattaaagaaaaaataagtataatcgtgtatggtgttagagaaaaaaagttagacatatattttctaaaataaatttagaatcaaattcttacaatgatgattattttaacagatataactgaaggaattcgtaccggtttataacaatttataaatattaacaatgaatcaaattgcaaggaactgtgtaaataaagaattaaatctagatcatagggtttgaatatacctggatattctgcagcggaaagattaaccatatttttttaaggttgttttagcatcccaagtgttgtgcctctaccggtatccacacacacacaaactagatcagatccggaatgctagttcttttgagatctaatctcaaaacttagataaactatttatctctttattatagggttcttgtgatcaaaaaaagatctcacaaacgttgctaatatatcatatatatagccaaatgtttaaccctaacaaattaggattaataatgggccaaagcccaataactctttttattccctttttgaaattcatgtacataaatatatgtatatcatatataacatatataagtataataaacattgatccagtttgcttaggtgtgtgaccctataggtttgtataatattagcaatgagttctgactcatagataataagttgtctctagcaaaacattataaccacctaatattatacaaatgtcaaagctcgacattacaactttaactagagtaaagtacaacagatttcaggacattcccaacaatctcccacttgtactggaatcatctattcccataatccctttgtctctatatctctatctcagcataatgcaagaaattgtcatccttattcagctagatcatgtttattgaactccaatttatactaataaaacaaacgactgacattcacctcatttgagcgcggccacgcatttctcagtatcaaatcttcgataggcccaaagactcccgttatatgggagggacaaatcccatcttgttccatccatgttccttaaacaattcataacgcgcccaatcactgtctttataatcacattttacggctgacgtttgacagagtcaaagcgaactaatccatgagtaagaaatcatgacgaactcagttcaaaggactatactctatagttgtgatgagaaactcttatgacactcatataacaatcttgtagagttctcataacgggtcagtccaatactatgttctctaatacatgtctttgtgattgactttaataccacatattaatgactccatgaaacttagtcatcagtcacctcacatactagtcattcttaattatcaatgtcccaatttaataaccttgactagggacttcaataatttatgtcattttctacttcagagtttcatgatcaagtcacgtacttgatgacctataagaatgatataaattatttgggactattatttaattatcaaataaataataaatactgaaacaaatttcattaatttgaaaataaattcaaatgtattttaacatgaatatcatatcataaaagaaaaacctcccactagaaataagatcacatctttataaatctaatgccaatcgcagcagtatgagtctcatgcttcggctgcagaagaggtttagtaaaaggatcagcaacatttgcatccgttgaaactctgctaatcttcacatcacctctattaataatctcacgaatgagatgatatcgcctttgtatgtgtttggatttctggtgtgatctaggttcttttgcctacgcgatggcaccattattatcacagtaaagatcaatggggccagaaatactaggaaccacaccaagttcagtaatgaacttcctaatccaaacaccctccttagccgctttagaagcagctatatactcagcttaagtcgtagagtctgccacagtgctctgtttggaactcttccaactcactgctcctccgttgagataaaagacaaatccagattgtgatcggaaatcatctttgtctgtctgaaagctggcatcagtataaccactcacaacaagttcctcactaccttcatagaccaaaaacttatccttagttcttctcaagtacttaaggatgttcttgactactatccagtgaccttcacctggatcagattggtatctgctcgtcatgctcaaagcacatgcaatatctgggcgagtgcagagcatagcatacatgatagatcctatagcagaagcatatggaatcttactcatccgctctcgctcatcatgcgtcgaaggacattgagtcttgctaagagttatgcattgagacattggtataaagcctttcttagaatcatccatattgaacctgtgcaagaccttatcaatataagtatcctgacttagtccaattattttgtttaatctatctctatagattcttattccaagaatataggcagcttcgcctatgtctttcatcgagaaacaacttccaagccaagtcttaacagactgaagcaaaggaatgtcatttccaaggagcagtatgtcatctacatacaataccagaattgcgactccgctcccactagtcttcttgtaaacacaaggttcttcttcatttctaatgaaatcaaactctttgattgcctcattaaaacaaagattccaactccgagatgcttgcttcaatccataaatggaacgatgaagcttgcataccttcctagcagcctcaggaacagtgaaaccttcaggttgtgtcatgtacacatcctcttcgagatttccattaaggaaagctgttttcacatccatttgctaaatctaataatcataatgaggagcagttgctaggagaatcccaatggacttaagcattgcgactggagaataggtttcatcataatcaataccatgatattgcttgtaacctttcgcaaccagtctagctttgtatatctgtatattaccatccatgtcaattttcttcttaaaaatccatttacactctatggcttttacactattaggtaaatcaaccaaagtccattctttgttttgtgacatggattccatttcggattttgcggcctctaaccacttatcagaatcggggcccatcaatgcttcttcgtttgacgtaggttcatcactttttataataaatagagcatgatcatccgtcactcaatctatgaatctatcgggttcgtgacggttcctttcggacctacctacctcaggttccacacgtataggttctacgactcttcgtagatccaacgtatgttcttcctgagaagttggaacatcaccatgtggttctcgaacttcttcgagtaatactttactcccactagttccttttgaaagaaactctctttccaacaccatttcgagcaacaaacactttctagtcagttgggtggtaaaagtaataacctttggtctcatttggataacttacgaagtatcacttatcaggtttgggtccaagcttatcagtaatcaatcatttgacacaagcttcacaaccccaaattttcagaaaagacaaattaggaacctttccaatccatatctcatatggtgtcttctcaactgattttgatggacatctgttgagcataaacgcagacgtctctagagcatatccccaaaaggatggtggaagatctgtgtgactcatcatagatcaaaccatatccaataaagttcgatttctcctttcggacacaccattccatggtggtgttcccggaggagtgagctctgaaaccattccacactctaagatgatcactaaaaacttggctcaaatattctcctccacgatctgatcgaagagctttaattgatttgccaagttgattttgtacttcattctggaactccttgaacttttcaaaggattccgatttatgtttcattagataaatataatcatatctactgaagtcatcagtaaatgtaatgaagtactgatagtttcctctaacacttgtactcattggcccacatacatttgtatgtataaggcccaataagtcactagccctctcattgtgtcagtaaacggagctttagtcattttttccaacaaacaagattcacatgtctcataagattcataatcaaatgagttcaaaagtccatcactatgaagcttttgaatgcgtttctcgtttttatggcccaaacgacaatgccaaagaaacattggattcaagtcattagacttaaatttcttggtatgaatgttatagattggcatgcttggtttagaccatagagtccattctctaatggagcgctaccataaaacatatcatctcaatcaaatgaacaacatttgttcttgatcgaaaagtgaaaaccttccatgtccaaacatgaaacagagatgattttcttgtttatagcaggaacatagtagcagttcttaagctccaaaaccatgcatgaaggcaaagacaacgaatatgttcccacggccaatgcagagacttttgctccattagccacacgtaagtccacttgtccttcctccaaagttctactgttgtttaggccatgcacatatacacaaatgtgagcaccaaaaccggtatccaatacccaaggagtagaaccagaagtagtaacatttacgtctataacatagatacccgaagaagaaatcttgaatgttttcttctttttccagatcttccaagtattcaggagggtttgatgcattcaatttgtccttcttaaggacatctcgaactgaataggaactttgagggtttaacataactgtcggaaaaaagcataaattaatatgatgttcataaattttagaattcttaacaattaagaaaactaacactataatcaaaacaaattttcctctaatgagtacaatgatccaagatccatatttcactagaatccaagtgagctttggctccacccttgaatatctagttatttaggtaagcaacatcttgctaattatatcctatataattcttggttgtgtatgacatctaatatcttatccaaccctatgtctctaagcccataaccgttttgatagcttagtcaagtaaactagatttatttcatatagtaaccattactatctgtctcactcttaatcaattgcagaccgttgttttggcaaacccgccatacaaaaatttaagttttaatcgttgataaaattggagagacatcaacttacttgatattagttgaggaattaattttatacctcaattttatatttaaaaatttatatccaatataaataaaatacaactaatatatatataatatatatttaattgaattataaacaatttaagtaatcttaattaaattaaaattattaattatctagaaaattaattttattaaattttaatagatctaaccatattagaatataatataatcgactttatcccgatcaaattaggatataaaaaattctcaagagtatgatatgatcgaatcaaaatccatacataattattaggaaaattgactttctcgttagaagataaatcacaaaccatagtatattcgattatctttttggtaacaaaaatatattgtataaggaacaatttcaaattaaacaaagattctcattattatccataacgtgatatacacatattatataaaatatttaattctaattaaatatcctatctacgaaacatgtttcagttctcataatccaattatgacacacaaccaaacacgatcattctattataatactatattctatgtgtataatattattctaagcaaacatatcttaaatcagttgaatgcaaagaaacgttttcatacgagtaaattaataaactatacatcaattcacgatcatgacattcacgagaatgtgttttaacaaaacaaaattcatcaatttcattcatgtttaattatattaattatttaattttatcgtactcttattaaccattaacaactacgaacataaacacattctcttattataattcttttttttttttttttaataacaggaggttctgggccgaagcccgtaatccccccaggcccgaaatcacagcatatagtattagtttcgtcccaaacgtcactcaaaccggcgacctctaagcttcgcctagggtctgttatacgaaacatgtacacttcaaaacatgtgtctatacgaagtgtgaagtgttataattcacacttcataaacgtatatctcatatacgaaacatgttctatgttctattaggcgaattcgtttctaccatgtttaacaaattaaatttcacaaatttcatcataataaacaaataacaattatttatctatatcataatatagattaaactagattcaaattcagtattaaacacataggctctgataccactgaaggaattcataccgatttataaatactaacaacaaatccaattgtcaggaactgtgtaaataaagaattaaatctagatcatatagtttaatatacctggatattgttgaagggcatgagagaatgagagaatgaatatttacaaaatgagaagtgatgaagttataatttgaaaagtgtgggagtgaatttttaatttattatgtgttgaataaaatggagtggaaaatagaattaatatatatttttatgatttcagtattacaaataagatatgggatttgattttttatttattggatgttgaataaatagagttgagaaatataattaataaatatttttatgatttcagttttgtattaaagtttgaattaaatatctattaattatttgattagaaatatttttttaaaagaatttatattgccaaatagaccaataaagagagagggaaactttatatatatatatatacatatatatatatatatatttatatatgataactcaacttttttgtttagtttatttctggaaaacagttttaattattttaactagaacaaaacaataataatcacaaccgctcttcttcccaagttctctgttttcataacttccaacgtgattgattcactccaactgattttcgcaattactcacaacttaaaaggtatttgatcaacactcttctcattttttatctctcacattctgcaacttttttccttcgtccatctcaagcctgatcaaaaagcttttgtcgaaccaggtaatatgttattcatcaaaattatttcatatttaattgcttacatagtctacactctaaagtttcattaatttcttttgcttgaacagtatctgaagatggagactctgacaacaacgagctgatggagatcagggagctgatggatatcaggaagctacatcaaatctacatcaaacgtctgagctgctgacatggacgcgtgagctgacttggaggagctggagtggttgatgtgacgagccaagaagctgtgctgacttggcgtggtgatcaaagacgaaagtcggttgagaagatttggtgaatattcttctcaacaagttaagcaaagagatagacttaaatatcaaggaggatctcaaacaaggaaagagataggcttgaatatcaagaaggatctcgaacaaggaaaaggataggattggcgatcaagaaagattcctttagtgattctcggagatcttagggtttagggttctggaaaataaggtataagtattctatagctagcgtggagtcgctttaagcactctagaatattgccatacgtgtatagctttcgaagcctagcaaaagcttagaaagtgtgtgtttgtaatccctcctcttcacaggcgtgtgataagaaacagaggagtgattaggcttagatttgttcttagtcggggttgatcattcgggtagaataggtcaagtaattgccgagataatagaatccttgtaaaaaatttattatcaataagaacaagtaaaaagcgtttgtttgacgcgtttcaaacaaaatcagcgtgttgtgtatcctctataccctcttaattggtatcagagcagacacctgataaaagaatctgttaatcttttcaacaggtgagatcttgcgacaagggatggagaaagcacaacggttcgttgcgatacctaagccactgaagctggatgctgagcattacgggtattggaaggtgttgatcaggcaatcgattcaaagtatcgacatggatgcatggtttgcagtagaagatggttggacgcctcctaccacaaaggatgcaaagggagacattgtcttgaaatcaaggactgaatggacatcggatgagaacacaacagccaatcacaactctcaggcgatgtctgtgattcttggatctttgccaaggaataagttcactcaggttctgcaagactcattcgaaggcaccaacaatgtgaatcatactcgtctggacatgcttgcattagagtttgagaatcagaccatggaagttgaagaatccgtggatgacttcaccggcaaactgagctccatcacacacgaggctgttgtcctaggaaaaacatacaaggacaagaagatgttgaagaaatttcttaggagtctgccagacaagcttcagtcacacaagtcagcgattgatgtatctctgaacccctatcaactatagtcttatcagatcattgggatgatgcaggcgtatgatactgattcagtgaacgatgagcatggattccctttggagaaagtcaggatcctaatcgaggagttgactctgaaaaggaagggaaataaggagctcatttctgaaaaaggaatcttgatggaaaaagtttctacacttgaaaaggagctcggtgaagagagaatcaaatcccaaggactggaaaaacagctagaagaccaactgagaaacatcaagatgctgagtagggggaataaagacttggatgagctcctgactgttggaagaacttcaaacgttacttggagtcttggatatgatgggacaagttcaaaaggaggaacacgttttgtcaaggggacaaattcagatgaaaatctgatgatatccaaccagcagcagcacaccgcacggatgcaccttcgaaggctcgaaaggcgttgaccaggagtatggctactcataactggagacagttaaattatcaggttgatcacaatcatctgaggagcagaagaacatgatgttggttttgcggaagtaagaaacacaacagaggtgattgttacagcttcctaaatcgtgttacgcaagtcaggcaccacaagcagcaccacaagaatgataagcaagtctacataaagaaagatgatttttatcgtaatggtggatatttatgtaccttagttaaggttatgaatagagttgttcctgttaacaacttcgctaagtttgtttttgtgaaggcaaagacgagatcagaagcaagagttagtcagtcgactgtcaaacagctgagcagaagaacgaggaattgtttctgtagtaaccaaggacagattacagctagctgtaacttgtgttacaatcgagtaactaaattgctgaagcgaaacaaatatcacagcgatatttgtagatccaatcgagattggatgaagaaacataatgtttgccatcatgttgctgataaacaaggacgtacgaccttcaaaagtgtgcgaactggtgacaactgttacatgtggaatctatccaatccacattcaaagcattttgttcagagtggtgttctgaatccgaagtgcctacatagccggacttggctactggtagcaaggtgcagcagtctggtaagtgttcgaatcatatcccacatgatgatatgggaaggattcggggggagaaagttaccaagcctgctggtggcggatgaatcaggaactgaatctgatggtgtttatacatatgactgtacatatctggagtcaaagttgacgagccaagtctgtacataatcaagggagttgtagtgcatggataccattacaagagtcggatgcagtgcaagattctgactggactggatccgtggaagattgctgaagtacaagtggttgatgcttcttcatgggtagcaacatggtctcgaggtagagtaaggagcagaatattgtgtctctatcccttgctgaaatagagtactttgctctagggagttgttacactcaaatcatgtggataaaacaaatggcagctgactatggtatgatctctgattctttactaatttattgtgataataagagtgcattaaacataggaaattatcttgttcaacattgacgcactaagcatattgatattttacaccatttcattcgtgaacttgttgaggcgaaaatgatagtagttgatcatgtgagtactgaatatcaactatctgacttatgtaccaaaatcttggagtttattagcctcagtgatctaagaaagttaattggtgttcgtgagatctaatctgtttcgtgagatgtgttgatctaagacaggaacaaaaaatgcaagaacatgccatgtaaatccaaggatgaatagaagatcaatactctgcgaataaaggtgtgttgaaaatagctgcctgtcatgccgattctgtagccagccgtaaaagattgtcgtctaacaggaggtcaaagagctgaggagatcaatttattgtgcaaaccaaactaagggtatctaaagcctaatttggtgtcaagtgaccatcatgcactaatatcagcatttgagaagtcaagtgatgctgctgatatgaaactgacagatcaacagggattcaaagttttaagaaaaaaagaaaaaaagaaagaaaggagaaccctgttgtatctaaatctgaggaagtatggaaataaaagcagcacactcatgattctttgagcaatctccaaaggaaaattccagctgcctgttacacgttgagctgatctactggaattgaaggcatgacagtttgaaagactagccactgtacccagagttgatctattaaagatctgagtggttatggtagcttcttgctgagttatgaacaactggttggcacggaacacggaacggattttaaaggtattaaaaatgttttgaatccaacatagtgtactcacatgtttcaataactttctgggtcactaaactctgttcatgagtgaatggttgttcgctaaatgatttttaatctgaactatgctagcatgtgatgttgatcgatgggatgatatgaatcaatgggattatatgcaagtgtgcactaatgtttttgtttagtgtttcaggctctaattattttaggtatagcctaagcacatttgttttgtaggcccataaacaaattcagcccattgcttaatgtctaggttggagggaaaaagagttaggctttctcatgtcaaatcagatctccctagggagtcgttaactcgaagacttgtgctcatagagaatcaagttgaaatctttcttgaagatgaatgcgattttctctggacttcaacggctcgtgcaacaaagatttgtgacaccgtcgtcaaatctgtcagaggcagcctctgaggagcatccatcgtagtgtctgaaagctgaagaggaagaaaatctaaacaaagctatggtgttgtatgctgagcccgaaccaacatctcgtagatctgagcttccaaacaaggagaaccaagatgaacatgcagccgtatctccagagccaacggtgattgtggaactgcctgacgagtgtgaatctactgttgttcatgtgcatagatctgagacacccattcaagctgagaccagaaaccagacttgtgaccaagttccaccactcaacaaccagaaccctcaagtggtgcagatctctgatgcgtctgaatccccataagctgttgactcaacagatctgtttgtgtcctcctgtctgctgaaaaagaaacagtctgttgttgtagagaggatgaaaatacagaagactaacgaaaagaaggaagctgttcaagttcttgtgcagaaattggtctccaacgaccagtgagggatatgcaagtatagacagggctttgcttgtgtatcggattgcacacaagttgtcttttgactttgtgcgtgactgggtgtatgagttttctcctgctaagatcaatgagctgtttggtctggaatacatggatgttagaactcagcgaatggaaattgcaagaataatggatgatgaggtagccatatatctgactgatggcaaagagaaggctttgaagaaacttgtggggaacaccttctctaatagtggcaaagagctgttcaaactctgttgtaccaactggtcaccaactactaacgatgcatatgcacaaccagacagagctaaacttgtgttcatggttgcacacaagacaccgtttgatttcgggaagatggtatttgagcatatcatgcagcttgcgttgaaagccgaggcaaaactctacattcctttcccgagtcttgtgtatcaacttcttcagtcgcagcatcctgtgaaggttcatgatgagaagtcagtgcccttagtccagactaagaagaagactgcaaagaagccatcaacacaaggagtgcaaactggtgactccactaatggttcaggacatcgcagagcaatgaaactggccattgaagttctgcagacggctttagatgctggtaagtgtttctctgttttcctctgaaatattatatttctaatgatgtttgtgtgatttttgactaagtcatgtacttaagcagaaggagatgtgtcttattctgatgatgatgggggaaattgatttgtgggagagcttgatgttgtttaacgtttcaaatctagtttttgacaagcttgtttttatttcagaccatgcttttgtttttgttctttttgaactgatgatatatatcatctgaaaacttgggtctgtaataaggttaacacggctacttggacgaatcttatcttttgatatgtatgctaaaaacgtttctagattttgtcttcttgctgtgtttgggtttccttctgtttcattttcaggtcttgtcagggagattgtttgattcaaacagttggtagaagcaaacctggtttggctgcagtagtctgagaagtggttggtcatcaaagtgttttacgatacactgatttcaggtaagtgttttcaactacttatcctgatgtagatcttctgtaactagttgtttttaacttagttgtgcactcaagcagggggagatgactctggtttatagaatgcttgattgtgggggagttagacagactgttgactacttagtaatgttcatggttgactgattacttgataagtattgttgactaattactagttgagtagtgttcactgtttatgggggagacttgtttgaatttgattcgttttaagtttagacatagtttcgctgcctgttgttagaggagttcgttgttagaattcttctgagtgatgtgaacggttaagaacttgatttccgctgctattgatgttttgcgttcttaacacagttctgatatgaacaagcttttatctttagctagatattgcttgttctgtttctttttggttggtttgtttagtgtcttttcaggttgaaccagaaggatgcttgagtatcaaactaagtcaaaaagggagagattgaagatgcagattctgacaacaacgagctgatggagatcagggagctgatggatatcaggaagctgcatcaaatctacatcaaacgtttgagctgctgacatggacgcgtgagctgacttggaggagctggagtggttgatgtgacgagccaagaagctgtgctgacttggcgtggtgatcaaagacgaaagtcggttgagaagatttggtgaatattcttctcaacaagttaagcaaagagataggcttgaatatcaaggaggatttcaaacaaggaaagagataggcttgaatatcaagaaggatctcgaacaaggaaagggataggcttggcgatcaagaaagattcctttagtgattctcggagatcatagggtttagggttctggagaataaggtataagtattctagagctagcatgtagtcgctttaagcactatagaatattgccatacgtgtatagctttcgaagcctagcaaaagcttagaaagtgggtgtttgtaatccctactcttcacaggcgtgtgataagaaacagaggagtgattaggcttagatttgttcttagtcggggttgatcattcgggtagaatatgtcaagtaattgccgagataatagaatccttgtaaaagatttattatcaataagaacaagtaaaaagcgtttatttgacgtgtttaaaacaaaatcagcgtgttgtgtatcctctataccctcttagtatctaacattttctacaaagctttttatcaactacgatatggaagagattaacgaattcaaatatgaattatctgattacattttctttagtttaaaattgtttgtcataaatttattttaatgaagttatcttatcttgtggcgaatattgtttcaagccaatcttccttcgaaatttttcgttcgtctctattcaacggtgacaaaagaaatattaatttaaaagagaatattagagcttataattctatgtttgtgttcaccacttctatgggtgataatattgatacttatgttagcgaatgacgtatacgtggagcaaatgtataccgatttcatagtcaaaattttcatcaaattggaaattacttccacatgattgcgaaaatacaaacagaattgtcgcattgaggtatttatttatctccttctatgtgtacttaattaataatcatttccgcatgtactaaataatcataaaattgcgatgatttttcaggtactttcgagaagtatgatacatatttctatgtaatctcaatgtaaacacatttgcaaaacttttatactcacaaaattatttatcttatacgttatattatgggtttgttacactatgaggcactttcggagaaacttaattcactttaaacactttaaaaactagaggcattttgccttgcttttggagtgaaataaaacatatatacccccactaattcgtttgagatatcactacaaaccggtttatggttacgtttggtattggtttaaaatatacggttataatggtcggtttagaaaaaacagtttgggcgtgacgacgatcgtcggatttcaataaattaaacggccgagattaaacattgtaacttcccttgctttccgagtttaaaaaaactgaaacacgagatccattgaaacacataagattttgggtttcaatcatcgatctttgtccaactgtcgtgtccaaggaggtacgattgttgaaaactgatatcatgaaattaaaacgaattttcgtgcattctatttgttacgggaatcagaacataatcaactttttttttccgtttatatgtacagggatcgatgaacgactatatcatggttatatgtggagagtggttttgttcttcgactggagagtggaaattggagatatgtaaccaacttttctcaagggttgtaccaattcatgagggaataacattggttgtgttgaacgaagcacttctgcaggagtttggggtcaagggtttaaatcctatgttaagttactctgtaccgaataagaacatgtttgcaacaaaggataagactccaccggttatggttacaagcgagattggacttcaatactatctaaagacccttagagaaaacaggggtctaaacttgtttgtgaagtttgaagagaaggttgatacaccaaatttgagttgtgaaacgctaggaggtagtgcaaaaaggaaagttgaaagtttgtatgatacagctagtggttcgagaaatgctgacacaaattctggggatatatcttttggtgtttcaaaatctcctaatgttctggtgacccctgtagacgacgaattcatggatgcattacacgatgcacaaaaaaaaatagcaagaaatgatgggctgaaatctaacgaagaagtaattgttgatgatgaagatgacatcttcgtggatgacttatttggggacaacaaaacagaggaaaccgaagacgggatagatatttttgatgatactatgccctgtggcggatatgataaagagttctggggtaatttcctgtcggatgattatggttgctcaaatgctgaagagttgatgtctaagggtggagtagatgcaaggtacaagggaaaaaataataaagacgtgagttttgagggtttaaatgataaggtaggcactagtgaggataaagttgttcagtgcacaggtagtgttgtctttgaccacgctgtgtttgtgagtggtggaggttcaggtgtaaacgcagagaaggtaaaaacggaatgggctgcaaaaactaaggttggttgtaaagctgggagctctcacggattgagaggtggtgcaaggaagttggaggaaattgatgatgaggagtttgatatcccaccattatttgaagacatcgagtatgaggtagagaacataccggatttggatttagaggatgatggcaaagggatatacaaggggaaagtgtatgcaagcaaagaagattgccaaatcggtttggctatatatgcgatcaagaacatgtttcatttcaaccaaacaagaacaaagtggaattattctgttcttagttgttcagatgagaaatgtgattggagaattttggcgacactcatgaaaggtactggctactatgaaattaagaaagcaagtctggatcacacatgttcgttagatactagaggacagtttatgcagaaggcaacatctaaagttattgcatccgtctttaaggctaagtacagtgatcctacgtccggtcctgtcccgatggatctacaacaactagttctagaagatttgagagtctctgcgtcatacaccaagtgttggagagctagggaatcagctttaactactgttgccaggagtgacgaagaatcatactgctatctggctgaatatttgcatctactgaagctaactaatcctggaacaataacacatatagaaacgcaaagagatgttgaagatgagagcaaagagaggtttttgtatatgtttttagcttttggtgcctcgatagcaggatttaagcatctgagaaggatattggttgttgatggaacacatttgaaaggaaagtacaaaggggtcttactaacagcgagtggtcaggatgcaaacttccaagtctatccacttggatttgctgttgtggacagtgagaatgacgagtcttgaacttggttctttaggaagttggagcggatcattgcagacagcaaaactctgactatattatcagatagacactcgtcaatccttgttgctgttaagagagtttttccgcaagcaaatcatggggcttgtattattcacctttgtagaaatgtccaagctaagtacaagaacaaagctttgacgcagttagtaaaacatgcaggatatgcgtttaccggtacaaagtttaaagagcttatagtcagattgaatccacgaaccaaaattgcggtaagtatctacatgatatagggatggctaattggacaaggcattatttcaggggacaacgtttcaatctcatgactagcaatatagcggagacgttaaacatggcgttaaacaaaggtcgatcgtcacatattgtggagttgataagatttatcaggtctatgttaactagatggtttaatgcgcgtccgaagaagtctctcgaacataaaggtcccgttcctccggaagttgacaagcaaataacaaaaaccatgttaacaactaatgggagcaaggttgggaggatcaccaactggagctacgagataagttgcatgttaggtggaagaaatgttgttgatcttgagaagaagcaatgtacttgcaagaggtataataaactcaagatcccttgcagtcatgctttggtggctgcgaatagttttaaaatttcctacaaggctttagttgatgactgtttcaagccccacgcatgggtttcgagttaccgggaagcagtattccctgaagctattggaagagacgaagaaatacctgaagagcttgaacaccgatcgatgttaccaccatatacaaggagaccatcagggaggccaaaggtagccagaattccatcaacacgagaatacaaggtaaggattttttttttgctaaagtagtactttctaattgattgttaaaacctaatgcataatgtggtgtgtacatggtaaatgtagaaacctaagactagaaggacgcagcagaactggtgctcgaggtgcaaaggcacgggtcataaaaggacaagttgtacaaatccaatttgaacaagttgttacggtggatgactttgagattgctatttaggatattaattgtttttcttttgtaatgtaatgcgtaggtgtaaaacatataaatatttattgagtattggatgctaattaggtttttcatttatactgcttatgttacaccagggactcgcaataatgtcgcagaaaaggtacaagtagatgaaaatcaaatatttatgttttctatccaaatatagttgaccatcagatcatatccaatcgttttgattcaaatagatctatttgttaaattagttcgattaacatgcttcaatattgaaagatactccaatcaggtatatgttgaaaatttagaaattgtgagcaaattattttcagatcagctcagatttaaaaaatggaattagaacctatcagccatgtaaacaaacatcttttcccattatattcttttttaaaacttatgcaattgccaaatttctactaagaaacaacgtaatgtaaaagccccatgtaaggttacaagtttgttggttttgaataaaaaatgtggatatttattgaattggataatatagaatagagaatatcgcctaatacatgtgatttaatattatatagcttagtttttaataataaaaaaacctttaaaaacttggtaatgaaatggatgtctctgaatacttacatgtagataggaaatgaatatttatttgtctatccacacaccccagaccaataagatataaccaatcgttagtatttttgaaattagtatagttggaaaattttgctatgcatgctccaaaatcgaaagagtccctataagtcatgataaacgagaaagatgttcactagtttatacgttaaatacaagagagaaatacaacttcataataagattacattaataaactagataaaagagtaaaacaaaagagatagttatattctgaaagtgggttactgatgtttttaaataaactaggaaagcagaaggatgtctctgaagaggaagaagtagatgcaatgtgaacatctcccaccattatattcgttgtaaaattcatggatgagccaacactctggataatcctcataatgaaagagctcagcataagatccgaatcgttttggttccgaatcagaaacgtgcccaattagtgtcttggccatgatatctacatctgtaaaacacttgttctctcctttgaaagtattaaaggcgtctaatacttcattacctgcgcaacggtttagagcaatgtaaagaagtttggctataggaatgacatctttacaatcactcaataatgaaatggcgccaatcaggtccagagaacagaactctaccttaagctttggagatacatagcgtaaaggtttcgttttgcaagacattttgagtagaatgagaagtgaacagagtcgggcgaagacatgttgatgaagtcagacttttatctaaacgaactcgggatagtgtttcgacagagaaagctgcagatttcccttcatgaccagattttcatagcctcaattccttcttctgaaacgtggctaacatttagtgcgagaataggttccagaatgtgtaatcttgcaatcttcctctgttgacaacgcagacgaaaagttagagaagttacatatactttgtggaatgaatgtaaactatattgtttaaaaaaatgaaaaatttaacctgtgtgtctctaggttgtgtgatagagtgtagacatttggatgatgtactcattttgtcaatctgttgcgaataacgaaagagtaagatgtgatggagagagaagttttagtactgagcaaaacggtttacaaatgagtaataaaaacagagtaattatttggaagtttctcttaataggtcacaatcgtgagggatgaagcttaatggggagtacgggttcagttatatattaactctaaatataaaagctaccacttgaattccattaaagcaaattcatatacaaaaatgcaagtcatagttctgaaacaactctaatcatttgtataataattgtgacaccttatagttgaaaactcgaacaatatataaataaagttggcgaaatatgcaaaacaaactaatacataaaaccaagaataaaaacttagattcaaatatttgttctgcaatcgagaagaacgataagatgaacataaatgaaattggtacttctgaaagtattacttatgaaatgtgtacaatttcatgggacaggtaatagtaaatagatgtgttacaccactgtccctcgtactcattgaggttctgatggtccgaccaacactcaccataatcctcgaactcccaggtttttttgtatgtcccttggcgacgtggacaaacctcgttgatatggaacattagtttatctgcgaataagtcgacttcactaaatttgtagtaccttcgcttgtattgaatataaaattcccacggaattgatcgagcgcaactatggagcatgatgtaaagtagaccagcatgtgggaaaacatcctttatgacatccaatatagcaattgactcctggagctcaaacatatgaaatgccaacactaaactctgaagatatagggcgtacggattttttgcggtgaggcatttggtgtaaaacatgtgataactagacgattcttcagccatatgaataaaaaaaggggacttatctattcgaacagaagaaaaggtttcacttgaaaaaacagcagcttttccatctggacctgattgaatccaagcctttaacatatctacatcgtcctcagaaactaagttgactattttagctgctacgtgatcaggcatgtggaaatcagggaacggaggaggctgaaagaaaatgcgtactaacgttaacaccaaatttgtgaggctatatacaaattcaaaacaaaatttcgcaatttttggatcaatttcagtctatataaaatgagtgtctcaattcgattgaaatttgttttgagtaaacattacctgtaggttaaaatgaaccaaaggttgacgaagacgctgcacgacaaattgatttcccctaacaggggcaagggcacttgggggtcgccagtaatgtctagtaggggacattggtcgagggtgggtacattttcttttctcgcagacgatttttgacattttgaattatcaaattagtatagtactgaaagtgaacaaataacgatctaaggaatttgaagaaacaccgataattaaagaggaccgaactaggctgaagggaaacggatttgagatcgtgatgaaatgggaaccctaattctctggacaaatgagtagggagtggtgtggtggagcgatgggttaccgaatataattagtggatcctataaatattccaaaaaattgttcgtgatagtaaattagatatgtccatattctcacgtccatgaatatatatacgcatggtctataatatattacatagacgtgctacagtgatttgttacagccaatttagccggaacttatttatggggatttaggttcgaaattttttttcttcatttttttcgtaaatttgagaagagattagattttatatccatagactgaagtcattaaagacaaaaaaaatattgttaaaacgataaaacttcgcttatatagaaatgtagatggaatgcaaacaagaattaacataacaacaaaacatcagaaatagaattttaaacagtttgagtaagttattatggtttgacgttttacaaacagttgtgatcctgtatgtgggtaattcttcagttttaaaacagttcaacaatgttccataggtaaacttaattcagacacttgattactattgtaatgcttaatctaagtttttgttgcaataaataaaaaggagaaattttgaataaataaataacttttttattaatatataatatcatttataaaaatattaaaacattgttggaggtaaacataagatttgaaaaaaacagaaaagaagatgagataacaattgtaagcaacaagcactttgatagttctaagcatcttccattagtcgacaaccattttgatttcttcaacttcctcaacatcaggttcgggatacatggttgatattggcgcatggctaacaatcttaaaccagttacaacctggataatatctaacaaccttccaccaagcaagtgcaataacaacattgttcttgcgaaatgctcgaaaccttttctccaagtccactgcaatttgtccataagcctcgcattccaatgtatctttgctgaaaatcagtaaaaatatgagattatatagtaaccttactacaaaaatgtataaacatgatatgtttggaaaaaaactgaaaattgatgttgaagaaatgtgtttttttatccatgatcatgaacggcagtttgaatccgaccgtatctttcccgttacttgcggtattagtgagaatcccaatcttcacgagtgcaccaataacatctataagaaatatgtcggagatatgtgtttaaaaaaatattttttttgaaaaatgtgaatgaaatttatgaagaagccattacttaccaaccaaggtatgtttgccaacaacatcatccacaatgtagtcaaatggagtgaacttgttgagtaaactagttgctaaaggtgtggaagaagtgataatggtgtgatccatgaatagaatgcgaaactcatgaggagttgttcttattggttcgcagttaggtcgaacgagaaacgtacttatcgttttccattaattctcttggatcctgtcaaagtagaaggcagagaaacgaggtccgatggttgcttctatttgggtgccctgttacaaacaacattttaggggtgagggatagacgggtaaataaaaattccgcaaattgcaaaataaattgaagaaaattgtttacccattcatcggccaagacaagacgtagtttgaaatcgttcgggttgagcaatttaaattctcaataccatgacacagatgatccagccagtaaccatcggagacaactcgtaaagattatgatgttgaaccatcgtgaacaggagaagtaaagagtaacgaaaactgagaaatatggtaagctttagttttgttttgcgtttgtgatgtggttgtcttgatgaaatcgtgagtagcagttgaatctatacaaactgaaacgatgtaaactgtcataacgacgtgttgattcgtcgaaggaattaaacattgtaacttttaattaaaaaaacgttggttctatgaaagttcaataaagtaaaatagagtttgaaatacggtatggggatttaatttgtcttgtactaagcattaattcggtttgacctcggaaattcgtcttgaagcaggttgcggatatcatcaatttatatttgttcataatctttttttctgtccaaaataacatgtccaccgataaccgtccgtttggatgtaatataaatattggatctgagttttatgacccaaacgggttagcatttgagaatcttttctgggaaattaacttaatcaaacgtgctcaacagattcatgtcaaccaaaaaagttagttggaggaatggatgaatttacctaggattaaacttcaaaagatataagatatatcaagtatagaaatgtacatgacaagataacaatggacacattatgaacatattgatttctatgcttcatactctccgtaaagctccacccataaggtagctctatagcattcggctgcaaaattctcatatgctattggtttgtacaatacagcattcaaagcatgtgaatttttggcttcaagacattttgtgaagaaatgataatagatggagtgcgtcatggaccaccacatgtaataacgagatttgtcaacgcgtacacaacttagagtttcctttgaatacaaagccgatttaaatagtggtccagctttcacaaagggtttcagagcatacacgtcttcttcaacaacgtagctaacaattttagcaagtactggtgccggtatgtgaatttcagggataatagcaacctgcgtaaaaaaaaaaaaaggtaggaaacaattggttttttgtttatgttggatgtcaaacgtataaaactatagcttatgatacgctgcactacctttttgacacctgaaacagatgagggttcactcatgtcgaccttcgttaacttgagcataatttctatgttttgaagttgatactaatggaatgggtatggaagaaacttaaacgaatcgtggaaggtttttgtagctagagattattatggttagattaatttttatatttttccggtttatttaaagttgtagttgtgaaggtgggaatattcccgttatggagtgaagtaaaattagattgttctttcaaggtaaaagagaataataatattctctatataactaccacatgatctacatatccacataaaccttttgacttttagttaactaaattaggaatatttactttaaaaagtgtcgctccaaatcaaaacttatctccgtaacacttgcgaaatggttaagataggaaatattctgcttttcaaatttcagtttgtggggcgaaattaaaggaagtagaagaatagaagaatataaaccatatccttttttaaataagtatccacgatttctccccagtttagaaattattccttatttgatttcttgcgagcatatcaataatgagaagacagaaacgaagcagtgaaccatccgccggctgtagtgtgaaaatggtttttcatacattacaaaaatcataaactctcctactttatacttttatttatattgtcttattaggtttttattttttggccaggaaaccaccattcaagaatttcacatgctccctctattgcttgctaaaattgttagctacctggctgaagatggcgtggatgcattgaaaaatttgatcaaagcaggtccggtatttaaggaggctgtgtattcagaggaaacactatgttgtgtccgacttgacagatctcggtatttcatgtggtggtcaatgccacactcgatttattatcatttcttcaataaatgtcttgaagcaaaaaatccccatgctttgactgctgtattgtacaaaggaatagcatatgagaattttgttgaagaatgctacagggcacctttatgggtggagccttatggagaggacggaggatgggtacaaatcgatggagcttactcggcttagccccgagtgcgagcaatgaatgcaaggtgctgccgatgcaaaagtgcagcacagaaaacttgtccaaatatgtgaagttcgattttaatgttgtcttttttttttaaccattaggaacctttgtttttcatttattagctcctttctttttttctggttttagttttccaattatgctacattaccatttaagatgtggaccattctactaagtaagtaacaaacctttagtatataattagtataaaataataatccacatatcgtataccttatggatataaatatatggatggaacacaataatataatcaagctctatccattacaaaaccgcatatcacattaaatccatgtataacatataaaatagagattgttccttttgggagtaatgaaaaaaaaggataaacataattcatacaacaacaattatattatgtttactattcaacaaagcaaaatagaacacacacgttcagaaaatagcttacaaggtgataatattcaaaaggaaagttaagatggttaatattacaaaaagcagagaaagtgatcacttgttactaaagtcagatgcatagagggggcagacaaactcctcataaatgtccatggcatatttacgcctaaaagagtcaacgtgcttatctgttattttcgccatgttctctgggggattatcacttgcttgaatctcaaggaacttcattcccaccgggccacagtcaccagatcacaaattcttatataagccatctaatcgcttccaataaaaagctgaagaccatgatttctgagaaagcaaggacaccaacacctccatatgctaggtaaacaattgttgacaacaacaccaagaattagactttctcactaaagattataaaggtaatattggtaaaaaattgttgattttatactagagttgaaacccagtttgtaggcttggcaagtgatagaaggaatgagtttgaaattaagaatccacacgaagtgagatgttcactgcgaggaaaaaaaaagcataagcttataacaagattataactgtattggtgataaataaaatgaatgtataaccatacgtattcggtgcatcggagagggtattgcgaaacagtgcaaactctgatttactcattgaaggtaaaagttcatatgaggccgtttttgattttgataataactctgctacaagaaaaactttagcttcagacagaattggtttctctctttcttccgccggagatgaatctgaaacatcaacataacattcttcctgtacattataatgtaatattagtgcaaagaagaaaaccatcataaggtttgaaagtaggaacattagtttatagtattaaagatgttgtgtttatcttatttagagcatacctggttatcatccagatcatgtgccccaatgtctcgagaatcagtgatttgatcctgataggatatgtcaaaaaggataagtaattatctgtatgaaaatattattgaaactgatatctaaaaaacataatttttggagagatggacagaattatagtatttgaaaaaacctccgttggagtgggagaagattctgattgtttgtcaggtttggaatttgtatcataaattggatgggaatatattaccatagcctgcaataatgcgattggttttgaaaatgtattaaactatcttgaggaaatataaaatgaagagacctattataagaaaaatatcctacaaattattttgtaaccaaataatcatgtcgaataacacagccttgttgttactgtttaccttcatggggtcaccttcgaagttgacttctggtggtgtctgtgacataaggttgtccaatttaaagtgaacaagagagcctaattaagtattgacataaggttgaccttcttttttgcgaactttgcaaaccctaacaatgaatgagatgctggagccgcctccatggtgtcctgaatgttgtagaacacaaaaatatggtgagaaaaacattagcaaatattatctgcaaattataacgtatccacaaactcctgtccaatataaataattaacttgctatagcaaaatttatttcagacataaggttgacatcctttttaaagacaataattagttcatacataatcttgacttctttaagaacataattagttcattcatagttcagacataatcttaaagaaataccttcgcctgctgttcttcagagctttgttctattggcagatctatatcagaatgtgatgcaggctccctgtccaatgagtcctgaaagtaattgtcaaataaatctgttgtgttaaagataaagagaggaaaatagaatatgtattttcgatggttaaagaaaggctttggctttgatttgttgtgtttgtatttataaaagtacctgcagtttgccataaacatctgtttcattagcattcgtttgcagttcttcagagttgtgttcttttggcagatctaaaccagaatgtgttgcaggaactctctctgatgcgtcctgcaagtaattgtagaatggatttggttaaaaaaaacataaccattggtctgcgcagtaggtccaacaaatactatattatcttacagcaataatatgatcttggtggagagggagtagtttttcgacgcttggatctgaccttggatcaacctgtttggaaattacaatagtcaatgtctcttatatatataagtcattatgggtgtccaagaaaacctgtccacccaggattaatattaaagacagcacaaaaacaaaatgtagttttgatggttaaagaaaggctttgatttgttgtgtttgtatttataaaagataaaagtaccttcatttggctatcaacatcttcctcattggcattcgattcctgttcttcagtgttgtgttcttttgacagatctaaaccagaaggtatggcaggaactctctccgatgcgtcctgcaagtaattgtagaatgaatttggtcaaaaaaacaaatataaacattggtctgcgcagtaggtctaacaaatactatattatcttacatcactaatatggtcttggttgagaggaagtactttttcgacgcttgggtttgaacttggatcaacctgattggaaatcacaatagtcaatgtctcttatatatataagtcattatgggtgagcaagacaacctgtccacccagaattaacattaaagacagcagaaaagaaaatttagttttgatggttgaagtaaggctatgatttgttgtgtttgtagttataaaagtacctgcatttggctatcaacatcttcctcattggcattttgatctttgacatcagtgtcataaacagggttgccttcatttgcatcatcattattagagtgctctgattgtagtggggtaacaaatacatccatggggtcatcagtaatctcctgcaataagatgtgttaacgtcgttaattctaccaagtttgtaaatagttgaagttaactattacactaaccgtgtttatcaatggggtactatcactggagtcttgagctttatctaaatgatcgtctgggacttgctgtgcaacttcaggctgtccaaatacatgcttagacagcgtgtgtgactgagatgaagtctatgagaaaattaaaagatttattatgacagcctgaagttgaagtctatgctaatgttcaaatatttaaaacagtttgaaatcttgaatacctcaggggtttgagattggatagggacctccattgtcttcttgcgctttgatctagaagaacatgcaacaaaactggaggagagttttgtggaccgcttgaatctgacagcttttttggctttttcaagcttcattacacggttcgatagctcttccaccttagtttgtagttcactaatgagcctagacttctcatcatcagagagattgagtaccggtttactacgagttgaataccttcgcttggatttgggagccacagacttcacacctaatttcttctctttcttcttacggtccacattgtgctttttatgaacaccagatagcttcttctttgggaatgaaattggaggcaatgtggcatcacctcttggccaatcggttttttggaattgatgagatgccaatatcaaatcatacatgtatgcaacttttttatctttcacctcatcgtcccactctgcccaactttggtcagcattaaggtctccaactataagcggatccactggcagctgtacaaaattagaaggttagtaatagtatataagactggatttatagaaagagaatattatagacacaatataaataattgaggtgaaaaagaataccttaaggttgctttccaaagcatgaatctgaggaagcgatataacttgttttggatgagttaatcgtttccaatggaggattgtcttagaggtcgagtcatctaacagcaaatctaacagtccaggtatgttacgaaatgctatgagctgcaacgctagggggaaacctttcaaacggaatgttttctgctgaagtcgactcaccaaactcttgatagggtcagttgtcaactgtcttttaccagtggacttaccgggatttcgtttgtcgggtctcattcctactacagtcttcagaaaagactctctaccccaaggaaatgaaaggaatttatccagatctgccaacatctctacatatttatatgtaggtctactgatttggttcgatgctatgagtacaccatctacaataagtagaaacgcgagcttaagtctgtggtcagatgacaatgtcttgcgtttgttggttagcatgtcagaaacatcccctaaggtaacagtcttgtctggaccaattaactcgtcccagtaactcttcatgccatcaacataaaccggatcatcatctggatcataatcctcagaaaactcaccacagggcaatcacttgcaaattcaggtaatgaaaatctcagggggtatccaccaaatactgtccacagctcatactttttctttgttaccagctgtctacatagcaaggcatgcataagcttaccagacatcgcacacttactaaccggcaaatggaatagaggtccaaagcaacattgaagaatgaaatccaattcctttgtcccctgaaagtccttccggataaaggatagaatatctggtcttgagtatatatttagccttcccctcggatattgatcgatggcgaagagtctattaggaagatttgaatcacactgagaagatggttcctgagacgttgaccctgtcattagcaagaaacaagttcagaagattaagattagattaacagataatatgaccaaataaaacgagttcacaaacgtctgtctattgcttgcctagattagattaacagagtaagagtaccttccatagtgtaacagaataaacttgtctgccaatgctatcgatttagatgttaaactgtcttccaaatcctgtaaccgaaacagataaactcatcttagatatggcagtaatagatataggaaaaggaaattataactatatgcagatattatttttttaaaacaagtcaaaatctgaagtatctttttcatctccacaaaagaaagtcaagttgcaaatgaaactgacaaaataccagagagtgaacaaaacaaagttcacaaaccagcataagattaggtgtaatcactaaactacagcgaaaataaaattgaacggattagaaaaggatcactctgaagaaccagcagaaggacaactctaagaacctaacaaagccttgtaagtgaaagaaaccaaaaataattaaggctacttcagaaatgagaacaagagttagcaaaattcatcaacaaattatatggttttgtcaatcaaatgagtttgttacaaatgaattacgtttccaaaacaaaaaattccattgtttataactgaaatacgaaaagaaaactaaacaatgaaagaattcacataaagatatcttactaatgggattgtacaattactctattattgttttttgctaacatataacttagaagcaccactaaaatgcatatcaaacgaataaagattttagttctgaagcaagaaacgaaaattacagaaaatcttatgatgaaagaaagaaactctaattataacagtatggctcatctctagaatagtcaaatatggagtaagctagtgacgctctgcgagtaagtcagaaaggtacctgaaaatgccaaaatatcagagagtaaacaaaacaaagttaacaaaccaactgaagattagttactgaaaaatcaaaacacaatgtgaattgatgttatccaaatatagttgaccatcagaccatatccaacatgtttaagataacagccaaagttgaaaatgccaaacaatcagtgagtaaaacaagattagttactgtaaaatcataacacaatgtgaattgattcagtgccctgtccacaaaaagggcgagtgctaattatgaactgtaaaatcataacacactgagtcatattggtgctagcttacctgaacttgcagaacactctggtgagtatttaggcccgtaaatgaacctaaaatccaaaaaaaaacagatagacacaaccaccataagtgaaaagctaaacatgagagaataatcataggatcaaggtgaagtggaataacctaacaaagactagtaagtgaaagaaacccaaaaaagttaaggctttacgagtaattgcaacaagagtgagcaaaattcatatacagagtatatggttttgtcaatcaaatgagtttgtaacttaaatacgaaaaacaagaagcgagaaccgaagatagaaactagaaaataataatcaaacagccaggtataactgttttagagtttcgacaattcaaattttacatgaaacataaatccaattcgatataagaacaatgagaaatttgggggaaatatcggtggagtcttcagaaaaagaaagtcgtgtgcggcaatggtggtggacagtgacggagaagttagagagaatttagggtttgtgagcgaaattagaagtcgtcgtcgtctgcgtcttcgtctgagcgaacagagtcaccggaaaatcgtctgcgtcgtcgtctgagcgaacagagtcaccggaaaaactgaaaaggatgacgtcgccggattcgtcttctacaataaatagtaatttgcagttttttactggattaggtttttacgcgactgaaaaagtcttcaaaactcaaatagggtaaggtaactgcaaattcgacgagtggtttggttaagggatctctttagttaatgcgggtttggtttgaagacaaccggttagggtaatagagtaactttgccaaggcaaagtgcctgatgattttaaagtgtcgaaacacgtctaaagttatgaaaaagtgtctgagtatgcaatattctcttatattattatgttgcttgttattgttttttttggcgtctctagcgtcgtaaaccactttatatatatatattccttcccctaattggttagtgtcttaccttacaactacaaaacactcatcaatatttaaattaaaaaattcaaaagcaaattttaatttttgtttttactaaataaaaatggaaaatatgtggaaaaaacgccaactttcaaaaataagacaaaaaagcatcaacttacaaattgtcattttaatcacaaagttttagttgacgttttaagaaaataataaagttttgttgaccaagccaaaaaaggcaagacgttaaatctccgttagaatgacgattacgtggtttagtcgctgttaacggcttccgtctttgcaaaacgacaccgtctctgtaatgacaatatgacgtcgttttggtcagagagaaaactcaataaccccaaatcgattagaatcccaaatcgaaaaccctagattttttttccaaattctctctcgagctcttgtcgattgattccgatgaaaatgcgagtaggaaataggaatcctcgtcagtcgcggaggctgaaatctatggtagacggcggttcaagagcaaacgatcctatgcccaaagaaacaaagacagttgtaatcgaagatgagattgaggcggtgtctttaccttcagagattgaggcgttttcgatacgaccggagaagaacccaatagaagacagtgaggcggttcctccacggaaacaaaaaaagagaaaaaagaaaactcgtgaagatatagaagtagattgtgaagttgttagtggggatgattatgaggtagtcggcgatgaagactgtgaggaggttgggtatgctgacgaatgaatcaggaacgatgtagaggcagctaatgtgcttggggacgaaaaattgaccattgaagctgttctacaatgatattccgaaccacctattggtgaagaggaagctaatgtggatgataatggcgatggaggtgcatatgaagacaatgtcgatggaggtatagaggaagaacaatgcgataactttgaaactgagtttggagtgggtgcgagagaagatgataatgaaagtgatgcacacagcgaagatgaaatctgggacgatgagaggattctagagcctatgtcacacagtgatgacgatgaagaaggtcctgaacaagaaggtgttgttcctcaagcggaagatccttacgagctactgaggttagggaagactttcaatggcccaaatgaattcaagatagccgtcctaaggtactctcaaaaccatatatgacatctagctttatagatcacaaagttagagaattggtgcaaagtgttcttcaattgatgtgaaatgtccttggagatatttttgctcgtatgataagaagatacataagatgcaagtgaagatatacgatgatgagcatgcttgtgtgaggtcggggtactttaagatgttgaagcaaggaaaaattgcttggttgtatagagaaagattgaggaaaaatccaaaaattacaaagcaagagatggttagtgagatacaaagagagtataaccttgtactcacagaagatcaatgttccaaggccaagacaaaagtcttaagggaaaataagcgacctcatgaagaccattttgctcggatttgggactatcgtgcagagatctttagatctaatccggattcaacatttgagattgagacaactcctagtccaacaataggtagcttacagaggttttttcgactctttatttgtttcaaagcacagagagattcttggaagcacacttgtagacttatcataagaaaactcacttgctttttcttgacttcttccactcagccaatttctcaacttgtgttgcgccaactttcgcaaatggataatgataacacggtattttagcccattttagctattattttcttatgttttagagagcatttggtgctatttctgagtcaagaaggagataaacatgtattttgggagccaaaaaggttttaatagttttagagcaaaaaagaccaagagatgaacaattctcgtatttcagaagtttggcactcattgaagatcttcccgtgcatcaaatctacatatctcggagtctatggagagctagaagagtcaagattaacatcaaagtcgaaacaaagcaacccataaagcttttcggaagaaacgacccgaagaatgaagacatgtctcgagaatcagctgcattgcgaagcaaccattccgaaaccaagcggttgcggagactcgtacccgggcggtctctcacgtttccctccggtcattaaacccgcgtccaaatcacctcctcttcatcccaccatcataaactttgacgaggagcccctctactggtcccaatcacttatccaaccaacggaattgacgtttccactcctaaacctaattcttgatccccaagtataaaaacattttgtaaaccataaacctaggggtgccatattcttgaattcatcccaagcaaacctagctgccgccgtgagcccccaagctgttgtcgcacctttgggctttgaagaacaccgaatctctcccttttccctagtttgtagaagatctattaaggtgaagtcttaccttttgtattctagattcaaagaagtaatctctaaacctttcttgagtattattcatctctttcttatggtcttatcaatccacccattgatgagttcctttacaatgcaagagtagatctctagttgggtttagagggctagtcaaaggggggtcgatgatctaatgtttaagtggctataactatggctttgtttaatcgtttatacggttctttctagttgagtttgttctaaatgcatgtatgtcctgcacgccacctagtacatgattttagaaattttatccttggcagaatcttgtgtaattgtaacatcccggttttaggaatatggtgttgcattcggaaaggtataaaagaatttatatgaccacctatgtcacgaaagtacatttatcttttccgttaactgtcctgagagaacttcacagttaagcgtgcttgagctgggaagtctcaagatgggtaacctttcgggaagttattgttggaaccatacgaataagaacaaaacatggggaaagatcatgtagtggtttgtagggttggtaacaagtctttaacgtctcccggacgtggcgtaccgactgtcagacagaagtgggcccatgggcccgagagaggacgtgaggctcactagtaggggcggtcgggagttacaagttgtatcagaggagaaatcatacgagagtggaatcaaaaagcctcacactgtacggggtgacagtcttggtgcgcaacgaggacgttgcgatctgttactggggtgaattgtaatatcctggttttaggaatatggtggtgcatgcagagtagtttaaaagaattgatatggccacctatgtcaccaaattgcacttatctttttggttaactgtcctgattgaactcattagtccatagttaagcgtggttgagttcagaaagtctcaagataggtgaccttccaggaagtgattgttggaaccatgcaagtggggataaaatatggaaaaatatcatgtggataatttgtaagattggtaacaagtctttaaagccatccggacgtggtgtaccgatcataggacaagggtgagcccatgggcccgagagaaaacgtggagcccactggtaggggcggttggagcgttatatgtggtatcagggccaaacccatatgagtatggagtcaataaggctcacaacgtagggggtgatggtcttcgcgtacaatgaggacgttgcgatctgttattggggtgaaatgtaacaccccgattttaggaataaggtggtgcatgtgaaaggtttaaaagaattaatatggccacttctgtcatcaaagtgcacttatcttttcggttacttgtcttgagagaactcctgagttaagcttgcttgagttgggaaagtctcaagatgggtgactttccgggaagtgattgttagaaccatacgagtgaggacaaaagatgggtaaagatcatgtggtgatttttagggttgggaacaagtcattaaagcctcccggacgtggtgtaccaaccgtcggacaagggtgagcccataatccaaagaaaggatgtggggcccactggtaagggcggttggggctttacaaaaaaaaaaaaatccgcaaataatttgaacctagatttagaagaacgtttttaaatttgaaccattatggtgcaacggattttttttgttaaattgtcctttgataactcgatagttaagcgttgttgaactgtgaaagtctcaagatgagtgaccttgtgggaagtgattataggaaccatgcgagtgaggacaaaacatgggaaaatatcatgtggcgatttataaggttggtaacaagtatttaaagccatctggacgtggcgtactgaccttcagacaatgggccatgggcttgagagagaacgtggggcccactggtagggacggtcgagttgttacagtaattcagttgaacctagctcacgattgaatattgtgctataaccttcgatagttgagttatagggccttatggactagaatcaaacttgatctgaatgttttgatctatgtgtagttgtctgcgatagttgagtaatagagtacagggagattagccggctctcgcctataacctagggttagtcgaatacgaatgagtttcgtatgtccaagaacttggaaataaacaaacataaccatgttatccttagacttgatcattgaacccctgcgatcccttgaatgcctaatgtttctcttattgctttcacttgcctgctttaccttcttatattgcttacttatttacttgcaactaaccccttcttttgtttattggtcctacctttactctcttccgacagacttctctgaaatacttctatgtatgtgagatcaatcctaaaatactactccaatttggtgtgcactggcagtagtcgtgtactctttcaagtaaaagccaggggcaaaataaaacatgcatcagatacaatactaggtacttcttcttctcacatgtataaggtagttgtgtatgaattgaagaaattgtacctcgcttactttttctttgtgcagttggtctgctaacatcatcagcatggtcaacttgactttgttcttttgatctttttggaacattatcaccaacattgccaataaatttactcttcttaccttgtggctatcaaaaagaataaaaacagctgttttaaataccttgtaaacaaaattttaatttcttgcaaatattcttataacaaaattttctcgcaatataatacattacttatttataaaaacctcatatacaaaccttaaataagatacaaaactcttttcttgttggaacatcatcatcagcactatcaacttgttgatagaatatgcggaagtatatgagaataatgagagatttatgaagcacaagagagagagtttatgagtcgtgtgttattgtattcgaatagaatagtttatatgtttgtttacagcccatttaaagacatacaagagacatatagccgttacacatgatcccataaagtgaaagcgaccttgtgcaagatagcgacatgaggagagatggttccctttgtctctagcggtgaaagttacaaaagagtgtgtttcattagatattagtctggtccggactaacacaactcatgatcatggcaagggttgaaaagcctaaaccgtgttcgtgagggatggtttatgtgggtgatccggctaagggtctaaatccgttttgaacctaagttaggttgtctgtatgagctatcaatgtagcgattctcggtagcccttggcttgtcctgccaaagagtgattcgggggtgttacaattagtggtatcagagcatggttcatgatgctcacgtgacacacgttttctaaaagttttatcgagtaaatgagtcacaaaagcaattagataaaccggtatgtcccgagttagtggggaatgggttagatataacccttgttgttgttgtagttgtgcgtttggattggatcgagaatggatggccgtgggggaccgcaacaaagattttaaagtgttaaagaatcctagccgagctcggcaacgagggcttgtaactcaagtgaggtctagtggggaagcgggtgagttgtttcagagaaaactaaggaatcgtgaaagagaagttgaggagatttttgcagaaagagtaagaaccaaggtgggtgatgagatgcgagttgtagagaacaagagtcgaaggtgtaactatcatttttgaggaagaaggaaaacggaagatgaatgacattaattggaagaatgatgagaaagacttattaatcggagtaaggtatgcgggaagtgatgaagacgagaagaagtaagtgattggaaggagaaccggttttaccataacaaaaccggttttaaacttaagaaccagtgtataccgatttgaccatgaatcaacaaaatcgaaaatacttaccaatctgattttgatcaattccgactttggtttagtgagatgttagtgacaatagattcgtatgagggagggctttctaggaaggtatagatcaacccctaattctccccaaagctctttggaaggctgaaaacaattcagcacgaaaccactaacaacatatgccacaaccaaccaaaagttgcaaattgacaatggatgcggcttttaattcgttggggctttaaaacgcatatatatacaacatattaaggttaagaaacgaagattcaacttgccaaaaactctccttcgttttcggaaaggatcaactcgatttctacctcttttcacgttttttgcatttcggtccccggtcttttatctagttacagattctaccctagacttttaaattcctcagaaattcccctgaaattagacagtttcaacatgatcaatttaacccaaaatctgattcttcattttcttttaattacgggcgttacatataaaaaagaaaatcattgtcgtatatgttccaatatatacatacacatataaacatgcttataataagtagtcatatgatcttttgattgatatactgttattaaacaaaatttattgtagtaaattacaaaatttattgtattattatttgaaatctgaaatttgcttgtgtattatgtaatgtaataaactttttaatattatttgaaccagtaactttttgtattaaattaattgttatccacatactgatttatattaattttaattgatatgatatggtttagaaataatcatttataaatgtattggtaatatttgattataaaaaataaatgtagtttatatattaaaatctttattaacatataatttttatgtttatatataaaaaatgaagtacttatatatgagttccgaaagattatttgcataattattatgatgtttttaattggaatttcatttttaattaattactatttttaattagaaaatatcttttattttttgtttgattagttgagtgaaaatatgtggtagttatactaatgtcaaattgatgtaaatattttagtaagaaaagagcaactaatgaaatgggctatggagttttgtgagcgtgacacgtaagcatggtatttttgttaatacttaataacatttcagggtaaagtttgttttttagaatgtttctctattaatatataggggatttaattcattaaaaattaaaaattcttttgttttaattgaataacagtataaatgattgaattcactatgtttgtgtaaaaattgtgttaacgtgtttgattaagaaccaaaatatgtggtcatgggcttgaattgtctaaacaatttcacattcttaatatgaaactaccaaatgataaaatgtgataaaatgtgaaactaccaaataatatttaatcaatccctcatctactaagtcgcagtttgtttgttgttcattttctttttacagtttttcttaatttatttagttttataaattttcacgtttcaaagattctgttatttgatgatttattaatcttgaagggattttgtagtttcaaatcagaatgtgctaacaaatgcatatctatgtggcatcccaaaggaggagattgtataggagatgaaggtgtcttatattgttgtcgttaccgctgatttatgtctcaaaatgattctccatatctagccaattccatatctatatgtagtctcaactaaaatatgaataaaatatatattcaaatatttctaaactatctcagcacatcgtcctactagtgaaatatagcatcaccgcaaccatgcaaattcagaataacgaattttttaaagattttttttgtgttcagaataataaaattcgactttgacaaaatagacattccaaatatgtaaaagagcattaaaaattttttactagttttgaaaatggaatcttgcaaaatctgccatattttgttttcaatcttacaatccctgccatattctacctcagcttaccaaatctaccacatttcatcacatgttgcaattcgaggacgaaaatacccttacggtgggtcagagactctgacttagatggtgacatgacagcttttggctgatgtgatgataaaggacaaaaaaatcatggtggaagcataaagaattaggagacagaacagtggagaacagctggcttctactgttgttattgggtatttaaaaatgatttgtttaaacaaattgattatccaaaattctgcgggagacaacgtaatatataatacattaggagacatgattacctgctagcgggggacaacgtaatatgtaatgcattatgggacatgattacctattagcggaggacaacataatatataatgcattagaggacatgattacctgttagaggaggacaattggtgatagaattttgtttttgtctttacatcttatatgcaattattctcatttaagaattttgaattttatttagtcttgtgaaatatgaagataataatgctcaactaatctatagatcaaaatagatggtgaaaaatctaaataaattttgaaatccttaagtgataacaattggtggataagatgtgagattcatgataattttgaaagatgatgaaatcagggacaagatctagatacaaaagagaatttatgataaataaaattgggagacaaatttaattgaaagttacatgtagagaatctgtgcaggttgtcaggggaagtgatagagagacaaaagcgtttagttgttttcagaaagataatgatgtatggttaaagcgtacatatttcgaagatagagagataaaatataaaagaaatggtgagtacaaaatcgacatttcattataaaatctgttatgatgtgtaagggatggtagattatgctagattgcataatgatttcaaaaattatggtagattttataattttcctttttgaaaagtccattgttaatttgattttgactgatagacattccacgatggcgataaaaatggaaaaaagatttttttaaaaactttccttctttttgccagacggattgtaaatataatataatttgttttatgtttattttgtccacatatgtcaaatctttcgtgattgtctatcatatttcagatatttttttaaaaattgtggtaaagagaaatcgattttaaactgatgctatagcaacaactttgtaaatcggtttatttggtttgtgacctgaactatgtagtaggcttggttgtttcatctgtttcttttggtgtgtagaagaatgttgaaagttaacaaatgtagattgttcatatattatctcaccagatatttatcagtttccaactttgaacttcctcgctaaaatccgggactagtttgagttgattagaaactaatccgctgtatcaagacaaatgcaataatgaagccaaatttgagaactaaaaatttatcaactttgatttttggtcttggtttcaagcacaatcaaccgagtacaacccaaaaatttaattgatgttcaaagtctaaaacattgtggaaaacatattacataatgtggaaaggtttttaaataaatttttagtttgaatatatgtatatataaaggcaacaaacttaattcttagtaaattattaacagtacaaatatgtttgataaataatatattaaaattttattttatatgaaaacaataattcaacatgtaaacacaatctttaattgagaaataattaaaatttagagtcaaaattttgattcaaactttctattatggaaaacatattacataatacaggccaacaaactcatttctttgttaattatttacattacaaagtttttttattcaaaaactaaagtaatacactttatacagaaaccaaatttaagatttaaacacaatctcaaatggaaaaaataattcttatttaagaaatagaaatctaaatttagagtcaaaatttatttgtgagatataagtaaatttcacaaagatttattgcatcctaaagaaacacaagtaatgaaagcaaacaatttttcatttttttatcatcctctgcattaagttttagtttgacattctgaaattcttttatttcactctaatatatttgtaggctctatggtatgtataaagtttgctttaaaagaaaaataatgtttatcattgttataaaaaaaaattcacaaataaataaagggaatgtgacacgtttaggcacttttagagaattttattccatttgaggcactttgcagagatgaggcactttttcaactttttcatcgaatttatgacaaatttgcccctaaaagtgaaaacgaaaatactttagcgtttggaagttggtatatgatgagtgggtcgttggatggaagttgtagctattatcagattatatatataatttaattactcaaaaaagtataatgaatattatttctctatttgtactttttttcttcgtcttcttcattgtctactttttttcttcttcatcgactcttcttcttcttttctttctctatctatctctttcttcatctttcagtctttccttgcaaaatcaaacatgagagaatttgtcaaaatcgtgtagcttctgtattttcctttacggagaagcctctctagatttaagtgacgattaggcttattcgattggtttcggagcggcagcgcttgtgactaacagcggaagcttgagtgtagcagacaataacatctagaggtgaaagaagaaaaggatttgttccctcaatcttacaaccaatcgatccagcttttgcgattattcttcaattctatgaatagaatttagagttttgttagattgtgtaaatatctgattcatatttgcgaaattgtgcttgtgaagacgatgagatcggttgcagattgaaagttcctctttccttactctcctttgtttcagatctgttgcaagaaggcgacgagagaggcggtgataacgtaacgtgagacgttactcgacttacttaatttggattttgaaattccacctgagaatttaaactctctcccgaaaaagaagaagaaatggcagcgtacatggaagagattccgtgagaacaaaaattgttcggagtaacctcgataatacggggttacggagatgcaaggtcctcgttactctgttctattccatggagcaccagattggcaaattccagtattgaatttcatatccatatgatcagcttgtttggtaccatttgattctagcttgataaattgatgtttcgttgaacctctaagctaagagcactttacttcgcacatgagaataaatcatttccacatggtcacatcttgttggacaagttttcatggacacaaactatcaaagcatccaacacgatttcattatgtataaactaataatcctataggtctccaagccccaagaacaatatgtagacattgctttcaaatagcaaccctcaaaacccaattagttaatgatagtttgtatccattataacttgtccaattaaactttaacatgtggagtaatggtgaaacatgacaaacacttgaacacaaatgattcatgtgtagagctttcatcaattttctatcgaatgaaaaagagtgtcatggtgatgcaagaatcacaacttagtcaaaacaaatcatgcgtctttttcttattcaacacagtatccacaataacaatacattacttacacaaaagaacgagacccatcaaacatgctttcatataaagacaaaaccataccaactaaaacccaaaatcttattaacatgctttctttcacgtattcttttctctgcatttgttattcttacagatccataataatgtgttcatttcaaatgtgttcatacggaatcttgtttactaagcatatccatcaccccaagtccatacaaccatgtctacaccgttgtagaatcacaatacacaatttctataaaaaagcataagtaataaccaccaatttcaaaaactatgtccactacgatgctttgcgtttatattctaaccctttacaagtagccatccactagcgaccattcaatgttgaccatatagttgtagggatcaattacaattttcttgtaaatggttagagttatgaccatatgatgtatcattgtagaatgcgcaaacaaaagaaagtgctaatttaccgagctataaacacattcacagcaaatcaaagacatagttgttgtccattgatgacagtccaaaaaatgtagtccatatggttatctaatgattcacatggtagttttatttcaataaacaagtctatacatgaccaataaacgccaatccaaagtacattatccatttttctttgaccatttattcacttgtgtataaacaatcccatcagtaggacaatgtcagttatatagcttttataaagaatttaacgaagatcttatcactctcaatgaagaccattagttcacttggataaacccgtctatactaatcatttgtaataggtataagatagaaggatgtgtccattgccataaactacagatttttattcaatagaaattcaacaaatatacatctattgtataacgtcataactcacaaaagttactttgattttcatcgtgtctcaacctctcgtttatttcttcatcttgactttgaattagaagtgattactctcaggaaatcaaatcaatcagaaacaatactttcaaatttatagatctgatgtggaataagattaagaactttctaattttgtatatcagagataccagagtaattaggagcagagaggcaccaaacgaagcgacgaataaggcataaagctccctccgccaccgccaccaccaactacgtacgccatcatgtcttgattagcttttcaaaaacaatcatagcaaggaatcaaagcaaatatgtcggagattagaagataaagccctcatttttgaactttgatttttcgtaaaagatttgatattggttttggaaatagaaaaataaaaacgatgaagaagcgctgagaagatatgacaaagagaatgagtttgcagttaaaaagggtaaattggacaatttggtttggcaaagtgccttatcttttcaaagtgtctaaatccgtacatagttttttaaaagtgccctagaatgtaatattttcataaataaatctatggtagtataaaaactataaatcttagaaacaaaaatatataatggtataatatgaggcaagcccactttaattggttgtatatctaacttttatctaaaagtttttcaaaaataaataaataaatagatatattaatatccatttctctctagagtttgtaacatctaatacctaaatattttagaaaatttagtttgatattaactacccaactaaaccaacaattaaatttgttcacacatatgtaaagtcaataatacaaagtaaatgacaattaattgaaaaccaaatctcatatcatttatttgttttccaagcaaccaaatatatttgaaaaaaaaaatattatataatatatcatgcaattaagtaacaaattaaataaagctatggttgaatacaaactatgaatcttagaaacaaaaagcaaaaaaaaaaaagagattattctagggggtgaacccaattatttttctatatattcaacgtttttcttcttgacacactcaaatctcattctgtttatttggttttcaaacacccaatatcttctcatactaaacaatcttgagtaaattagtgtttcctaatttgttctcaccacaagtctcaagccacacaaggaagacaatgatgataaaagagagaaaaaaaaatcagattattggaggtgataagagtaacaatgaagaatatggcaatgtagaatatctctttttttttttcctttagcaataaagaagatataaacaagagtatgagttttgcaatcagattatttttttgctcttgttggtctgcgtaattatcttcaatagttccatttctttaagtttccatagtcactagatgtctagatttatatttcgtttctgatttgcttgggctcttcttaattttgctgatatgtttgaaaaatagggacatgagtatgagacttgatatttcattcaaatttttgttctaagatgtcctgtttataaatcacattcaaaagcttttttccctccctggcacttttacctaggcgaaacaaaagcagaatagagctttcttttaaccggatctcaccaacttccccaacccatttttagaagtttgtaacggtcccttcgtggctttggcttttgtccaacggtcggatgaagttttccgttgaagtttcgcttcttgttaaagcttcaaagttttccaatagcaagttccacaacctgtgaagcttagatccatatctggtaccttacaaccccttaaccaaaaccaaccactaccctctgtttccatggcaaaccgaatcccctatcacctcaaaggaaaagttgtggatattgactttcccccccccccccaccaaagagaatccgagcccctgaccttgatacctttgacctaattgaagccaactccctaacccttatggatcgtctcaccaaccctgctggctaaagattatggtctttgttttctttcctctctaaccggtggaacctaaagggtaaagccgcaggttcagatctgggaagaggttgtttccagttcagctttgaatttgaggaagatatgcaaaaggtactggaaaataggccttaccattatgaccaatggatggtgatcctccaaaagttggaaccagtgatatctgcatctttttcctcaaagatccccttctggattgagcttcagggccttccaaagcacttttggcaaccccaaatgctgaaaactattggagaggaactgggagacattatggatatggagattactctctcagctgcaaagataagagtccaaattgacggtctgcaaccgctgataaaagaaactgttgttggctttcctgatggcagtaagctgttgtgactctagagtacaagaacctcaaaaaccattgtctccactgtcatcgcctctctcatgaaaaaaaggactgtcatggtctgcaagaatcaaaagctaaagaaagcaagtgtctttcacaagttaagcctgcaaattcaaaagagactgctagaaactattatctccccaaagataattttgtagcaccaaaacacaacccggaaggaagatcttaccagtcttactcccaggaagaccaaaattctctgaagaggaaagcaaacctgctggaaaccagaaccagttcccagtctgttattagagctcataattttccccagggccaaaggagacatgttgtgagggctgttgatactcataaaaatcagtctggaagagaggaatcatacagatctcatcataacagagacagtagacttaaccctagccgcaacttgcaatggagagaaaaatcaccttgaaacctctgcgtcctctaggcctagaagacctccactggaaaggaacttgaccactacttcacctcgtgaggttactgctccttctccaccttcaaaagaccaaatcatggaagagttaagggaagtcactatccagtatacatcctgcgtagaccctactgaaagcgcagccagaaagcaacgagtaattcaaggagaggcaagagacctaatgtcaaatactgcggatttgatttttgctgcagtagcaaactcagctccctcccagcctgacttactcgtgattcttgcagaagaaaatcagagtctgagaaccttcactggtgaagaaccaaccattctctcaaaagagctagatgctcctgttaaaaaaggcaagggcaggctaccatcagcaaaaccaagtttaaacctcctgggagctaaatctcagaaatgaaatctaactattgggtccccaaagaaaacattaacctagaggaaacttcccagcctaggggatcagactgcaggtccaagtactattcatccacctgctgaaaaacctactggcaagtctgtaggaagctcagctaaaacatcaaaaagtaaaccctccaaacccagtgctccaaaaatctctttaatccctgcaacaaagaaatacttggtggattttcagaaaccgccaacccctcttccttaagaccagtaagctagaactactgtgggcttaggaaccccatgacaggccagcgtctaagggaaatccacaagaagatcttccctgatatactgttcctaatggagacaaagaatacctcagaatttgttcttcaacatctgctttggatgggttatgactcgcaccattttgttcttccaagctccacaggggctggtggactggcccttttctggaaacacaatattgaaatggaagtgttaagctcttgtcagcactatatagatgcaaaggtaacagcaaagggttgctcctttttctctacctttttatatggggagtcagatagataaaatagactttaggtctggaaccaaatccaagagtttgcaaaagatagatctagtccttggtttctaacaggggactttaatgatatcattaatagcaatgaaaaagtgggtggaccaccaagatatgagggctcatttactgatttgagatcatttatgtatgcttgtgatttgtttgatcttaaacactcaggcaattatttatcatggagaggaaagaggcatactcaccttgttaaatgccgacttgacagagcaatggcaaactgtgaatgggccattgaatatccctctgggcgcagtgaatatttgagatttgagggatctgatcataggcgactatttacttcctttgaccttgttaaacaaaaaaagaagaagcctgtttaggtatgacagaagattgtgacacaatgaggaagttaaagctattgttttgaatgcttggaactctgaacctttagccctagtgacaagactcaacaagtgtaggttagcgattatagcctagagtaaaaatcagcatcttaacagccaggcaaaaatcaactgtcttcggatcctcctggaagaaaagatgtgtggagatgaggagaatcaggaagagatcacacagattaaccaaaatctactcattgcttaccaaaaagaggaggagttttggaagcaaagaagcaggcaactgtggcttactcaaggtgataagaactcagggtacttccatgctgctacaaaaaaacagaagagccattaataacattgcagtgatggaatcttctgagggatcactagtttatgaggaagaggatatagtaaaggccatctctgattattactcagcaattttcacctctcaagcgggaaacagacacacggtggtgaatgaagccttatccccttgtatttcggcggagataaatgctgccctgatgaaattaaggaagcctgctactccatccatcctgacaaagcgcctggccctgatggtttctctgctagcttttttcaatcgaattgggagaccatgggtattgaaatcatttcagaggtacagactttcttcatcactgacgtacttcctagaagaataaaccatacccacatcagattgattcccaagatactaagccctaaaaaagtctcaaagtacagaatcatatccaaaatccttacaaagagaatgcagcctatgctccatatatacatgtatctcggagaatcagtcggcttttgttcctcaaagggcgatctctgacaatgtcttgattactcatgaagtactacattaccttaaaacctcagctgcaaaggagaaatgtttcatggcagtgaccgcctagaatgggactttattaaagctgttttagaaagattgggatttcatagcagatggatcacttgggttatgtagtgcataacaagtgtcacctattcctatctactaaatgggcaagctaaattgtatgtggttcctgagaggggtatttgacagggagaccctctttctccctatctttttattctctgtagcgaagttttatctcgattatgcaacagagctcaaccaaatggcagcttacctggaattaaagtggctcttgggagcccgagagtcaaccatctcctcttcgcagataacacgatgttcttctaccggtctgatacccaaagctgcaagaaactcatgtcaatactgggaaaatatgaagaagcctcaaggaaaaaaatcaaccaagataagtcctctataaccttctcctcaaaaactcagaatgagataaaagagagagctaaaagagacttgagtatccaaaaagagggaggtcagggaaaatatctgggtttacctgagctgtttggaagaaagtagaaggatctatttaccatgatagttgaccggataaaacaaagagccttgagttggtcttccaggttcatctcttctgctggcaagctgactatgctaaaatcggtcctcccttcaatgcccacctacaccatgacatgctttaagctcccaaactccctctgtaagtgtattcaatccgcacttaccagattcttgtgggatgctaatacttgaaaaaagaagatgtgctggattgcatggaggaagatgactagatcctttaatgcaggaggcttaggttttcgtgatatcaaaaccttcaatgatgcactcttggcaaagaacagttggcggttgcttacaaaaccctcttgtctgttagccaaagtactattgggaaaatactgcaaaaccaaaccttttttctcttgctctgccacaaatacagcttctcacgggtggcgaagtatgtgtgctggtttagaactgttaaaacctagcctaggcaaactgattggaaccgggaaaaacacctctgtttggcattctccttggctgtcactaaaaaaacgctatgtcccatgggacctgcaactgaagccaaccatacactcaaagtctcagacttaatcctcccaaattcctccgaatggaatattcccttaatgagagacattctaccacagtatgaagatgaaatcaagaagctaagacctagcagacacggtgtagctgatacttgggcttggttgcctaatacttctgacatttactctgcaaaatcagggtatcatgtagctatctgaccaatctgaggacccggagcaattttcctcaagagtttcatttgatttcaattggagagagagcatttggtctcttaagagctcacctaagacaaaaatgctcctgtggaaacttgcctagaatgcacttccagtgggagataacctcatccatagggaagtgtgcttaacagctacttgtcctcactatggactccatgaatctgcactccacctagttttccactgcccgtttgctgtacaaatctggaatgctgctcctttggctggttttttgaatccttcaagtatctcctctattcgggaaggagtaactctggttaacaaactggtttgtttgcctccttctgggattggagagggccctcttgcaccttggttgatctggatgatttggacagctaggaaccagttaatcttcaacaaaatcaaacctgtggctgccgattgtctagtgttgggtcttatacgagccagagaatggcaggaggctcaacggtcactccctccaaagcttaccccaatcaggtctgtgtcgatcttgaccccccccaagcttttgccctaaagtcttcattgatgcccctggaaagtggatggatctgcgggtctgggttggatcttcaaagataaccgggatctggtggttgcagaaggctcttcctctgtctctcacatcacctcgccgctggtagctgaagctttggcaactcttgctgcggtaagagttgcacttgaatcgtctgcaacccacttctttttcgcttatgactcgagcattcttgtcaaagcacttaatctggagctctaccataaggatctccacgggattatccacgatatcatgtttatctcttcacaatttgcttattgttctttcaatttcactcctcgagagcttaatcgtcaagctgatgctttggcaaaggaagcccttctgtttgtattgaacccggtttagaccactaatgaaattaaatgttgctcaaaaaaaaaaaaaaaagatgtcctgtttataatattttacgtcaaaaacataaataactatatatatatatatatatatatatatatatatatatatatataacgtgtgtaatacaatttaaatctaaaatatatctcccgcatcgcgcgagtatacttctagtattgaaatatatctaaaatttcttacaaagtatgtctactagtaaatgaatctggaacaaaacaagaatatcaaaattttagtttaacaaatagacattcaaaatatgtaagagaacataacccaatttttgtatttatattgtggatgaactcgtgttcgctcatttttagctatgattttattaggtttttaatgtagattttaagtgattttggtattttttatgtctgttttcaagtatttgtgcttccaaattaaatgttttataaacttttgagtaaaaatgagaaaaactgaccaaaaatcgtttacggacagtttcaaagctcgggaagtttgatatccaattaaggcttctcgtgcatcaaatcgagacatcttgcaggctgtggaaagctataagaattaagatccatgtcggagtagaatcggactcatacgatcaactggtgattttgagtgcccgtttgaacaaaactatatcccacattggtcataaggcgtgtgaccgagctgaagttcttcttcagactggtattaaccaccgtgatcagactgaagcttcttatggaaccatacacagcgaacatgatcaggctgaatgctcttgtcccgagcctataaatattgcatcttatggagaacatcctacggctttcgtatgtttctttcacagcttctaaccgcatcccgcagctcctttgtttcctccaagccttgagaagttatccttggatcgatacttgttcttcattgtttcttatctctttcttacttttatggactttaggaagacaagttttttctctaacacttagagaattttcctaaacacccattttgttttgtaatcctttatgatgttgttattcatgatattgaaagtttactcgcatccttatttagtactctctttcttgggtttgatggggtgattcaaagggaattcatggttcaaccttgttaggtgattagatccaattttcgttcatcattaatttttactaggataacttttacttaacgcattttgtttggattgatcaccaaacgctagtcgacactagtgttaccgatgcctcgtgttataacaaaaacacaccacttagttatagagctttatgatcaacttatcaaactcattgtacttgttagtcgagatgtcacgttaccagctttagctgagtaactaagtatggatactttacacatttattgtatgacttataggttgtttgtttactcgtgtttcgtagttaaacatctaaatagattaaaaaaattaaattattatcttaacacttaatttgtccagagccatgataccctcagctatttctttcatcgtcatctactcgtttattttttagcattgtcataaaaaaactgttacgagtaatatttacacataaaaagtttacttttaatatagaccgcaaatgcaaaaatacaaaaaaaactgagaaacaaaaaaaaacacaatagatttgaaaggatttaaactaggttaggataacatgaggttacaggaactcgtgtaatattgcagaaataaataaataatatataagaaatagagaattaaggaatcatcagagaattatataaagacatgtaagtttaagtatgattagaaacgttcttgaaatcagatttctattatgaatcctaatggtgataatttccatgaaagatattacttaaagactaaacttgtggtgaggtttgttctaaggaatcctatcaaggtttaagattagaatccaataattaatatcaacttgtggtttggttggctaaataagctttgcctatctgataatagatccatcaatttaacaccatgtttggtggctagaggaattgatcatgggcaatgtatgaattatgttagcctaattcaactaagggtttaagaacatataaagatagagaactaatcaatcatatcatacataagaaatacatgtaggttttcataaatatccaaatatggccaaattatgagcagcaacattgttacaacgctttgtaaaaagaaacttgaactcgctgagttttccggacaacattgttagaaattcgaactgaagtcatgaacaaacttttacacagggactatgcaaatagacagtcaaggtgctcaagataatggagaatgaggggacttaaccaaacttgatcatgctgaatgttttgattaatgcttttggaactgctaatatgtgttatgttatcaaattgggtgtttaaactgctggctgtacagattccaaaattattcagggaaatggaaacctctagatgactagatgtactgcatgtaggaaagcaagaaatgtattgcaaaatgctcttatggttcttagttttggtttcctatcttcacgtgcttactgttctcggtttcttttatttgtgacctggactatgtagacactaggcaaacttgtttcatctattttcttttggtatatagactatagattgttcatagattatctcaccagatgtttatcagtttccaactttggacttccttactcttctgttaactagttagagatgataaggaactagtccattaatgtatctttatgatgtctaagaatcaagacaaatgcaataatgaagaatcggatttaagaactaaaaatttcatccactttgagttatggtctagttttcaagcacaataatacgactacaaacaaaaaaaatcaattcatgttcaaagtctaaagcatatttttcaagaaaattgaaaattcttatacataaacagataatacaacctgaaactagaacaagaaatggagtagatatgtaataatagccaagtaactacaagtcttcccactgttgcctgtcgaatgctttgtgtttgttatgtctttgttctgctgtgctcttgtcacatccaacgagcctgcaataccacagttttgttcatgttaaagatcatataaaatagaaacgcaaatattatatcaaaaaataatcacactaacaattgtattctgcccatccgatccgttgatgatcaagatcatagacgaacattttgtctctaatagccacttctgcaaaacaaaatcagtaaataacgttattaacatgcattgcttcacttttatttactcaaagtacaaaaaaatggttcattaccgccgataattgttatacgacgactcgtcgaactgtagaaaccaaggcaccagattgcatttgttaactaagaaaataaatagagatagttatcatcctttttaggtacattagtaaatatagttaccatatgaattaacttacgtctagaaacttctgaaaaagatacgcctcaggtttaatgaccatggatgcaccgccggcgaagcccaaatgaacttcaggaaacatgtccgcgatgctgccacatggatcattttttagcagttaaatattttagacatgagatcaatagacacacacacacacctaagacaaaatgtattattatgtacacttacactagatgggaacttatcccagatgtgatattgaagcactggaaactctcatagggaatgggacgcccatactgtgaaacaacatttaaaatctgcacaatgaaacgctttatgagtcttctttttcccaaatgttaaataagatctatctatcttaaattggatgaatagaaaaactcacagcttggatgagtggatcataagcttcacctggaaaatgaacaagagttgtccctgaatcaattatcgtgccataaccctttgctactgagaaaacagatggatcaatcggtagcctcagatcattcacagcaacggtcttcaaattcacattataatgtgtcctgaaatgtatgttgtagtatgatccaaacgtaggttacaaattctattgtactaaccatcatatgagagaattgaggattatagtataagggttgagaactcactgtgatcgaacaagaggtgtgtatatagtattaggtaatctgttttcacctaaaaccattacacctccaccgtcttgatctccactgagacagagcgagaaaacctgtggagcaaggcgttgagcataaagctgggaaagtaccgataatcgccccttgcctaacccaaggatgccatgtactgttgtctctgaatgcgatataagtccagtctgtaagttgctacacctgtttgtcagtagaaaatcatggaaaagccaccgtattcaaacgttagatacaaagcagaacagtctctcataaagaagaacatgattaaccctaaaaattctatattattatctaaacgtgtctgtatatacataacagtatcaaaactttgcacaaaacagaacaatctctagtaaaagacaactagcggtgactgaagcagtcttaaaactatgtagttttatctatatgtatttgtatatatactagtatctcagcaaaggttgcacaagtttggagaaaaaaaatcaacaaaacaggaatgaaagaccaaagacagagggacaggacaaagctaacaacaaaggttacacaagaatgaaaagccaaagaaacagtccataaatgcaattctcagcaaatgttacacaagtttggagaaaaaaatcaacaaattaaaacagggacaagacagagctaacaagagaactccattcttaggagtaaacatatgaccaaaaaacagagtttggtagttaagttcattaacgtgaagcgtttaaaacatcaagagcgagttatatagtatgcaatttcacattgtctactatatgttctcaatattttaacattttgcatttcttttaagagaaaacataataaagtaaaagaattagcttaaccaaatagaaagggagcagatgactttacggtcaagttaccggacatagtatcgaaagaaatgagatctgatatgtagtagccggaggttacacttccatcaccgtactccaccttgtaggtacaactttcaagtagcgaacaacgggatttcttctgtagatccgaggaacacctcttgtcagaacatgccagctttacagctgaggatgaggctccaggatcgaagaaagtaacattctgccacaaaacagaagcaaaacaagtgatcagatacaaaaacatgaagaaaatgtttccgagaattgaaatgaaagttatacatggagcgggcagccgacgcaggaattgcagctaacccatacaagatcacttcccgtgtcaattaccacatccaactctcttggaggtgtcccaatttgtactgttgtgtagtaaagcctgttatgaaagcaaaacaagaacagaaggaaattatctttagaaagtattttgagatatggatcaaatcaagaaacataagaaataaaagtattgagatataaggatcatacgctgagagaagtatactagtgtctctttcaactttccagttgaaagatccgtgtacaggagactgtaacaaccttccatgccgagcagaatcaaatgtcataagctgagtgaggtcgagttcatggctcggcggaatcatcctcttcagcggaagaaccgtcgcctcgtagccgcataccatgacaaagatggcagcgatgatcaacctgaaaaacaaacaaatacaaaaggttgtctcgttaagaaagcattttgtataggtctctaatgatacgctttaagattttacactacaaaatagagttctcatatctgcaagcacaaacgtatatcaatcgcattcaagatgtcacatgtccataaattaaacgtaatgaaacttatttcttgctaattcctaaagtaatgaattgctctgctttttcttattgaacatgtttcgatggtaacatgcttatatagagaaagctcaaactaaagaataagaaaagataagtccaatggaaactaaacaaatcccatgtcctttatcataatcggaaaaatttcttatcctaatactaatacttattgttgttttgtgacatagtggaatcaaaagtaagctgaagaaacttaggattgaagaacagaatctagtgagttcggattcggtacttcagcacgaactttattacaataatggttttgatgcttagtgtggattaaaatataattagtttggcatgcatcacaaaaacacactagggaatagagagactaaaagaccgtgagaaaatccatacctcataataccttgcctcatggttatgtgttgaaatgtacacaaacctaccagtagtccaacaagaacagcacgaggatcctaggatagacattaagcagttgtgtcagttaattaacatcaaggtattaaacaaccaattaaaacatcaaaagtaatgatgtcaatgaacttccttgaaaaaaaacagtgtattttttaagcaataaataaaaccagaaaacaaaatcgaaagagtaacaaaagcattatctttactcattaacctcaaacaaagtaataaactaagaaaatctaaaattcagaaaataatctcaagttaggaacaaaacaatcagtcgatcaaaatacaaagagacataaaacgatgattcatgaaacataccgacaaaaagctaacaaaaaatgatgttttaagtttgagttacgattcctctctacatcctctgttttaaaatgttgatgagaagcaattacctaatattcaaaattatatcaaggcgggattgatttgaggaacttggactggaataacaaaggcttaacggcgtttctgaattactaaataattaaagttgactttttgggtttatttaacatggtcaacataagttttttatgattttttctttactaggaagtttagggggttttcttcaaattatgaagaatggtgatataacaagagcaaatcctttttatttctttacctcaaagctttttttttgggaaagaaatatcactctcaaatatcacatttaaaccatggaatctaattaatgcgtagaaacaaactaagtaatctgaagctaatctgaataaacaaacacacaaacacatgtttgaaactaatctaacaaaagcctaagtaaaatagtgatcatgtttagctgttttactacttggtatttctcttacaatgttgttgaagcttattgtcttgttagatttcctgcatttcaccaaccaattacacgttaaagaagattaaaccagatcacatatgagaattaagattctctaccttgcaagaatccccaccgtcgtacagaaacttcacgttccctcgccctaccaactcaaccggagaactgatagtgagatatacaaacgtaaagagagatatccttttccaacagagaacaaaaacaattgatcgagtaatctacaaaaggaatgtataaaacagagagaagtaaatcagaaaaaattgaggttcaggtaatttaactacaatcgagtaattattgctgccttttacgttcgttatgaataacgttttgtcacttttaaaaaaaacagtaatcaacatatctagtaaaatcaaactatttatacataaacagaaaatcaaaacagagagaaaagcaatacattggttacatgttcctctcaaaaaagtttcagattttatagtgatttggataactggaatcaccttatgagaggaggaggaaaaccagcggcggtggaaagttgaaatgaatgaattgtgaagatgaaacgggaatttggtgttgacggatcatgtttggttgtcaagcaggaaggctaatagtaacagtaattttttgatggtgatttggataaagtgaatggaaaatgattgtgataattgattgtgtgatatgtatacatgatgatttgctgaaactgatgagagtaggaatttagttaatttggggatcgtggaattcagagaggagatcatgagattttttattgacttgaagaaaactgaattagagaacaaaggtggaggcttttcgtagaaaaaatattttgtttgaggggagaggacgttaagaattttagatcgtggggaaaaagattaacagttgaaaagtaataatgtttttcttttctcgccaatgtgttttgtttttttaatatttaatttacaaaagtaaaagtaaaagaattgagacttaaaacacgtgtaagatagatagagttgcagttattgttaaagtgactgttgatttagtataattagatataagcggcaaatttgagacataaaatgtgttggagtaagtttgaagataaagacttaagttataagttatttaaatataggattagattaaatcttaaggagagatcttaggagttaagttaggagttatctaaccataatcctattgtcattttgttttaaatctctatatatatgagtcccaaagttgtggtgaaccatatgagttttagagagattaagactttgagattgtttaggtttgagttatttcctaaacttaataagagagtaattcttatatatctttgagttcttaatcttctttgaaactagatttggtatcagagcatccaggttttcgatcaaagcaaaggattgaaaacatgagtgagattattgcagtaaacaacaaatcaaaagatggaggaggatcattgtctattcaatgtccgatgttgaataacacaaactatacggtatggtgtatgaggatggaagctgcactacgagtgcataaagtctggggaacaatcgatcctggattagaggacgaagagaaaaacgacctagcccgagcccttctcttccaatctattccggagtcacttattcttcaagtcggaaaactgaagacttcaaaggcagtatgggataagattcaatctaggaatcttggagcagaacgagtcaaagaagcaaagctacaaactcttatggcagagtttgacaaactcaagatgaaggacaatgaaactattgatgaatttgcagggagactttcagaaatttcaacaaaatcagcatctttgggagaagatattgaagaaacaaaagttgttaagaaatttttgaaaagcctaccaagaaagaagtatattcatatagttgcagcccttaagcaagttctagacctcaagaacacaacattcgaagacatagtagggagaataaagacctatgaggacagagtatgggatgacgatgattcactagaagaccaaggtaaattaatgtatgcagattcgggttctcattacatgtatcaagaaggaggcagaggaagaggacaaatccgtggtcggggtagaggcagaggaagagttggttataagcagagagatcactctaaggttacttgttatcgttgtgataaacaaggccattatgcctctaattgtccagaccgactattgaagttaatcaagctccaagaaaggcaacaagaggctgaagacgataatgatgatgaagcggagtctcttatgatgcatgaagtagtgtatctcaacgagggaaacatgaatccagagatttatgaagcatgttctgacaaagctt

SEQ ID NO: 203 - DNA, 96583 bp, Arabidopsis thaliana
aagcttcttaggaatgatcttcttttgtatgatagcactgcattcatgactcaataccaccataccttgcacttcttgaattctctccacgatcaagtctttcagaaacttgtgagagtctgggattagcgctagagcgtcaacaagaggtatccgcaactcaacctccttaatattcttggcaaacatagctctatatttatctgccaacgctttcttgtgacggccaggaaatggaagctgtggtttgtagggaggagggacaaagaccttttctttgtttttaacagcaactggttttggagcagttggtgatgctgctgggaagataggtcgagttgttggtcgagtaacgttgtcaagtggcagatcgagtggttgctcgagtgactggtcgagtgactggtcgagtggttgctcgagtgactggttgagtggttgctcgagtgactggtcgagtgatccgcgctttgatctccttcctgtgtttgtcatcagagtcagctgtgcctctgacggtcctatcacagtcctcgttgtaattgccatctgattgagcaaggttctctaccaaatcctagccttcttcaacatccttgttctggaaattttcattgctggcggtatccagaagcattctgatgcgtggtaggactcctctataaagagtgctgagcagagaggctttagtaaagccatgatgagggcattggttggtgtaatccttgaaacgctcccatgcttcacagaagctttcagcagtcttctgtgagaaaccagagatctcatttctgagtcttgcagttctggcattggagaagaactttgatagaaaagccttcttgcaatcatcccaggtggtgattgaatcatggggcagattcttctcccagatgtgtgctttgtcgcccaaggagaatgggaacagacggagcttgaatccgtcttcactgacaccattgatctttgtcaggttgtagagccaatcgaattcatcaaggtggtcgagtggatcctccattggcagaccatggaatttgttcccctgaatcatggagatgagaccactcttaatctcgaagttgttgttctggatagcaggaggtgcaattcctttcctctgacgatgatcacgtggtgcatctccagcaccaatgttggcagggccattttgttgattctgttcgtcagccatttcgagtggttgctgaggtacagggttgactgtgtttcacctttctctaagctcgcgagctatgcggtcaatgttgtcgttgaaaaggaggttctgattgcctgttgatcgagttcgcatacagtagaggtgtacctggatcaagaagacaacaagaaagacacaaagttagtaaccgaaaagaaaatttgaaaaagaacttgatctaagcaagtctgaaatgtcaaatgtaaaaaacagacacccaattggcaacggcgccaaattgataatagatttttcagtcaattaaacctaaagcactatcatgtcgttgtagtactgaaggttgtcaatccaaatgggtgtgatgctaacaattaagatgtgatcaaaagtccctaagtcaagccaagcaataacaggttgtggtgtgttctagcaattctaagtgaacatgcagaaaatagaaattcaagcagaaacagtaaaacactcgaccaacacagctctttgcagagcactaggtgaggagtaacacacagaaaataaaacacagatacttgactgcacagtctgttgccagacaacttggtggtcgagtatgaggttgagtaacaagaaagaaccgcagaaattaagcgacagataacaagatgcagtaaacaacagtagagtaaacaaaaaattcaatcagataaagaattcccgaggatggggtaattgagtagtttcgtttcctcagtttacaggtgattgacatgctcaataaattaaccctagacaacaagttcattaaccaaatctaagtgccaccgcaatagagactctcaagttaacctagtcccagactcaatcaccattgacgagagctaacctaacaggcattacgaatcaacaagttaaagccaaaacgctccctgcaaccaataccttggtacagggccacaagtctctagaattagtggttcagacatttcatcgaacaccttttgggcgcggaaatgtctgggctcaaattccagttgatcagaaagcaataggcattaagaacaactaatccataagggatctatcaatcaatactcaatcacctagcatactgagaattctacactattctaacccatcctcagaaacctattcactactcagacatcagaacagaaagcataaacgttgaacaagctaaaaacatgataacaacagtgtaatagaagggtgataacagaatgaacaacagtaaacgaaagcaagaccaaaagctgaatactgaatactgaatactgaatattgaatagataaagagaaatccggattacaaaaggtctagaacacaaggtctgcggaataaaactaaataaaaaacttgtttgcgaaaatgtgaagtacatgctacttatagccaaatattccgaaaccctaatacttaaaacgatgcagtattgggacggattaagaattgtactcgactcatgtggtcgagtggggatcgagtgaatagctggagtcttcttttcttccttgtgctcgagtgtctggttgagtgcggaatgaagaagactctgaagcttgccatcgagtgtgtagtcgagtggtggtgatggtgatactcgacttccaggtagagtgatggggtcgagtgatgattaggtaatggtggtaaagacactcgacctcagggtcgagtgatgtggtcgagtgatggtcaggtgatggagatgaggacactcgaccttgtggccgagtggtgaggtgaagtggtgatgtcttctactcgacctgggggtcgagtggtctgttgagatcttgaagctcctactcgacctctgggtcgagtggtttgtcatgatcaggtccgcttcttccagttagctcgtcaacagctccaaatcacctgaaatcaacacaaatatgcaacatgcatgcaaacctatcctaaacatgtaaagtgatgataaatgatgagaaatgatataaaacagtgatgatatgatgctaaaatgatgacaaatggatgctcaaaacatgcaaaatacacacttatcagtatctcatctacgttgaccttattcccaccagcatcatttagcgtttatcggagttcttatctgccgcctcagatccgccgcaccatcaccatcctctgccacactgttgccttgttagggttcctcttaatgggccactgttcttcgagcccattaaccaaatttaggcccatcccccaaaacaattgcccatctccactaatggattggcccagcccctccaaacggtctccgcaaaatcataggtttgacccaaactcctttttgtcttctcttagcttttatttgcgtcgattcatgataccaattgctaatggacatcaattgaatcataatcgaacattgctgctatgttggtacaaaaatcctttgagaaccttgccattagaatctataggtgtactattcatgttgctaattccttgaagaagatcggcatgatgatcccgtctccaaggagcagtgattaccgtagtttcttcaagttttcatctccgattcattttattattgatttcatacttgatatatttagctacatcatgggtactattcttgaaagtaaaagtttgatgaataatggcattatgatcccgtctccttggatatgaattagtgctttaggtttaattgatcttaaaaaacctattatcatctccgttcctcattggcttatcaaacctatctttttttccttattgttagctttcgttattcggagttttttgtaaccctttgtatgcttgaagatcttgtaaactttacctttaggagatgcattgaatgaaatacaaggcttgtttgacaaaaaaataagaataaataaaaagtatcaactgaaaaaagcattcgtttatgcaatataacaacgtattcgatgattcaattttaattaaaaaaaattctaacaacattctcaacaatgcatcatacacataattcagaaacaacattgatcttaaaccaatttaacagagggtagtgttggattctaaaaacctaagaatttgatgatggagctctttacgtattcttcacactcagtggtttattatataaatatcaatttaagagaatataaatatcaatttaagagaataacttactcaaatcattaagtaatccacaactattatacactcatactttgagtttggattacaagaaaaaaacaaacttcgggtataagaaaactattaaaatggttttattgaaaaatcatgtaatattaaaataaatttagtaataatacaattaaatatgtaaaataaaataataaatatatcattaacctataaattagaagttgaagagcttacattaattatttaatagacacatggcaaatggtaaagtgatgatgtgtcaatcatatggagagagttggccaactttcatatatatgatttataaaccatgtgaggttcaaaccccttggtttatatttgcttaatagtataaagtcgtggtcgtataacttttatgccggcaggatgttggtattgacgttatgctgcccgactattatactttgattgttagataactaggattagccaaatcatgaggatcccatccgtatgttgtgcatcgcgtgtaactccgttccattatggcatacgaaggcaggggctggttcaataccgaccggatgcttcatgacgatgtagtataaggaatggcaatcttctttagactttgtgtctaggagtgtgcaggccattgcctcgggttatcatgtgttcgtaaaaggccttacttaagtagttaggagcatgtttaggcatagtagtttcgctgcatatagttgctagttgcattgcatttgattgcctgtttgctttttgtttgggggttgggttgggttttatttttagagatcccagatttattgagtaatactagattactcagacactactttttttttacaggcaacctttagtaggaagaccttagggggcgaaggatgttagactaaccggtgtagatttgctttgcctttgtaatatatagttttgcgtatagtatgtaagactcgatatttttataaagctctgattttattaaaaccccatatctcccaatgatatatttagtcttgtctagactatcacaactcgcgtccgcggtacgggttgcaaagccttaggccatgttcgtgagaaacgggactcgcggtcggacggctcgggcgaacggatttgttctgggaatatgggttggctgactacgggcgtgcacgtgacgctctcattctatcctaggcctaggacggggtaggagtgttacagttactagctgcaaagtatgcttcaagagaaattcctaaagtggacgtctcaaagatcgagctagctcagcctcaatctgaggcagtagagtccaaagagacgttacccccgaacaagaaataaaagagcgactcaactcccgtgactactaaagggctaaagaaaatggtcaaggtaattatgggatgattctatcaatgcaatcaagcaacacaagagaaaagtcgttactccgatggaaaaaagcctaaaacgagccgtgctaactggcccgaggaagaaaccagcaaccttgataagcctcatgatgatgccctcgtagttactcttgacattgcgaactgtgaagtctaaaggatactcattgacaccaggagttcggttgatctgatttttctcgaaacactcgtgagaatgggaatttccaagaaggatattaagggagctccaagcccacttgtatcttttaccagcaaaaccttgatgtcagttttcacaataacgcttcatgttaccgcacaagaggtcgttaagatgatcgagttctctgtctttgaccgaccggcggcttacaatgtaattctcggaacacttggttgtacaagatgaaggcagtcccataaacttaccatcagtgcgttaagttcccaacccctactggagtcaggcaaatcatgggaaatcagtgcacctcgagaatgtgctatttgactgggcacaagctcaaaatccaatagcaaccacaactcaaggtatctttgaatgtgatcaaaaaagtaggggataaccacgtagaaaaggtggtcataaacgtggagcacctggatcaacttgtcagcattggggctagtctaagtgagagcttccgaagcgaagtgattcaatttctcaaaaataataagggcacctttgcatggactatcgaagagatgactggaattagtacgaaggtcatttcacacgagctgaacgtagacccaacattcaaactggtcaagcaaaagcgtcgaaagcttggtttggatagcgtaaaaccggtgaacaccgaagtcgtctgacttctcaaagcaggctcgatccgtgaagtcaagtatccaaaatggcttgctaaccccgtagtggttaagaagaaaaatggcaagtggcgtgtatgtgtggattttaccgacctcaacaaagcttgtccaaaagattgttttccacttccccacatcgaccgtcttgtagagtccactacgggacatgaaatgttatcctttatggatgctttttcatgtaataatcaaatcttgatgaaatcggaagatcaagaaaaaacgtctttcatcacggagcgcggaacctactgttataaggtgatgccattcgggctgaaaaatgttgatgccacatatcatcgtctagtgaacacaatgttcaaggatctcctcggtaaaacaatggaggtttacatcatggacatgtttgtgaagtcagccgtctctacttcgcatctcgagcatcttcaggaatgtttaacttttttgaatgagttcggaatgaagctaaacactttgaagtgcaccttcgctgtcccttcgggagagtttctcaggtacattatcaccgagcatggaatcgaagcaaacccaatgcagataaatgtgttcatgtcgatgactttgcctcgcagtataagagaagttcagcgtctaacaggtcgagtttccgcactgaacaagttcatatccctatctattgacaagtgcctacctttctacacattactgcggaaatcgaaagcggggtttgtttgggttgaacactgtgaggaggcattaagcagctgaaaagctatctgtccaaaccaccaattcttgccaagcccgagtttggtgaacagctctttctatatatttctgtcttggaaagcgtagtgactggcgttctagtgcgagttgaacggagtgacaagcgtccaatcttttacgttagcaagtcattctccgacgcagaaaccagatatccaatgatggaaaagctagctctagttgttgtaacgtcagctctgaagctgaggccatattttcagtcgcacccgatcatcgtcttgacatcgttgccacttcggaccatcctccacagtccaactcagtccggaagatcagcaaactgggcaatcaagttaagtgaatttgacctagagtttcacgcgcgaacaagcttaaaatctcaacttctcgtagatttcctgatcgagctgcccttggctactcccgaacctgacattccggaccaacctaggattcttcatttggatggagcttcttctaaacaagggtccaatgtcatagtttgcttgaagtcttatactagagaaattcttgaacaatcattttggctcgctttcaaaggctaaaacaacgaagctaaatacgagtcacttttggtcggactttgcctcgccatcacggtaggagttcgtaatctgcaagctcattgtgattcactgcttgttgccaatcagtatttcggggactacaaagcgaaggatattcgcatggaagcatacccggattgagccctggaactgacaaagaaatttgaaaagttcgagctatctagagttcctcgtgtagagaattctgctgtcaatgcactagctgccttagcttcaacttccgacgtaaaaatgaccaggatgattcttgttgaaacaattagccaaccgagcgtacgtctgaaaacggtgagtttcgtcaccactcaggccatgcgcagacggctcgaagctcaaatggatgattctggaccttagcagtttgacaaaaatggggcgattcccgacataacgtagcttgaggcgaaccaagagagtccaaattgtctaattccaaatagccacgaagtccctgatgctggtcaaccacctcatgactggggggggggggcagactagagagagcctattcggaattacattctctctggagtaattcccgccgataaatgggaagctgaaaagttaaaagccactagtgcgcgtttatgtgtagcaaacgacgttttttacaaacgattaatttcggctccggatgttgtttgcatctttgtggagcatacccgtactatgatgaaagaaatccacgacggtacgtgcggaaatcactcaaagtaaaaaaaatatggttatttttggtaaacaatgattgcagactaggaagcatacgcacttaaatgtgagcaatccctgaggcatgcaccattcatcttgcagcccgctgaacttcttagtttggtgtccgcaccttatccgtttatgaagtggtccatggacatcatcggattacacctcgctatccgcagagaaaaggtcaggctaaagcgatgaacaaaataatcatttctaatctcaaaaagaagttgaacgagtacaagggcgcttagttaggagaattacaaaacgttctatgggcaatccgtacgattctgagaagagctaccggtgaaacacctttccttagtttacggaatggaggtagtcatcccgaccgaaatcaaagtcccaagtgcgagaggaatcagaaatccacagagtgaagctgcgaaccgcaaaatgatggttgatgtcattgatactattgatgagtgtcgcgatcaagccttagtccgcatgcaaaactaccacaacgttgcagcccgctattacaattgaacgtctaaaacagatcattcgaggtgggaactctagttctacgtcggtttcaacagaaaacgacagagaaaggagcaggcaagttagggatcagctgggaaagtccttacagaatcacacacgtagtttggaatggagtctaccgcctcgtgaaatgtttttacatttaaattcatctttgtcattgaactacgttagacttgatccccacctttgagtacgtaggcagcccgtacattgggtccagtctctaaattcttaaaatcaataaaaccgagttttgtcgtatactaagtctttcatttcttactctgtacagtttcaggtagattccattagaatctcacctccgcctcggaaatacacaaactaagctaatacttagtcgtcgcgatccttactgttttcccaaaatttataaaccgagtctaactcgtaaaggaaaagcattctttggtcattttttccaactcaaaagttaaaaccaagtccatctcgtaattcggaaaatagactagcaatcaaaactaaaataagactgtctcagtgaatttaaataagtttaagtaattaaaaagcctctgtggccaacaaaagcaaaaacaaaataaacttttcataaaacaaagcgggggttccaaaggaccagaacaaccccgaggtaattcttactccgctgtttgggagtctttctgaacatctattgggaacattaccgctatcccgggttgcaaagcagaattcttgttagaacctgttcattgttgaccaaaacctcgtcaggagtggttgtctccgcgactgtctagggaggggtgtcgtccaggagagaagtgagttcaaccaggtcaggttggggggtcttcggttcagcagccttctctgggtacttaacttcatcggctcgaactgattccaactccccctttttatctcttaaagtagttcctgattcactctggtctccgcaactgataccttcagtgcttcaacctcttctgactccttgaagaagctcccgtatttcgaagaaaagtcatggaactgagcccgaacttttctcctttcctccttcctcgcagcgttcaacatcgcggactgctcttcctcgagtttcttcagcttctcctcgcagactttgagattagctctagctcgcttctcattctcgatagcagcaaagtaggcatttttgcctaactcgagttttgcggataggtcgatattggtcacctcgaggctatgaaccctcgcttcggcagctttcatccggctcagaacttttttggccttatccaagaaaccggcattttcctcttctatccttttgaaaacgtcaatttcactctctttgttggagagctagtcttcgtggctacaaaaggtggagttgaactccaagattaactttaaaagtcataaggtttggttaaaacaccgacttgcgtgttaaactgaatatttccgaagatcaactgctagctttttggcaaaacgaagatagttcttccggttaacagccttcattttgtcaaagggagcaatggcaattccgggagggacgaaagtcctgattgtgtccgcgaaagatgctggaggagatgaaaacaagtcaaagcggtatgagtcgccaattcttgttttacattaaaaaatgaaatttgttatctagaggaggtgatgtgtcatggtgctccaagctacgaggacaagactcccgataggagaggatcacagatcttgagggtcccccttcttgttctctcctttctgtatgctcgcacttgtagtttttcctcaatgcgatgacgagatgtgcgaggagagggacgaacatcatcctgtagttgcttcatcttcttctcagtatcccgttttgcggattctttgctggaagaattcttgacacaagtccttgcctccgaggtgggagtcgcagattttttcccagttgaagaagaagcccttcctacaatttgacaaggttcgaccccatcatcgacgattggcttctttgacttttcggcatctcggagcttactctctttgaggattcccgacatcacgactttgtcggatttaatttgagctttcacctgattagccctctctctttccaatctcttctcttcgcgttatgaaatggaagacatgtcagctttggaaagaatttgtggttggaagggagaagttaaggcagcaagatcggtacgatattgaagccgtctacctgatgctctgatcatgtccgacgtgagagattcttaacctaagtcttgacgacaatgtgtgtgagactgggggtttgtcgactttaactgtaagagaacagaagtggttagctcgtagaatgcgagatgaatcgcaaaagggtacgacgaaatgaaaaatggcatcctaagttcattatctatcggcccgagctgtccattcagacccaaacaagtctgtcttcttgccgtacgtgagttcattcacagggaaaaagaagtaagacttcctccattgttcatccttttctgggaagtcatcaaacactcaaaaacccttccagggtgacaggagaaaggttccatttgtgtgacccttcttcactgtgtatagttgaagaaggtcgggcagcgacagcatgaagccgtcttcttcggctaaagtaaggaagcacataatggtacagatgacattcagacataactggggcagagcaattttgaaatcatgcataaaatcaataagaaagcagaaagtaaagtccgcattccaagaagaaaatctcgaaagcgcaagtatgaccaggaggcagtgattcggtgaaacggttggttcgggggataacaggttgatttggggagaagtttagtgggccccctttaaaaggttaagtttgcccggagtcgttagggaagtcatatatttcccaaactgaccgttaatcgagaatctttcgggtttaatctttctcggaggcataattaacactgcgaaatcgtgtcgcggatggtgaggaaggtctgggaagtttttggctcaagaacatgttgaagatcttcccaaaatctgaagaacactcaataaattatcaccggaatccggtggttagcagttcagagcgccggtaggctcgacgacagatgacggattacaggcggtgaaagagaaaccggtggttaaaacgatgaatttcttcaaaatcaaagttgaaaatctgagaaaccgataaggaatcatgtcctaaaacagcctgttcaaatcctaagcaattctaagcttaataaacatgctggatcttctaacgaactaaacgatttaactgaaacaagtttaagaggaagagagaagaatcgaggctttacttttagcggtgaatgagctccagcaagttataagcgatattaggaagctgataaggttcaaattacctagaactactctctcaaataagagatcaattgcagtatttaaggatcgaattcacggagttctttgttcaaacagtgagttgaatgtcgagattaagctagcaggtgatgattaaaatagtaagaaaacaaaataaaaagacagcaagttgattgtgatgtaaacgattaaataaagagctaggaacagggtattctcaggaaactattggttagtagatctaatgaaagctaggttgttatcaaaccattcttgaactcaaactctaattatggaataaccggtggcgttccgcaaaactccctatatctatagctaagaataatcggagaagccgagaaattatcaacctaaatatacattcttaacgagttcgattgttcaccttagtagataggccgattcttattacacacctataaaccaggctcatcaaataatagatccaactacaaatacctatggcgggcatatctattgtctggattcaagatctagttaattactctagatctagcattaagcataattaaagatgaagaattctacagataacctagcaagggggcaatctactaaaccatatgaatccctaatgagaaaccctcttcctaacaagcagattactcagacatattgattgaagtaaacaacatattgagtatgaaaacataaacacaacaaatagattaagggaaagaagggatctcttcactgtattaagatctgaatcaatctctgaaaagaatcgatgaatagcttatgtctctcagtaacagggtttgcaaaaagctttataagaacttgatagaaaactggatgatgaaaacataggtctaaacaatgtatataaaccctataaaacgtccaaggactaataatgcaaatacggaagtcttctggggcaaattcctcttctctaaacttgaaagcgtcttggactttgctgggccgaaactggtgtcgatcgacaccaagagtgtgtcgatcgacagtcctcgctgattcctgaatccaaaatcgtccttggcttcctttccttagcttttgctccagaatgtcttctcatctccattgttgtcccactgcatagaatacctgaaaagacactaaaacgactcgggaaataatataaagactcgaaatcctatacctaaaacatagataaaatcagtgaaaacagagatatatcagaagccaagagtttaacctcgatatataaagcgtcagaagagcgagaaaaaggaaaatcctaggatcacaaagcgtcacactctttccaagaataatctcgaaaatcgcgatattttgtttcctttccctacttcggaggatatacgcgcctgttgaggatcctgaaaattacggcattacttcaagatagtatgttgaaattgatctaagtccccgaattgaattcatttttgagacttggggggtaaattgtggatgtcggatcacgtctattcgacccgacccgcaatccgtcgatatgtcctagatcgggtgaataacaagttcgacccattcaggatgagatgggcttcaggagcccatttaatgaggcgagatctgcggcgtgatacgagcattcatttactttctgtagatttgtcttcattgtataaatagaacttagcctgtaattatagaggggcagaaaaaattatactgaaataattccgatttacttaaacactttttcgatttgatcttggctcgactgacaaggcttaagaacctcgttaatatccataaatttttaattgcggatttcaacatccacaatgggtatcacataagccttccaagggtaccatgacacattcgatcaagaagaagaagttaactatgttggagcccaaggatgctttaagaatcgcggctacaacaacaacttcaacaacaactttagaggtagtcctagtctttcttacagaaacccgaatgttgagaatcctcaggatcaaaactatccgtgttggtgtcggatcccaaaccgatcgtccggttccaaccaaagattgccacgtcaacaaaagggggtttgccaaggattcaacctagaggataccccaaatcgaacaaggagtttgactttgtgcaaggtgaagaaccttgtcgagataggaggcagttcagatagttgctatgggcctaatgtcgaagcccaagaagaagtcaaaggaattcaaattcgaacgttaaggcatttaaccaaagaatctaaacggatgcattgaagggaaattagtgtagataattgtgaataattatagtattgatgtatatatactgagtccaaaatggagtaatacacacacattcttgcaaacatactttaagctaatacaataccagtttcagttttatcattcaaaaggtgttctctattttattatattttcattcgatttttgtccttaagagatttccttctcatagataaataaatatttgagtgtgcaagtccgagatccacattttggcgatgtctattgggacggaggattcttgagtcatcagatatctttgacgacatacccaaggaaggcggcaatggccgaagaaagctttgtcaatgtgtccatggctaaaacactctagagcatccagaaaaccgtttcgggcatggcgcaaaagttttcagacgtggaaaaggttgtgagcactttgaaagcaactcaagtatctcttagccaaaatttcaatattatgcaatctcgggttcgatctttgaggaaaggaaaccctcaaggagtccggaggagcatgttcagttcaccatagtcccatacagggaataaaactggcggacagatgactccggatgcaactgatcccagaactcaaccaaatgtcgtggaagtacaacctgatggtgaagaacaactcgggagtctcgtgagcaagaaaactatgagcagtttgaacctatgaagaaggttagccgtaaactgaaagagataaaatcaaagttccatcaggccaccagttcggaactagacatcgatcgagtcatcgaagcaacaaggtggacgcatttcacccctcatattgcgagcataagaatcaagattcccggaagctcaaccgcgagccctataatgggctagaagatcctaaaagctatctcgtggctttcctgatagccgtcgggcgagtcgatttggacgaagctaaacaggatgcaggatactgcaagctttaatacgagaacctggctagacaagcctagatatggttcacccagctcgaaccaggctctatcatgaacttcaacgaattatccgttgtgttcctgaagcagtacaccatccttatgggtaaaagcacttcagacactaacctttggaatctacagcaagggccaaattagtcactccaaactttcatcacaaaattcaaagctgtactttcaaagctcatgagggtgtttccctatggcaagtctgatgaccaaggaatcgttatgataactgtcaagactgttcttctagctttcttcgagcatgataacatcgtttggtcggtcgaaaggtctcgaccagttgctacttgagtcgactcgtttctgataagctttgcttgcagctaaggtgtggaggcaatacgctgatccacccattatggtaaaaatcctctatcgggttccacttggttctgcgtcgattgcccttcgatcgctttggattctcttcggattctctgatagtaggattttactcaattaatcctaaaacactatcgtgtcgttgtagtattttaggttgtcaatccaatccggtgtgatgcaaacagatgagatatgattgaaagctctaagtcaagccaagtagagagttggttggttctaactatcctagtatgcaataacataaatgaaatgaaactaaaagaagaaatggcaataacaggcaggtgaataacaaagcagaaataataacaggcagtcaaatggataaacgattcctaaggatggggtaatcgaatagtgtgatctccttaatctattcaggcggttgacaaaacttcacagaagctatccctagacaacaagttcaacaacagattaattcactcccgtgatagaaatcttcaagcaaagctagacactgacctaattcccattagcgatctctaactaagcaggcaatatcgaatcaacttattaaagccaataccttctctacaagccaatcccttggggtagaggcgaatatctctggaattaatagatctgacattctatcgaacaccttttgagcgcgggaatgtctggattcatattccacattagccagtgaaacaagcaataagcgcaactaatctagaagggattctagtattctaaactcaaccacctaaaacgaccaagtaaaccacaactactctatctcatcatcagaaatacggttcactactgagacataatcaaagacaatagcaaagcaacgattgaaaacatgataactacttgaaagtgaatatcaaatatttgaaagtgaatagaaagtcgcaggagaaacactgcggcaagaaaagttgtatgaataacggatgccctggggaaaacccttaaaggaagtttatataagcaaaactatgaatcaaataaggaaactagatagatagcgaatcttcacgtcaggaccatgcgatcaagtatgtcattggcatctgatgggctgaaatgggcttccctgtgattgagtatgtcattgatcaaactgggattcagggactccgccttgcgatcgagtggatgtcatgaggttgtgatcgagtggttgctttagcttctcttctcttctttgttctcagtttgtctggttgaatgcagaacgagcagataggcctccttgtgatcgagtggtgtaagatgggtgattcctccggctttgcgattgagtaaaactgattgttagcttctccggggttgcgatagagtggtttgccttggcagggctccgaggctgcaatagagtactttggctgaaggcgtcattgtgaaaccaaagtacctgaaaaacaaccaaatatacaatgcacatgcaatcctaatgcgaaaccatcctaagtatgcaaaacacactaaaacgactcctaatgagatgaaatgtggatgaaacaatgacaaactggtgaagaatgaatgcctaaatcatgcaaattatagacatatcagtctccgtgtctctcggctcatgatctaccacagggtcagcctgcttgggccggacatgtcttgcttgtaggtccttgtgggtgatgtttcctagagcttcgcggctagaaatttagctgctaattttgctctaaggctttgacacttagaagtataatgcccaaaggtcttgtggagttaccaatacctttgcttgttgtttgacggttggtctcttttcggcctgtatctacttggtaatcgtgtgctccagagaagttacgtctctcatgatgtacgaatggtccgctctgaatgcccctcttctgggtcaggaagtttgtgtgtactttctcggctcgtgcttccttgctagcagctccatgtcctttttgtgggcgacgtaatacaaagcgcgaagcagggcgtctcggattgtcaaaggcttagacaaatttaactcttttcagaattcagatttgtacgaaatggccttccttagggccgagagggcagcgacgtcgcttattcattcgactttagccagggttgacttaaacgttgcgacaaagtcccttagtggctcattaggttgttgagataatgaccaaagatatgcgtcggatgtccatgggtcgattagcatggagtactgcatgagaaagagcgtcaacggctcttggaaactctcaaccaaattccgatccaaactagagaacaaatcttgtgcagttcctttgaggtgtccacgaacaacaaacacaagctggcgtctctctctcctagtttgaatctgcctcatctaacagctatcatgaaagacttttatatgtccctttgggtcgtatgacccgttcaaatactcgatcttgagctttcacaggtcagagatcgtggcctaagtgatcatgcgtgtgaatggcgtattgtacgattcttccgggatgcggtcaatatggaggccgaggaggccatgctatgcatctgcgaattcacgagcttcatgtcagcctcaacattggctagcgaggcttttatcacgtcgatctcatactccctttcgtactcctcggtccatttgatgttttcctcagcttcttcatcgttagtgacttcaatctgtttgattgcattagcctctgcttggggatgcagttcttgatggttgccaagctcgtccgtttagtttgatgcgtctaaatctaacggctcagcatgattgttacagtaggggatgtcgagcggtttcttaacttggctcggcatcccctactgtaattcgtatgatcccgaggtaatccataaccattggcgtttggctcggtctcattaagtgggtgaaatctgaccctaacaattatgcttagtcaatttccattctttttacacctaaccctttatttcgataagagggttttgcaaaacccaacactgaaacccttctccgtaatttctcaactccaacacttaacccacttttttcttatctcatatgagctctattatacaaaccagaacatgacagcttaaaaaacagagcacaaacgctcatcaacaaaacacatatgccttaactctgaaaaaaaaaaaactaaatcatcctcctcgtttttcctcttcaattcgtgaatgtaaccaccacggttttataaccaaattctactaatatgtaaagtccaatagttccacgatcttggcaatacaaagtgatgagaaatagaaacccaatctcaaatgcttataactactactttcattaaaataaaactacttaattccacgatctgacaacgttctaccgactggtttcgagaatcaactaccacactccaaaatatcacatatgcaaatcaggttgaaatccaccagtttcgtcttagaaaagccataagaagacatcttctagcctttatcatcttaacccgatttcttaacaaaaacgtttgtctaagacctatatgaagtactcttcatagtaattgacaaatatattactcccacataaaagtggaaccaatcgactatgagacataggaaatcaatcaatggtaaatgaaaatcgaattgaaatcctagttgaatctaaaacgaatactattagaaccagaaaagccgattcaacaaagatgaaaaagatccaactcaaatcagaaattatatgtttaacaaaaaaaacttgcgttttcattaaccagatatcacattctctctagaaaatataattgagataagagagatctaatgcaaactattttttataattacgtttcaaaaattgtactatactacaaactcaccctaacttttaggcctgggagttcggattaaaccgatcaaaccggcacgatcaacccgaaattttcggttctcggcttagaccgaagagattaaaccaaaccgaacggcaaattaatttgggcaatcagatgtcggtttgggtcggtttggtaatcagttatcgatcgattacttcgggtttaaaggaacattgtataaaaacataaaaccctagatctaattcatttcatctcttctcctccttttcgcctctcctttacgatccttctttttccactctcctcctctccttacgatcttccttgttctttcttcttctccttccttctcttctaaactcttctacatcttaatcttcttcgttttcgtctcagccttccatgacatttaccgacgtgaggttcgtgttgggatttgattattggtgttacttgattttttcgtagtgattgttttttcaagttctagatcttagaaatcgtttttattttattgatttaattgttttctttcttctttcagtgagaatgctaaaaacacattcatcaacctcattcaatgcaatctcgcttcaaggaataaatgtctggaatgccactatgtgcgaaaaagtaaccaggaatgccactcttctaattcttattttttgccgaattaaaaataaatgagagaaaatccaaataattggcaaaagaccaaaaacccagacgacccaacaaagtatccgatccaattaagatccatgcccagcgacccaaaactcatcccaaacacttaagcgaaatccctaatttctaaaatcaaaccgtttctgctctcagaaaattcaaattttccaaaatcaaattcataatttctcgcctttcacgattttccgacgaattcttgattcgtgtaatagtttgatggctcgtgttagagacggtattgctggccctttatatgattcgacggagaagtcgtcgtccggtgaagtttcgacatccgaaccagttacttcaaaaattgagaacgacggagatgtcgccgacttggttccgaccgaacctgcaggtccgacagaaccagaaacacgagatgttgcggcgaatgatactacaaaagaaaccgctgaaattgaaaaggctatggaggaaccgcgtgatggtgatgagggttctgaaattgaaaaggctatggaggaaccgcttgttggtgatgaggcttctccaaaagaaactgctgaaattgaaaaggctatggaggaaccgcatgatggtgatgagggttctgaaattaaaaaggctatggaggaaccgcgtgttggtgatgaggcttctcctaaaggaaccgccgaaattgaagagaatcagacagggacaactttgaaacctctaattgacgctgtcattcaacaattcgaagaagcgaaagacgggaatggggaggagttggaggaggaggaaatggtgaatacaatttcaaaagaaggggtagagaatgttaatcgtcaggtatatacaattgaatctctatgacacacatttgttttgtttgagtattagttctcgtattagttagaaatgttcaactagttcatctatgacacatgtttgatttaagtaatttgatggaactagttcaattggtacatatgaattattagtttggtacatatgaattcttcaattggttaatgtttattgaatttgcaggatacttgtgaggccgaggatgatgaggtttctgttaaagagacagaggaagatgaggctggcaatgatggtttggaggatgatgatttagattctcagccactgccgccacagaccatgcattttcctttttcagaatacggcaaagtgtgcaagataagcagtaggtgccaggtcacgcagacagttgaactgatagagaggaagtttaaagaagaagttgtatggttcaaaagacacgatcagttcaagcatatattccacatccctcaggagcctaaccaccagacgcaaggcatgtgggtgcttatgctgcgcacagtgaagacagatttgctcgaggaggcttggtttgtggtaaatggagtacctattaggtattccattaaagagcatgcgttgttaagtgggtttgattgccacaattacccaaaagaactaaatccaatggggaatattaactttgtgaagaggatatttaaaaaagaatctgggataaaggttgtagatgttcttgctaagtgctcgaagatgaagcatggttcagataggttgaagttagtgctgttgtaattcttgggcaaggtagtaaaagctggtgcaaagaatgatggaaacattgaagagtttctgttaaggattattggcaatttgaatgcgtgcgagacgtttccgtggggccgttacacctttttggaatgtatggcaggaataaggaaaatgatgaagaacatgaatggtttcgtgaaaccaaaagctcaaccttgctttagtggattcattgtgcctcttgagataagtaatttatgatcattatatgagaataaggtgtaatgtacatgttttatgatattaacattgttttgttatttgtagattctggcttatgaggctattccacagcttggactgaaatttaagagtcccttgcgctccgctttgaatgactgtccaaggatgtgcaagcataagtttaaagaatgtagcacgaaaggtgtcccgttggaagttatatataaagagcttgggaatagtaaggttagagtttctgtatttacttcattgtgtgtctagtctctcatgagattgattgattgctaaatgaatttcttttaacaggattttccacgcattttggtacctgcctatcatgagaaatatttgttgaaaaatctcttaaacaatgatgttgatgatgactgcggtccaatagatattgttattgacagttggagagagcgagtattagtagagaagaagaggatatggtggaaaggaatgtgtgagatggacatttcttctagatgtattgtaaatgatatttcggatgaggaagtccatgagattgagaatgaggtccccgagaaagatgtccccctgactgctgtccctccttgattccctgatttagatacagttgtggcatctataacctcactgacgcagatgatgaccaaaggcttttatgaaacaaaagataagattgatgtcattgatgtgagagtgcagtctattgagttatttgtggcagatctgaaggaaagggaacatgggaagcaaacagaggaggcaagtcaacatgggcattcaacagacgatgacgtgttatttgcttcgcccgatggttttgtgaccaccggcaggatgcaacaacgggatgtagtgatctacagagaacattctccagaggttgcagaaaatagtaagtataataattaatgtcaattgggtataaaaatgtgaatatatgacttaggttttgttttaaaatgtgtgcaggtaataaagagacaaacacgacggagaaagagctgaaaggaaaagcgaagaagaatggcgggggcaagaagaagcaggaggtgccacctgtaatagaaaccggaaagaagtgaacaagggtagcatcccgccttattaaatcaccgtttgtgacggataataagaagcgtaagagaatgcggaaggcagattgatccagttaatggtagttgtggaacaattggtttacttaaaaacgtttggcttgatttgcattgtaatgatgtctacttttgtgaatttttaaacatttggcttgtaattggtcttttaggttcaactgtttattttggttcctctactatggttcaactgtttattttggttcatctactatggttcaactggaatgttactaagtcacaacggatagttcagatagttcaacactaggattatccggttcgacttattagttcaaatggttcactttggttcaaccgattagttcatccggttcaactgctagttcaaatagttcatccggttcgactgattagttcaaatagttcagatagttcaacactaggattatccggttcgacttattagttccaatggttcaatttggttcgactgattagatcaaatggttcaaatgtgttcgactagttagttcaaacggttcgacctgtatagttcatccggttcgactaattagttcaaatagttcatccggttcgactaaagtccaaatggctcgactaagaagtccaaatggttcgaccaataaagtacatccgttcgactgattatataattgttagcaaaatttactttcaaaacacagatagttatattcaaacatttagattcatacattgtattcaaaacatagatagttagcaaaataaagattttaaacaacaatttagatttagatttatcttacaaacttaaacaaaacaaaggcataatgtttattgaaagagagagtcaggaggatactcgcgtggaggctcatccactctccagtagtaacttccatcatctggttcatcgtcctcctcaatgggatttggctccgcgaaaaacgaccaattcggtgacgatccatcgtgctcaacacaccatctccttagtggcagtggaatgtcagcaactttgtcgaaaccgtatctcacccagtctttcggatgagcctccaaccgcctcatacctctctccaggtcttgcaacttaatgagtagttggcggtgacgccttcgataagcctggtgttgattatccacctgtccaacaatagaaatgtcaatttctcgctaaatatccatcaatacaactataccaccactatatgattcacctaatataaccaacaatcaacacaactaaaccctaaacctgaaatttgattaaaccctaaacctaaccaaacgagcaacaacgaaacactattcttacatttaccttttgaatgaacatttgacatgcgtcatgcatctcattggatagattcgtttgaccaaaaaactttccgggccaaataacttcacctgggacaaaatctcttggggctggaacaaaatccggccccatatctcctggtaaaggagacttcatccacggtaccgtcggctccactgctccagggggattacacggtgaagcggaacccccaaatgtcggcaaattatctcgatgtcaactaactactcaggtggtggtggagaagaacaatccagtgatgttggagtcggagacgcaggagaggaaggcgccgacgttcttactctctgaatgctccggcgatgagccatgtagttcaccggtgaacagtttcaatttcttgaattctctggtttcgtgtaaaattaaaagcaaacgagtaaattgaatagacatgactcttcggctgtctcatctgaactttgacgccgaacgattaagaaaatgggttgggcttaggcctttcgtttactaggggttgtagcatccctaaaataagtatccgttttgggtcttttgccatctttaatgggcttataaattacaaaaaacaaaatccaataaatttcaaaatatagagtctgctttatgcaaaattcataattcaaaattcgaaaaggcaaaaacgatttcaatccctaaatcgaaaaattcgaattccaattccgaattgcaaaattgatttagggttttgtgagtgccttctctaactactccgatgagttcaagttcagtgtcagtgtcatctggtgttgatggagcccgtggttttccggtgaattgtgcgtgtggagcagatgtgacgatcttcacatccaagagtcaagacaatcccggaagacctttttccggtgtaaaaccaaaagagatccgaaaatgtggacaaacaaaagagatgtaagtagagttggtggttataatgtgtatttatgtagttgctaaacttgtcggatttggttcgtgggttgtgcaatagggtcatttgtttaagtgggttgaggatgctgtgcaagaagaggtcgaagatgctttagaaaaatttggagtcattgcaaatgagcttaacaaaatcaaatctgaggcgaaagagctacatgtgatgttacaagaactgaaagaagaagcagaattgggcaaaaaagaattccgcaagtggaaagtttgcttaacaatgtgttttgtgtggctttgcttgatcaccattgccattgtttacgtaatgtttggtaataaaaagaaacaggactttgtaatgtcggatttgtgaccttattattccctgattttataatacttttgatttgtgactttgtaatgttatttcattggttcgactgaactagagatagttcatctggttcgaaacagtttagttcaaatggttcatctttcgtcacattaccctgttcaactgtatattttggttgcacatcgtaataaatcataaatacttgcatatttaaaacaaagtggttcacaaggttcatacataaatacacttgcataattaaaacaaagtggttcacatggttcaaaagtaaatacttgcataatgaaaacaacgtggttcacatggttcatacatggttcaacgagaaccacgccctcctctagctcggaggatactaatagcactcctcattgatcgtagttccttgaataattgggtctcaagctcagtgatccggtcaatcataatgcgtatcttctcgtggatggctcgaacatcggaacttgccaagcaggaggtccttcttctcgcttgtccttccggctacagtacttcgaaaactcctcttcaatggcttcctcccaccacttatgcaagtgttctccatccacctcggtcagatttagtggacttcggaatcttgttttcccgtggagattgccaccaaccacattacccttttcaacgtcttttccacagtagcacttagtcagaatgccccaattcctgtcccgtattgcattgtagtagtcgaaaccgtcagatttctcactaggagaggagtcggagcttccgttaaaagagataggcatgtctgtcaaatacaaaatataaaactatctaatacttgactaaaccctagatcttgactaaaataaaccctagatcttgactattataaaccctagatcttgactaaaataaaccacataaaccctatatctttaatagaaaagatctaaccttgtgaagaaatgacgtcgtttgccggaaaaatctcgtcgcccgaaaatacttgacgccgctaaagaatcgccgccgtcttcttcagcagagggttttctcgaattttcgatttttcacacaagtaaatgattaaatatagatgaaaatcctcaaaaccctaccattaaaaaaaaatattttaaacatagggacccaccaaaatctaacttgagttgataaatccagacatttattccttgagttgatatacagtatgccagctggaattatgcggtatgccagctggaattatcaagttcatccgctaaaattttacacataattgtacagctgaactatcatacacatagatgtacttttcactgttttcatatattgcagctgaactttaatgtacatacttgataactatgtcgaacccaacctaactgtgatttattttgcatattcaaagttttggcataatcatatttgatatacgaccatattcacgtaatttacttcatttgaggtgatctcatagtaactactccttatcatataagaggttgtatatgtgaacacataccacgatttcaatttttataaaataatatttatcaatgacactttaatagtaatagtagattttttgttgagctagtagtaaacttcaaacgtttctacatattataaaatcgttaaacacattttactaagtgattatagttgaacgagctgaacctgttgtactaggcttacagatttcgggaattacaaaggaaacatagaaagacttgttattagttaaaataataaagtcagattacaaattccttcgtttatacgaataatacaaagtacccaaaaactaaaatactacattataaatttcatcaacttccgaaatttccagattaccaaacaccttcgacacgaggccatgactcacaagcttcggtttagaatgaccgctcacacgccagcaaacgagtacaaccacaattccccgagtacaaagactccgaaagtgagcttgaaagtccaaagcttgttgattgtgtgcttcacaatagagaacttcattgctgcaattcatagaaattatttacttgatcagaaattgtgaacatgactatctgaaccaggtctgctgaaccatttgaactatagcacttgaaccatcagaatagaccaagtgaaccatgtgaactatagcaatttgaaccatttgaactagagtaggtgcaccatgtgaactatagcaattttaaccatttgaactagattaggtgaacatgtgaactaaagcatttgaaccatttgaactagaataggtgcaccatgtgaactaaaataggtgaaccgttaaaactatatcatttgaaccatttgaactaatcccaaaatagaaaccaagtttcattataataagttaagatggaggcacttactgttgattcattatcttgaaagaaaacttcacaccctcgatgccttcggtcaatcggctctgccaaataatcgcacctaccgcatcttgtgtataataatagaagtaagtattcgtacaatttctcaaagaaaatactataaaattgtcaaaataactcaccgaccaacacattcttgtaaaccgtcttctctatgatattgtcgaaaggagtaaaattccaaaacaagagtgcatccgttcgcaaagctttagtaacaatagtttgttcaataaaccatatctggtagtcatgggatgttgctctcacagactcagcgtcgtttcggaccgagaaattagtggtaattatccactcatactcatattctcgtattcgatcaaggtaaaatgacgcaaggcgacgaggaatggtagccttgattcgggaacggggaccctacaccaaataattttaactatatacctgcaagttatgtgaaagaaacaaaattaaacatattcgcaatatattaccgtttgatctgccaatatgacgcccagttcgaactcatccggtgccacaaacttcttgaacacattcacaacaaaaacgcaaatagtcccatccactgatagtcagacaaagttcggaaacagaatgatatccatccatgttgacaaacaacggcttcctttattagtggggtgggctctttttgttggataggatgaaatatgaatggtgtaaaatcgattgtaatcctgtcttaaataatattccaaccgacgcgacgattggtactcgcagtgccacctgtcactgctaatatttcaactgacgcgttgactaggatgccacccgtgtttatagtagacgcagatgaacctgttgtactaggtttgccaaacaacgactggttcgtagttgaacctgttgaactatgtttggcaattctgttgaattaaaaaacttaactatgcttaaaaattccgaaaacacaaatttaaacacaaaggattgttcttaattgaacctgtcgaacaatatttgacaattccgagaaacacaaatttacacacaaagactttatcgtagttgaactccttgtactagttgacgagttaacgtcaatcatcattggtttcaggctgcaaccacctctccaagttgatgccacgcgtagctttgttatttgtcttctttcggcgcttctcacctgtggatggaaaccgggtttcttgattccttcctttttttggagtgtaatccggcggttttgcgaccttctccacataatcaggaggaaagaaccagtgagcctgatgcggcaccacataaattgttctgtaatatgccaatgcccacgtctcgatcaagtaatacttcgagcaaagaccatagatacttacattcaagattgaacggctattctaatccatctagatcgctttatggttgcagctatagcatggacgcacgggtacttgtctatatcaaattctctgcaagaacaagtattcctttccaagtccaccaaataagaacaacatcaattccaattacgttgtattcttgtcggaaactgtttagttcagttgcatttagctttgcaccaattggacagcgcgtatgtaatatattctccacaacatgcaccacttgccttgtgttcgatgtagacgcggaatctttgcgatgtgtgttgaaccactcagaaaacttcttcaaaatcgcatcgatcatcggtaacagatggtacttccttacttctgaaaacacaacgttcattgactctgcggagttgctagtatctatgttgtacttgtctccctaaaaatagcacctagcccatttctcaatcccaattgcccgatccagataggtggttacattaggatgctttctcctaaattctgcatacctagtgttgaacttagtcgcagtataaatatgagctaattccctaaatttggccatacctgcttctttgtcacctgccagcattttcttaatgttttgagacaaatgccatacacaatgtccatgtgatgccttcgggaacacatccgcgactcccttgatgatgcttccatgtctgtcgcttatgaaaaccaatttcgggtcatccggtataatggaaatcaattttctgaaaaaccagttccaactagcatgattctcgctatcaattacaccaaacgcaatggggtaatgaagatgattaggatcctgagatgttgcaataactaacatccctccatatatggttttcagaaaagttgcatcgatcactataactttcctcattgccttaaacccttcaatgcttgctcccaaaacgatgaataggaacttaaacctgtcatctgcatccaattccacttccgttattgtcccatgattcacagaccttaaaatgtgcagataagcaaacaataacttgtagctagtttcagggctcccacgcacatcactaacatgttttttttttcctcttaaagctgtggagtatgaacaatccaaaccatgtcttcctttaacaatactcattttttgttaaggtttcagagtattaagaggacccggatagtcctcatgcaacacatctgctactaatcgcggtgtggctttttgtttttcatatctagttgcttccggacatcaagagcatttatgtatttgtgtgtgtttcttcacaaaccaaaaatctgtgctcgaagttttggtaactcttaaataccaatcacaacccaatgatgtttgactgcattctaacataagacggcccgggtcagatttaatagttttcacaccaaacacttcctctttcgaagctctattaatcaaatcccatactgcctctttagaacgaaattcttgacctactaaatcaccaataccatcttcccattctttgacaacggcagccacactttcttgtaccggacctgcaagacgaacatatttgatatgtctataatatgcatgttttcaatgtccattcatcatcgttttgagtccagtttcgtatcattcatcactgttttatatcatttctcatcattcttgcatactttgcatgattatgatggctttgcatacatattgcatttctgagttgttttcaggtgatttggagctgtttgcgagcaaattggaagaaacgaggcagaaccagaagacatactcgaccaccaggtcgtgtgcatccagcaccatactcgaccccctggtcgagtgactttggagccattcttcccatcttctcgaccccttggtcgagtaacctcagctcaggccactcgatgatgccactcgaccccctggtcgagtatcacttcgccacaccacctgaccacactcggccattcactctaccaaattactcgaccccctggtcgagtatcatcactcaccaccatcaccatcactcgaccggacactcgatcacgtcttcacagtctactcaaatccgcactcaaccagacaagctaagcacaaggaagagaagaggagaagacaaagtgtttggaagcggcctggacctccatcgaatcacgaagcccatctcggcccattatcactctgtgggccgggcgattaggttattggcccgtctactatcattttatttcgttttgtataaatagatgtcttagggttctgtcctgagacatctagtcgacattgagtttttgcttcagttttattttttgttttactctgctgcgccgcttttgcttctgcaacctgtaattcgagatttttccaagttattcagattccgcatttgatttcatttgtcatcctgtttctctactctttatctctttacttatgcaatattatcatttatctacgtttatgtctttgagcatgttgtctgagtagtgacttagaattcttagggatgggatagagtagttgtggaattcgtagtctgtagagtggttaagttttagaattgattgaatccctttaggactacttgcgtttactgcttatttctttctgatcaactggaattcgatcccaagcattccagcacccagaaggtgttcgatgaaatgcttgatccactagttcctgagatatgcgtctctatcccaagggattggccgtttagagcgtttattgactttatcagtctgtttttattgcctgcatagttagattccgttaatgggaattagtctgggctagctttgcttgaggatttctatcacgggagtgaattgatctgttgttgaacctgttgtctagggataacttgattgcgcttgttaaccattcggataggctaggataccactatactcgattaccccatccttaggaatttctcgtctatattatttctctgttttatcgttatcgcttaatcattctcattgcttgtttcttagtttttgcaattactcaaccaacttactcgaccacacccagtgtctggcaacagactgtgcagtcgagtacagttatcttgtttcctgtctgttactcgaccagtatactcgaccacacccagtgtctggcaacagactgtgcagtcgagtatatctgtttcatatcatgtctgttactcgaccagttactcgaccacatcctacttctggcatcagcctgttgtagtcgagtgattttagtaattctgttattgtttctgttttctgcatgttcgcttaggactgttagaaaccccaaaactgttattgcttggcttgacttagtgacttctgatcacatctcatttgtttgtatcacactcatttggattgacacctaaaatactacaacgacaggatagtgttttagaattaattgactaaaaacctattatcaatattcttccctaacataatcattatcagaatcttcattaaccccacactctatcatcagcggttcaataacagtttcagaaactccattctctagcatcataggttcactaactgtctcacgctgttcctctagttcaataataggttcactaactgtctcacgctgttcctctagttcaataataagttcattagtactcagaattcctgtatttacatccgcaaccattacaacattggcagccaattccccataatttacaccgcatgaacttcttcgctctactattggaacttgcctattattactttccaaatcactgcataactctacatgcaaaacaggtctaaatccctctttatccaatgacgttaaatatatcaacacatcctcattatctacaatataagactctctccatgctttacatatcttgtaactcaatttcagattccttttctctccacctagagcaatctttctacagatcttatctattaaatccgcatatgttattctctccaaagatgatgtcttaaacactataccgtatattgaatttttgcaacttcactcatggtctgctgtatagtaccctccatagtcaaagtgtaggttcatctggatcctcttcttcatcgcctcctacaaatataaacactatattagtaccagttgaaccacgagatgtaccagtgtctgattcaatttcagttcgtccatccattgtattatgcaaatatggtttgattctgcttacacattgattcaattcaattacattgtactaactataatacttacaggagatggaagaactaaagaaggatcgtttccagagtagccgcagcaaagatcaataaagaattcgatccaatagtatcgactcacgtagcacgcagcaccggagaaatcgacggccggagaattggattagctgacctagcaaagtttccccagactcgacggagccaatgtcaaaaatcaccgatgttggaagttaatcggaaatcgcctatctcgtcggaattaaatgaattgggtcggaattaattgggttgggtcgggataatttcgatttcgatttggattttgtttttgatttttcttttaaaattaattgatataattcattaagggtaaataggtattatccactacaagagtggcatgcagatcaaaagatggcacgccggattcaaatttccagtttagtggcattgttgattaggactccttcaagttggaataggacggtcggagatcgccgtggtttttaccgtcgctgtcacaatcacagccagagccgcagtcactttgctcattcctttgcaaaaccctaaaaaaattattgggttgggcttttgattgtatgttgggttttttaattgtattgggcttttatattatttgtaatggtttattttagtagggtgaattacaaaaatgacggtttttgaaaaagttattaaatatatagcaccataatgtgtgtaattcatttgatagcacatgtcagttgtgaaaatacacccaactccttcccaacgatgcgcttggagagaaagagaagccacaggaggaaagagaaatatatatgagtaatatatattcacccctcttgattttgtttactttattagtttaacaatattacttggttaaagttaaagatactattgaaaaaacagattttttttttgtttatctaatatgatttgaattttaaaaatcggaaacgaatttcttaaaaaatgaatagtggtatcaaattctatacagatcatcatagaaagatagaatattatatatttgttcaaatagaaacgtttgttccgatgaatccaaataatcaattaaatactttttgatggaaggatactaaaccctaagataatatatagggaacccaagacttttaatataaaacactaatcaaatcacttaatatccttaatcaaaacaaacaattcattttaaaacatatatagtacaaggtatacgtaaatagtatacccaaaaagtacaacgacgccaataaattagagagacccaaaaaaagaaatcaaatgaaggaaacagaaaacagagattgatcaaattcagcgcttattagcgagaatctcgactaattcaatttcaaaaaataaaaccaaagtctcttaaaaaaaaccaaagactccaacaaaatctgaagtcttgcctgtgtaaatcaaaacctctaattcaatttcgagcaaaaccgaaatgtcatttccgaaaattaactgtcttgcttctgtgcccaatacacctctgttaatcgttggcaaaatcaaaagcttcataaacggtggactgaaatttattagagccaaacccatgttcaaaagttaatagttagtgaaagagaataattggttttctatggaagggagaagatgaagagcgtgtatttcaaacagggatagtattggcattattacagaaaatacaaacaatattggttacttttttttagagtgttagttacctaattataatatttttgtaggttataaatgtaaatttcccattttagtattttactagatttgtgtttgtaatagagtaattgtaatatgtaaaccaaaatgaaaaaatctataaaccaagaaaaatacaaaatccagttcatgttcagaacataaattttagctaataaccgatccgaattaaccgactaccgaactgatccgaaccgaattttaattcgagtctattcagtgaaattttcaaaaccctgaattttccttaaaccgaataacccgatccgaccaacccgatttagtcgaactcccgggcctactaacttttgtagcgtttaacggaacaaccggaccggttttagtaatttccctaattcaaattcactcttccctcagtttgaaatctctaaactggtaattccaatacagtcttttcttaaaatcgcactagcttaaaccagtagatcctaaaccgattcatttaaacaacaaaaaaccacttacagagttcgttcgccggcggcggcgagtcatcgtcatcaatgtcaaacatcgttgttctagacaacggcggtggtctaatcaaagccggacaaggcggcgagcgtgatcccaccaccgtaatcccgaactgtctctacaaacctctctcttccaaaaaattcatccacccatcaccactcaccactctctccgacgaaatcgacctcacctccgccgccgtacgccgcccaatcgaccgtggctacctcataaactccgacctacaacgcgaaatctggtcacacctattcacttccctcctccacatagctccttcctcctcctctctcctcctcaccgaagcaccactctcaatcccttccgttcaacgaaccaccgacgaactcgtcttcgaagatttcggattctcttctctctatatagctcatcctcaatctcttgttcatctctatgaagctagtcgtcagcctgattcaatcctctcaaagactcagtgtagtctcgttgttgattgtggtttctccttcactcacgctgttcctgttcttcacaatttcactcttaatcacgccattaagaggattgatttaggaggaaaagcttttactaattacttgaaggaattggtttcttatagatctattaatgttatggatgaaacttttttagttgatgatgctaaagagaagctttgttttgtttcacttgatcttcttcgtgatctccgccttgctagaaatgggaacactcttatcaagtctacttatgttcttcctgatggtgttacacataccaaaggctatgttaaagaccctcaagctgctaagaggtttcttagtttgtcagagaaagagtctgtggtggtgatggataaggttggggagagaaagaaggctgacatgaacaaaaatgtaaactttttttcgattcttttgtctctgtggtggtggtagggatttctctcaagtttgaggttttttttttgtctttgcaggagattgatttaacgaatgagcgttttcttgtacctgagacgttattccagcctgcagatttaggtttgtgttgatgaatgttagaatgtagttgtagatagaagatgatgatgagatggtattttattttgttttgggatagggatgaatcaggcgggacttgcagagtgcattgtccgagctataaactcatgccattcttacttgcaaccagttttgtatcaaaggtggttttcaaatggattacttatttttaatcttctgctgttattgaatgagctttgatgtctaatgtttgatgttttaccgcagcattatcttaactggtggaagtacattatttccacaacttaaggagagactgtaaggctaaatttatgtgatgaatcattcattagtactgctttattattagagaagttgatggtctgagacattattgcagagaaggagagcttcgaccacttgtcccagatcactttgatgtgaagataacaactcaggaggagtaaacaacctcaatcctttttttttttttttttttactctttatatttgcagctctttctttgttattttaactccttttgtatttgcagccccatactaggtgtatggagaggtggttcacttttggcttccagcccggatttcgagtccatgtgtgtcaccaaggctgagtacgaagaacttggatcagctcggtgtcgtagacgattctttcattgaggctaaccaaaacaatatcacatgagttggttgtaagttgaaattcttcacattatttgtcgtatattgtaatgcatgtattgtttttcttcttcctctaatttgataaacttcaaaccgtttaagtaataaccaaacaacaagagaaaattatcttgtcttcttaaatcaagtttacacagaagaagggtttagggtacaacatgcagaaacattatctatatcacaaatacagtaatatttaaatgcaaaaacttgtttttgttgttgttcttcaaagatgatttcatgtgcgtaattttgcatagccaacgaaagagtttggtagtatagtttcctcatcagtcggtgtagggttgagagtccatgcacaaatgcactagctttctctggtactgttgaaagtattcacaaaccgctgtcacttcttccttccctgattcaagaccaggcagatcgggcagcggtactgtgccatcaccagaagcagattcagactcctcgtcttgggttgatagctcggttatgatttctgaatgaatctcctgacacgcgaggacaaacatggctactgtatcaggctgttgcacctctctgagagctgcaagcgcctcttgcagggaaccagcagccacatataaaataagggccctgcattaataaaatgaaattcttttctcatcatcggaactgtttgaggaatttatgtcacatttaaattttctaagttaaactgtattgaatgtgagcatgatgataaagtaccgccagacgttgtgctccgcatggagaacatgatcagcccacctttgcaataccctgagtagatagagagataggagtagttacaacgactagtaaccaataataggaaataataattagatctagaagtaaaccgtagaagaaaagacctggcataatccgatccttctaaatgtgttgcggccaaggtagcagcatcggtccatcgtccagaatcttggagctgcatattaaaaagtataaaatattctgtgtctaaaacgttgcctattattaaaccaagctaagaatattctcgaataactaatgaaatgacaatttcagtggaagcatagttccgaagaatatgcaatatgtagtatgaccaaggaaacaaagaaagctaacctgtgaacaagcttcttggtgcctaccaacggcacataaaagatgagtaccagtgagtgaattgtcggtccttaccatgttggctgcaacaacctacgtgtggaacaaatgtgatggaatgatttttttacaaggacacgaaagattatccaatatagcaaagacagatacctttagtgcaaggtcgagaagagatttagacacagcagaagcgagtgcaacagctcggagagcatttggatagaagtatggagaatctggagctgaagaaagcagcaaactaacagcagcttccaaatttccaactgatatcagcctggtcaaagaggttaccgatacaagatcaacacaactactttttctctcagcttaagatgcttctaaaatatatagtttccattttacacaggagctactactaaaacaaaaccgtaatttcaagtaataaattgaaaggacaataaacagtaaagacaagctaatggtgaaatactaactcgtgtacttgtttctgaatgcaatcttctccgtctaatttttcatgccaaggaagacgttcattggcacgcgtccgtaattcttctcgctcaaaagccatcaatctaagtgaaccatcacactgttcgagaaaatgtagaatataagctcaccaacaaacactaagcaaatggaaatttctaatccaaaccgacttcaaataagaaagctccattaagctagcagaaaattacaaagtgaaggagctccagttccaaaataaataaatctcgtctctgcatcctggtagaagggaatggctagaatgcatgatcttttgaaaggaaaaaaaaaattattttgaaactgaccatagagtctatcttcctggcttcaggtgacgataatccagtagatggtattttactcggcatagctacttcatcagctcctgagtctaaagtaggggaagagattttctgcggagaccttctcgttagcttgttcatcagatggcgaatggcttgaggaagttgcaaccagaaaagtgcttctgaggtttcaccaaaaacagaagctgcaaaagcaaatcttgcagcataacctttcttgaccacatcagcgtaaagttttgctctttcatcgtccagcaagcaacctaggatacaagaaattagagaaggtaagaaaatagaatacttaaacaggtatcttaacagagagaggctagtctgtggtgacaaatgagatcaaccttctttccgataaggttctagtatcttcaacagcatttcgggcactacagggtcccctaaaggcggtaactgaatcatgtaactccgtagatccttagaggatgaagccatcccacggattaaatgaggcctcttctccaaagttgtgctagacgtattaaaccaagatggtttcactcctaactgtaaaatcatccgcagtgcctgcatgtataataataatcagacacattgtcaagagtaatcggaatctcatttctcagaacctgtcttgggagattatacggatatacagataatgcaataattagtatcttctggattacatgaattcagaactaaaccaagattgacttcagaatcaagaagtactccaaagcaaagaaagttaccagcgcatgtggcacaggaagtaagataggggaatacataggcataggacgaaacctctcctttactgatttagactggggcacaaagccagctttcttttcatttctgcaaaatccggaagaaaaagttggaaattaaagatcgcagaagtaaatgattgtagccaattcaaacttggatcaataataatggaccctcagaaaaaaaacagtatttatatgccctaacctaggcatgcctaagtcctaacctgggggaaagggcgcctagttgtcaaccccactaatccatctacacggccttgttttaggcacagtcctctggtgagcaaaatagataaacctagacatgtctattctatacagttaagttatacggggagaaacaacatgctgaaaaaaactaatcctaatctgaaagcattcatgggactctgcatacgaataaagttttacacatacacagtaacctcaacgagccggaaggtgctatcagccccggcaatgcatagaacaagcggatcatttttatcagttctcagaggcagccaatcaagttccagtacaagggtgccaggaatttgaggctggagaagtgattgggctaacggatctggtgaatcctgcagcaattttcaaaagcaagtgtcagaaagagtcattttgagttgacagacaatttcaaacaagtatcaataaaaccagtcctgttcttgttttctcttcacactacacaatattagtacaccacctttgaaaccacaagacatgtgcacaaattgaaggaaaatactgaatcctcttaagactcaccagatcaaatacagagaatgtattgtcattaaatagcacagctacacgccctctgctgcgatctccagcaacaacaggagaaaatttgatcctccgtattccatctctgtgactattaaatgcagatgactgtcctgttgttacatcccaccatcttatgtttcctgatctatctcccataacctgaaaagagagagcaaaatatgatctctcataaaaataagagacagaactggaaggtaaaaagaaacgaaccacatgaggcaagcgatatgccatggctgtaaccaatccatctgagggaacgaatgaagtagatggccatttaggtctagaaatagaggcgggatcgtctatacgtcagtgaatataggaagaagattacacagcaatcaaggttcaagaaggtgagtgctaatttatgtaaaggcggctactaacaactatcaggtagtgaattttctgcactttctgaaattggacaataaagatctactccctatctcgcaattttttaagaagaatttaatgacagatggcaaagaaacagattgaaaaacaagcatggaataagtgaaaaggaactctacagcaggtaagcaataatgtgcaatcactatttcatattatcttctcagaatcagagagatattcagaagcccttaactatgatcagcattgtgacaaaaataaaaacgcagctataatgtattactacggaaagaagaattctgaaaaaaaattgagttaacggaactctgattagttttacctgaaatctcgaattcgacgtccttggacttcaaatactccaagagcaccatttactagtgcaaatgcaaaactctctacagtttcttcttgcgatccatctgagcccactgatgctgaaaatatgtcaattaccgccccttagaaaaaaatgaatcaaagacttgggtatattcaggataacacagtttgaattgtcataaacatctcacaagagtctcctgaagcagttactccttcggatgctgagagcgattgtttggacggaccgccttgacctgggcgcggaacagctggaagcgtccattccactaccgtgaaaggaagagctaatgatctaagctacacgattaagagaaataagaaacataatataattgattagaatacataacctcaaaaagatactaaacactccacaagttagatacgacatatttaaacaagatgcaagagtatatttatataaagaacgcttttagttctcatttgacccattctccataccatcattactttcttcttaaaagttcacaagaatagatattggcatggcaagaaaggcttgttagcacttgcaaaaggggggagccaagaaaagaagccacatagagaatgttgttataagtaaatctcctcaaaaaatttaaagggacaagctttatcaattttatgcataatcgttcttattaggcattatgatgttcaagacctaacatgagccagtgattatttggtgccaattactcaatttcacatgcaaaaagtgtaaggtgggcaaggcattattacgtgaaagtaaatggccatacgaagaaagtattacaggaatgagagagtaagatatatagaatgggacatctaaagaaaaaagtcagaatgtaaaattgcaaattctaagcttgcaaacataagagagaaaaagttattgtcatccactcactgagactaacttaagtagaaaaagtaaatattttggggtttgagctcactcaccataactggatgcttggtcattgcccaaacttctacaggagcatcacggaaaagaattagaagatacctgcaacaggacagaaaaaacgaattctcagcatcagaagaggtatctagaagctcgggtccaaagtaataacttccaattttacaatagttcctcatctttgaaatagtgaaggagtatcctcgatgatctgaattgacatttgtcatcttataaaggaacatattttcaatactgaaagacgatgttcttaagcttaaattattagtgagaagctgatagcttgaagagcacaagcatttagttacattatttataggcatcaaatactcaagcaggtaaaaaaacattaaaatcaaaccttccggaagaagaagttctaagagctcttatgggagtgcgctctggcttttgtaaatcacgaaatggtttattcaacccacttctaaggcaggtaacaacaagcctatttatgtagcctctgcttttgtcattcacctgaaaccacaaaccagtgcatgatgccggatgtcactttcctaattctattattttttataaaaaaacaactggaaattaaactaaacctaatactattcttaaaccaactgtagattggaaatcactacgaaaaaatagaagaaagcgatgcgacgtaacatgttggattattaaaatatatttgcacacctgactgtaagaaaatgaaactaatcttgaatttccaagccaccgaaggcctctaacaacaccagtatgaaccgaagtgcttgcagcaacagcattcgttgatacatcaacaacatcgattgtcccactctgagttcccaaagcaaccaacggaacagctgcagcaggaatgttaccccctccttcatttaaaatcaatccataaatcaatcatttgagtttcttatgaacacttttagtattacaaatacaagggagaacaaaacaaacttgctagggttgctgtaagagacggagatggtacagcaagtgtagagactgtggaagagagaagctgaagctgtccagtcaggctgatctgcattgagcgaagtaaacaagtataagccctgttaagtagaaaaataatgaaaagaccaataaacacatactgtggaaaacacaaccctaatgatgaggaacctggtaacgccaaacttctaccctctggcggaatagtcatatagtgattaaggaactagttaacccaaaaaccttccagccaccaaccttaaatgatagatctgatttttccatggaggaacctgatgtgtgacctctgcttcgatttgtaggtgcaacaactaattcatcatccagacttgaggaatcattttcctgaatagctccaggaagtgctgcttcagtggctccaatacccatgtccaagtctgatgcatttttcagagcatcttcaacaccttcagcacttaagacccacttccatattttgccatcatcagatagggagataaaagttgtcttagaaacaagaagactttcgtcataaaagtcaaatgggttatcaaaatctatagaagaggttccatccgggtgaatttttgtaatggtttgcattgtggagtctgaatgactgagtagaacagccagagcggaaggagacgggatggacattccaatagatggcataaactcttccatggtacacatgacatgcacctgttctcctctgcaatgatatgtaacgagctatagtttagatatgcatccagaacaggggtatccaagtctattcaacataacaagatacaaagtcatattcatatgacgcttttataccatcaatctcagacactataagacaccagatagttcaaatatgaccagataggtagactagactggttgaagcacaaggctattagcatgattaccctaaaatctgatacctaaaatattctatccatattttcccagtgtagattctttaaaagatgatacttctaacatgtaaacggtgattgcttcaaccatctcctggttaacaagcaactcaatctgtatagtgactggaaacacaaaaccctgaaccatcaaaagctaaaatgaagccacccttaaaggacatagatatcttactctttccgacgccaaatgctgagcctgccatcgacatgaccacaataaagcaactccttgtttggatcaggcaagatatcaagaaacttggcgcaaccacgaggtaatggcgtagtcgagaggggcgtctcatattgcagatcaaacaccaatagctccctaggaaacgtcacaaagagtatattcttccaatgtggcgagaaggcaaatctagcaaagtataacggaaatgcggctgaagcaggcgaagacgatgatgaattgccattactagctgcctctctttccaacctcggtagctcactgaaatctgtctttatctgcatctcctgaatcacaacatcgttctcactatctccaagtaccttaaccgacaataggaatcctttaaggccaagcacacagaaatggcgagaatcatagggatcgcggcggagacaggagagaatctccgtgccggcatcgtacttccagaaaagtccaccggaggtcgtgtagagcgagagaaacgaagatccagaaatcgcagcgaggacatgagaatcgtggcgagcttgaacccaacaaaggtcttgaattccgagcttgggatcggaggaaggattaagccagacgacgacggagcgaagatggaagtcaacgagagcgacacggccgtggcgatctgcaacggcgaggagaaggtgagaggcggagggttcggtggagagtagatcgcgggggagagggagaggaatccaacggacggaagtgacgaagggagagagagcaccgggaggaggagggagagggatagtggaaacgagctggagagaacgagaatcgacgacagagacggaggagccagaggcaaaggcgaagagaccggagggactgagatcggcggatccgaagttgttacggctgggaggaccggggagagtagaatcccaggtatcggttggtgatggcttcgatgctgccattgttgcagctttctaccaacttaatttctctcgatttcaatttcaattgtctcatttgtaaacttccaaaggtgagttgaaatctatacatgaaccagcatgtacagaggaccattctatttttaattttttttcacaaagtgttctttttgtttagaaacagagagattccaaacattataaaagtgggtacaaccacctacaacctttaaagcctgctaactattacaagttttggattatcaaacagagtactgacaatccctacttcaacagaaccaaaagtatcctaagttacttgaagctcgaccataacatcttgaacattcaaggattaatgagctcgcaatgagaataaccaaggatcattagaagactctacaacataggctagtcttcatcttttacctgaaagttaacacacacaaattcctaaaaactggattaaagaaaaaaaacgaaacaaccttttcctgctttgtcgaaactacgtgataccaaaaagtggatgacagtatttgtagagtgatattatctcttctttggaggtatctcaactccccaaactgatgttcttgaaactttcattatttttttcttcagttcattatctgtcacaattgatagatatttagatgactccccaacctcaatctttgtgtcatctcatctatcagtcctcactctttacaaagttctttgctgcccaacaatgctttctttggcaaattgatccgacaatcattgaggatgactgctagcaacataagattgaagtcttaatcttgttatcactacaacaaatatccacattaatagcacaagaggatacattgatagcacaagaggataactcattttccgttactgctatgaaagattaatttttattttgattattttgtaatagcgtttgataaacactatgatagaaaatcactaagcggaaagctaaaatcatctattccgccaatatatatgcgaaaaaatcacttaagcgccttatgtctcagatctaaaaatattaagcgacaaaacgctaaacacatcttaagaaaaaaaaaaatcccccaaattgattccttcaaaccctaaatttcttctttgaaaatctctaattccacttcttacatcccaaattctacattgttcttcacctttctctcctcctttctctcttctttcactcatcctctcacgtttcagatggaaaaggtttgttgattttgtctctcttttccctttgaatctatagcttctaatccttgtttgttggttgtatcgctcctctgttggttttgtctctcctctttttttgaatttgcagctcaaaagggtaacgtttttgaagtgtttttgtgcacacaaggtgttcgacgaattgactgtgagacaaaaaccaagaaaagactcaacatctctttctctgggttcgtttctctcttctccaaggttgtggtatatctcaaatcactatgattcataaacctaattacaaatactttatctataacatcttaagtgttcttcctcatgttgaattatgttgtgtatatggttcgacattgcattcagccgtggatattgtagtatcttaggtcattaagcaaggtctctttgttagcatatgtagcataaaaaagattttgttttgttctttatgttgtttcgtgctaatatatttcacaaattctcattgctttctctcatgattctctaaattgttgttactctctttggatttctttaatctgtttccatggatgattacgtttagctactttaattgtatttctacatcgagtttataatgatttggttatatgattaatagttttccttctaataatgacttataattttctctatttcagtttactattgacaatatacttagcttcaattaagctactaggagaccgagttttggtaagaccaaagagacagagaaaaagacttgacttttgaatatagagaattgagagatgggtgatagtcaaggtagcatcaaacttgcttaattggtttggtttctgaaacttcattttgtcgattcttagtggttagcaagattagctagattgatttcacttatgtggtttgtcatttttgttttcagaattctcagaagttcctgatctaagtcaatggtgttcgagttatatctatgagtcaccgatgatggatacaagtgatggtcttgggtttgcttttcttggagaaagtaaaagtataaaggaaatggaattagtctcttctcacgctaaagatatgtctcagtcccaaattgagttttcaggtgagtaaaaagatttgtttactaataatgtgacttaataagtttgtgttcaagaagccgaaattttacttgttttatttcatgttctaacagaagatattatgaatctcgtcgttgaggacagtgagatagatgaagacaacagtctttggggaaaacctaagagaaaaggtagcaatgttttccgaaaacctaagagaaaggatgagactacaacaacctatgaagctgagctaaattacttgaagaaccgagtctaatatctagaaaacgaagtaaggattttgcatgatctcatcaataacttcattggcaaaagtagtatatagaagttaggatattagtttaagtgttggattgagacttgtgttatgtatgaattgatttttggtttatgaaatggtgtatactttttggatgtttattattatatatgtattggttattttgaaaactaaacatgttccaccaaatgcaaatagattaaaacaaccgcataaaattagagtcatgacactgaatattatagcattataaacattatagatcatagcctatatatatcgctattataagtcaataaatgaaagcgttttactaatgctatggtagaatattctatcataacatacggaaaaaatgctatcgtatatggagggtctaccataacaggggcataacacagcgtttatgaaaaagctattaatgatattttatagcgtttctctcgtgataagaatgtggatatttgttgtagtgtatcacactgttagctattttcgcagctcctctattacaacttgaaggctccaacaagatgaaccaatgaggcttattttttgtgtaacttaaaagctcagctatatgaccttctatagctggccaatcttttggtttagcaatagcttgaatgatgtctactgaagaagctccaaacgtaactttctctaaatgatgcttattcatgctatctaaagcccactcccaactctttaattttgcatcaaataatgaaagcacctgagaataagatcttctgctatgtagcaacacatggccattaggatcacgaactatccataatgcaccagtgatatgtctataatttgcatgatttaggcaatcattcttcaccactttatcattgtttcatccacatttcgtctcattaggagtcgttttagtgtgttttacatacttaggacgattttgcgttaggattgcatgtgcattgcatatttggttgttttcaggtactttggatgcttttggagttcaaacaaaagagaaacagaacgagaagtcagaatgccgaatgacgccttcagcaaaagtactctatcgcagcctcggggccctgccaggcatatcactctatcgcaaccccggagaagctagcagctcagtttcactcaatcgcgaagccggaggaatcaccccatcagaaccactcgatcaccactcgatcaccagaaggcctatctgctcgttctgcactcaaccagacaagctgagaacgaagaagagaagagaagtcgaagcaaccactcgatcaccacctcatgacatccactcgatcgcactcgatcacagggtcgctggaccattcaatctcgacttcactaaatctcactcgatcgcaaggcggagcccctgaagcccagtttgatcaatgacatactcgatcacaaggaaactcattttagcccgtcagaggccaatgacaaattcggtcgcaggatcatgacgtgaagattcgctatatatttagtttccttatttgttttatttctcgcttatataaactgcctcttaaggttttccctagggcatccgttatttatctcgcttttacatttcgcaactttgatagcggcagtgtttctcttgtgactttgtatttgtgcactttcaagtatttgatattcagttttcgtctaagtctttcatcatttctgttatcatgttttcaatcgttgctttgctattctctttgagtatgtctgagtagtgaactgtatttttgaggatgggatagattagttttggtttacttggtcgttttaggtggttgagtttagaatactagaatcccttctggattagttgcgcttattgcttgtttcactggctaatgtggagtatgagtccagacgtccagcgctcataaggcgtttaatgggcgttggatcctattaattccagagatatctgactctaccccaagggattggctgtagagagggtattggctttaacatgttgattcgataatgcctgcttagttagagatcgctaaagggatttagattagtgtctagctttgcttgaagatttctatcacgggagtgaattaatctgttgttgaacttgttgtctagggatagcttttgtgaagttttgtcaaccgcctgaatagattaagtagaccacactattcgattaccccatccttaggaatcgtttatccatttgattgcctgttatcatttctgctttgttattcacctgcctgctattgccatttctgcttttagtttcatttcatttctgttattgcatactagaactgttagaaccaaacaactttctgcttggcttgactagagcattctgatcatatctcatctgtttgcatcacaccggattggattgacatcctaaactactacaacgacaggatagtattttaggattaattgactaaaaacctattatcaatttggcgtcgttgctagtttggtgtttgtttgctatatttgagatcattagaaacgttaagatcaagttcgtttttgttacacaagttactaacattgtgccttttctgtctttgtgtttcaggtcccttgcaacccgctttacagacgcatctctgattcgtctgttatagtccagctgctatttgctgcatgcatacacggtcacaaggaaatcagaacctcctattcaacgataacatcgaccgtattgcttgccaaaagagagaacataaagacacaaacacaatgactgacgttgtagatgagcaagagcaacctacaaacattggtgctggtgactgccctcacaaccacaaccagcgtcatggaattgttccacctccagtacagaacaacaactttgagatcaaaagcggtctcattgcaatggttcaggggaacaagtttcatggcctgccaatggacgatccgctagatcatcttgacgagtttgaaaggctttgtggccttactaaaatcaatggaggtagtgaagatggtttcaagcttcgcttgtttccattctcacttggagataaagcccatctgtgggaaaagacgctaccccagaattcaatcacaacctgggatgactgcaaaaaggccttcttggcaaaattcttctccaattccagaactgcaagactccggaatgagatatccggattcactcaaaagcaaaatgaaagcttctgtgaagcttgggagcgctttaagggttatcaaaccaaatgccctcatcacggatttaagcaagcttctcttctcagcacactctacagaggtgtcttgcctaagataaggatactgcttgacaccgcttcaaataagaaatttttgaagaaggatgttgaagaaggatgggagctagttgaaaacttgctcagtcggatggcaattacaatgaagactatgacagaagtatctgcaccaggtctgactctgatgacaagcaccatagagagatgaaagctctcaatggtaaaccagacaaaatcgtccaaatgcagcacaaacatgtttacttcatctctgaagatgaaccattcccagtacaagagggggagaatgatcagtgggctgaaatcagctatgtttagaatcaagatggctacaacaaggggtataatcattacagaccaaacccaaatctgtcatatagaagcaccaatgtcgccaaccctcaggaccaagtctacgctcagcagcagcagcagcagaaccaacccaaaccgtttgttccttacaaccaaaaccaagggttcattccaaagcagcagtttcaaggaggatatcaacaacagcagccacagcctggtttcacaccacaacaacaacatgcacctacgcctcagaattcagacataatgattatgctccagcagctcattcaaggacaagccacatgagcaatggaaatcgctaagaagctgtctgaagtaaactacaaagtcgaccgacaaggcgtcgaacttaacaacaagttcgaatcaatgagcactaggatgagatatgtggaatgcatccttgcatcaccatctgttaacacaaacccatgccagcttccagggaacgcaatccaaaatccaaaggagtatgccactgcccatgccatcactatcacacatgatcgagccatgccatgtccctacatcaaacactgaggacactgtaattctagagggggaggatttttatcaagatgatgttttggctaacaacacaatcgaagagcccatactcaccagtaatccactcgaccacaagcttccccagctactctctttgttgaaaaaccggaagctgcaaagaccaaagacatagtcttcgtgccacccccttacaaacctccgctttcattccctagtcgtttcaagaaagttctggttgcaaaatatcgagccctccttgaaaaacagataaaggatatgcctttagtggactgtcttgcgctactacctgacgagcacaagtacgtgaaagacctgattacaaaaaggatcaaagaagtccaaggaatggtggtattaagtcatgagtgcagtgctatcactcagcagaagattgttccagaaaagttagaagatccaagatcttttactctaccatgctccattaggcaattgactttcagcaattttctatgtgatctatgagcctcagtcagcataatgccactctctgtggcaaggaagctgggattcgttcagtgcaagccttgtgacctaaccttgattcttgctgataggacttcaaggagaccttttggcctgttagaggatgtgcaagtaatgatgaatggagtagaggtccctactgattttgttgtgcttaagatggatgaagaatctaaggatcctctaatcttaggaagacctttcttggcttcagctggagcagtcatagatgttaagcaaggaaacattaatcttaatctgggggaggatttccaaatgaagtttgaaattagggacactatgaagaagccaacaatagaaggacaaagcttcttagttgaagaaatgggtcagctagctaatgaactgctagaggagcttactgacaaagatcacctacaaactgctttgaccaaaagtaatgaagctggatttctctctagtgagaccttgagctatgagatgtcaatagactcacacaacaaagtaccaggatcagagatctttaaaggtgtcattgcgttagaaagagaggatgttgcattgaacgaggaaggctcaattgatactcgactaaagtgctcaaccaaacagctaaagtcaagcatgagggcatcaaatgattggttagaattcaaggagaggtctaaatggcatgacagagctataagagagctaacacacactgtgaaagagctgaaggatcaagtcaaagagctccatgggaaagccaaccaagcaccactcgacatcaaggacgtcccaaatgatgaagttattcctatggttagaaaagaaggatgtgaattcacattagaatagtatagaaaagatgattatccagatgatgaaaaatgagcttaccaagaaagggccattgagtactcaattacatacttgtcacgagagcatgctgaatttgatgttgtatctactaaggaaggagaggagacgtcaattctactctatcaccctccttgagcctaatgagtgtgaggagtcaagctagagacttaaaacaagctcacttgggaggaagtcccacgtctatccctgtatatagtttttattttattttattttgttacttttgatttgttttggttttggttttgattctcaggaaatgaataacagctagagcaacatcagggatgcaaccgagtgttcaaataaaaaattacaattttttttgatgaatcacttgatcgcaagatgggagtaaaagctcgggagtgcgatctagtagtttttggacaacatctttctcaaagacaatgtcaaactactcgatcgtaacatggaagtggtgtgattgagtgatcttctagtggaattgcccaaaccactcaatcgcaaggagaagtgaaaatgcccgacatgacttcaatgacaacccgcctgaagacatgccatccagctgccaggacattgcccaacaaaaggaaatccacctattaacagagggaccacaccgttccgcaagctcccgcaaggcactcgtctcatgagccaatggaacacaggaggaagaatgctagaactgtacattcatcaagtaaaggccggataatgtcgggccgaagaacacatgatcatcgtgctccacaacctgctggggttgcgatcgagcacaatgacgaggagatggccgagccacatcaagaacttgtcatgcatgcggagtacactcaagcagatatggatgactacatctccaggacattctactgaggtaacacaccaaaaccctttgtaaatactgcttttgtttttgtttctgtgtttatcttgaattctttcacaaattttgattacacaagggactgtgtaatttaagtttgagggaggattcaagacgtaattgacttgttttttgtgaatatcatttgagtctgcatatcatctaagtcatagaaaaaaaaaaaaaaattgaaattttttgaaaatgaattccacaaaaacagagtgatcatttagttgcattacatttaggatagagtctagagtgtttcatataggattgttgcatatgcataggggataatgaggaaatagccttgtaagcatgatgattcactaaaatgagttattagttctctgaggcatttgaatgactttgaagtaaaaccgcaccatgttctatagaaaccactcagtgcatgtaatgacacctttccctgtcaatttgaacttgaatctgacttataattatcatgtttgcatcgcttttgaactcaaggatagaatacatatttggattttctttcacttattcaccactcttgttaatccaagtagctgcttctattattggagtagttcccccacccttaaccaacccttctttcaagccatgttattttgtgagagcatgtgaagcctattttcaggattgagcttggtagaacgtgttaggtttgagccgacaagagtagtatctcatgtagttccaatccgcgttttcggacttggtaggactaggtgggaatttatttggggattgagattgagtgtgaaaagaaaacgaaagaaaaataaaaaataatgggttagagtccttaggagaaggaagctgaaaatcatattgaggtctagtaaatgtttgggaagcatagaattgttaagacttgctctaaaaaatagatggcagcaaaaacagaaaaaaaattataagagccataatagtttaagaaaaactcaattcactagactagactcatagagtttaagaaaagcttctccttaagaacaagagccaaagaaaagaaaaggaaacattgatccaagaaaaaaaatcaaaatatgcctttagtgcaaaatggtagacttaggatcatcattgggtttagagataggaccatctacttgttattcacggtttatgtcattgggtagatgtggtgctattcttgtatgcataggttggcacttacctttagcattcttctaaagcttagtcctttttcattgagagtcccctgctattaaaatctgaaccacttaaaagggaccatctttgtctcataacctgtcattagccaaatgagttcactagcgattcatatcttgattcatgttttcgaacttaatgaatgttaaagggattggttgatcttgacgcattgtgcatttgagtgtaggtttggatcataacagagcatggctaaagtttttaagtagaagtcgatcacctcgcattttagaactgttagttggtacattgatcttaattgtcatatctcatgctttggttctgaatccccaacttcaaacatctccttccgcttatgtcttcttgtttgcttgagggcaagcaaagactaagtttgggggagttgatatgtctataatttgcatgatttaggcaatcattcttcaccactttatcattgtttcatccacatttcgtctcattaggagtcgttttagtgcgttttacatacttaggacgattttgcattaggattgcatgtgcattgcatatttagttgttttcaggtactttggatgcttttggagttcaaacagaggagaaacagaacgggaagtcataatgcccaatgacgccttcagcaaaagtactctatcgcagcctcggagccttgccagggcaaatcactctatcgcaaccccggagaagctagcagctcaatttcactcaatcgcgaagccggaggaatcaccccatcagaaccactcgatcaccactcgatcaccagaaggcctatctgctcgttctgcactcaaccagacaagctgagaacgaagaagagaagagaagccgaagcaaccactcgatcaccatctcatgacatccactcgatcacactcgatcacagggtcgctggaccattcaatctcgacttcactacatctcactcgatcgcaaggcggagcccctgaagcccagtttgatcaatgacacactcgatcacaaggaaactcatttcagcccgttagatgccaatgacaaattcggtcgcaggatcatgacgtgaagattcgctatatatttagtttccttatttgtttcatttctcgcttatataaactgcctcttagggttttccctagggcatccgttatttatctcgcttttacatttcgcaactttgatagccgcaatgtttctcttgcgactttgtatttttgcactttcaagtatttgatattcaattttcgtctaagtctttcatcatttctgttatcatgtttgcaaacgttgctttgctattgtctttgattatgtctgagtagtgaactgtatttctgaggatgggatagattagttgtggtttacttggtcgttttaggtggttgagtttagaatactagaatcccttctggattagttgcgcttattgcttgtttcactggctaatgtggagtatgagtccagacgtccagcgctcataaggcgtttaatgggcgttggatcctataatttccagagatatctgactctaccccaaaggattggctgtagagagggtattggctttaacatgttgattcgataatgcctgcttagttagagatcgctaaagggatttaggtcagtgtctagctttgcttgaggatttctatcacgggagtgaattaatatgttgttgaacttgttatctagggatagcttctgtgaagttttgtcaaccacctgaatagattaaggagaccacactattcgattaccccatccttaggaatcgtttatccatttgattgcctgttatcatttctgctttgttattcacctgcctgctattgccatttctgcttttagtttcatttcatttctgttattgcatacgaggacagttagaaccaaccaactttctgcttggcttgacttagagctttctgatcatatctcatttgtttgcatcacaccggattggattaacatcctaaaatactacaacgacatgatagtgttttaggattaattgactaaaatcctactatcaaccagccaatcttttcgtttttgaccaagcaaaaccaatattacacttcaattctcgagagacaggaggaatccaattagcattttgctctctaatcaactttccattttgtttgatgttttttgggcaaatagccattgattcccatcaccaaaagctttagcaacaattttatttgccaaagcaccctctccttcaaaaagaagcttatttctattcttccatagaacccacataatccaagaattgccaaatcttagatcttaaggaatagctctaaccttagacagttgcagcaaatgactaatatttgcaaaaattgatctcccaaaacctgaaactagaaatggaacattggataaggcccacatttgcctagcaagggggcattgaaacaaaatatgattgactgtttcaatcttttcctcatacatcaaacatccatcttggactttaattcctcttgttcttagtctatcttcaactacaatagctcctttcaacgctttccaaataaatacctttatttttggagctgtttgaattttccaaattgaatcaaacaaaggacttaatgatggacttgtttcagcatccgtaaacaaattacgatgtgcttttctactgctcaaatcataaccagacttaactgaatataacccattttttgttcctgaccaacaaaaagaatcttcctttgaaggcataggtcgttgttgtgagatgatctgaatctcttcaagtggaaacagtttctttactcgactccagtaccaatttctcatgtgtggatcaatgagactcttaaccttcaaagaaatatccattaaagaatgaagattcatagcccttctagattttccatcaaaaacccacttatcaatccaaacacacgtattttccccattaccaatgaccctctttaatccctggattaacaactctcgaacatataaaatgcttctcctagcgtatgaaggacgagttccatatggtgcattaagaaagtcagaatttaagaagtatcggctcttgaaaatctggtaaaacaagctatccttttaagtgagtaacctccatgcttgctgataagtgtgcattttacatgttttgagcatctatttgtcatcactttagcatcatgatatatgtcaaattaatcctaagaccactctctcaaataaagaggtcaattgcagcaattagggatcgaattcacaaagttctcggatcacgcaatagactaatggcaaatcgaattacgctaagtaaaatagtaaataaaataaagagaaacaaaagtaagcaatagaagattggttcgttgtgaaacaagatattaaaagcgtcaggcttagggtttctcaggagataaatgatagtagatatagaaatagctaagttgttatcaaaccgttctcgaactcaaactatgattttagagtaaccggtggcgttccacgaaactctctatacttagagctaagataaccggagaagccgagaaatcctatactaaagcatgcattcttatcaagtttgattaattcacctagaatctaaactagagcccttctatgagcctacctgttctttcttaaatgcctaggctcatctatgatggatcaaatagcaagtacctatggtgggcatacttactatctaatatcaagttctagttagctactctagaactagcattaagaacaatcaagaattcctacagataaccttgcaagggggcaatctacaaaatcatctataactctaatgagaaaccctaaacctgacaagaaaactactcaagcatgatgaatgaagcaaacaacaagattagaatagaaatcaatgaataaaacaagaagaaaatagagtaagaaagatccaaatggagtttccacaaggttttgctcctaaagtacaaaagagataaagggaatcgcccccaaagcttaggtctaaacaatgaccctaaaaacctaattatatgtctaaaacacgtgatgggccttcattaaacataagagaaagttctgggccgaatttggaaatcttcaaaacatcaataagttgcgtctcgaaattgccgtcaggaattggtgtcgctcgacaccaggggtggtgtcatttgacacctacgtgcattttcgtctccggatttctacaacagcttaagttgtcttttgatctccagaatgctccataatctccaaatgcatcccaaacatgtaaagacctaaaaaggactagaaaagactctagaaataacaattagactctaaaacttatatctaaatcatagctaaaatcggtaaaaatagagttatatcaactcccccacacttacctttgcttgccctcaagcaaaacacaaaagccgaacccgtgaaagaggtttgaaaacacatgaactcccaacattctctagtttattgccaagataaatctaaccaaatccatatgcctagcaagtctaatcaaatcctaaccaacatgtacttctctgcaagcttacacaacattctagattccatacctaagttccacaactatatccaccaggctttcatcgctgggtctcatcaaacaagctaatattcaagatctttctagactcattcctatattataccgtgataaatcgaccattctttatatgtatgtttttctttgtgtcctttctctcccctagacttattttttttagagagtaaaacaaaggggaactcgcatactagatcgaccccctcggcattttgccaacctttgtaattgatcatcccaaataatgtataataatggggtcatagaaaacattcctacccttatacactatctaaaaatcgtctcaatctctcattatattttttttttataaggggcgaagaacatattctttttatcacattggtctcaatatcaggtgaacaaggagtcaagatctatcaatactaaccgtttgaaaaggtaaaaggaagagcagtgagattagctccagccttagtggttgagttggaaactaggatatcctcaagtctgttggtttgccatctaaattttccaatagtcggattgactcgaacctgcaacactcatcaatcaggcaataaacaagagaaatatagatcatgattcctaactaaactaatcaaaacctcttttttttttaaaaaaaaaaaaaaatgactcaataaactcaaaaacgaaaaattataagaataaaaaataaaggcaatgttagtaagaacctcccccagacttaaacgacattgtccccagtggcattcaaatccaaagaaggtgggaaaagtaaatcaaaaataaaagaaaagaaagaaagggaaaagaaaaatcaaacttagtgggttgcctcccactaagcgcttgtttagagtcaatagcttgactttggtggagtttgaggatcatgtgaatcagatggaggaagtaaatacttcctcgtagaacctcgcatcatccaaggtggcgtataagcagccagtgtgtgcggtctaccaaggaagtgaggaatgttagcaggacaggacagaggtatgggtggtctactccggtttcctgaacaatcatcaaaagaaagaacaagcgctcgacaagaaactcatggcttgcttaaccgtaaaacagtttttagaaattttaaactcttattgatgaaatcaggaggtttaggaggaggagatgagtaccttagccgtttaggaggtggatcaatgagtagaggtgcagtgggtgacgtgaccgtagtgactggcgtatcagtagtgaactcaacacgaaaaccagctctaataaggaactctggctcagcctgtgtggggtgtcacttggctcttgagaatctgttctagcatgcattccatcctactcgtagaagtgggtgaagggtgggcttggtgagtagaatagcttgaatgactaacctagaacatagcaggcctgttgtagtcatcaagttgaatggcacgtccatctacaacagctgcagctctgtatccggcttggtgtcgagcaacaccctggtggtgtcgatcgtcaccctcggcaaaatcaggtagcaggtttccctactcatcgattttctgaccatcctcattgtatgcctgaccagctctgaaccttaacactcctgcaacatcaggtattactatcaacatcttggtgttgcaatttaattcctgaagctcctgaaacagaagaaaaaagaaaacaaaaagaaaaactgaattagtaatgaaagaaaagaagagtctagacttaaatcgacacctagtctaatggtgaagcaaagagaacttcggcaaaggcgccaaatttgatataggttaaattaatcttaagaccatctctcaaataaagaggtcagttgcagcacttagggatccaattcacaaagatctcggatcacgcaatagactaatggtaaatcgaattacgctaagtaaaatagtaaataaaataaagagaaacaaaagtaagcaatagaagattggttggttgtgaaacaagatattaaaagcgtcaggcttagggtattctcaagagatagatgatagtagatctagaaatagctaagttgttatcaaaccgttttcaaactcaaactatgattttagagtaaccggtggcgttccgcgaaattctctatacttagagctaagacaaccggagaagccgagaaatcctatactaaagcatgcattattatcaagtttgattagttcacctagtatctaagccagagcccttctatgagcctacatgttctttcttaaatgcctaggctcatctatgatggatcaagtagcaagtacctatggtgggcatacctattatctaatatcaagttctagttagctactctagaactagcattaataacaatcaaaatgaagaattcctacagataacctagcaagggggcaatctactaaatcatctataactctaatgagaaaccctaaacctaacaagaaaactactcaagcatgatgaataaaacaaacaacatgattagaatagaaatcaatgaataaaacaagaagataatagagtaagaaagatccaaagggagttccacagggttttgctcccaaagtacagaagagataaagggaatcgcccccaaagcttaggtctaaacaatgaccctaaaaacctaattatatgtctaaaacacgtgatgggccttcattaaacatagaagaaagttataggccgaatttgaaaatctttaaaacatcaataagttgcgtctcgaaattgccgtcaggaattggtgttgctcgacaccaggggtggtatcgttcgaaacctacgtgcattttcgtctctggatttcttcaacagcttaagttgtctgttgatctccagaatgctccataatctccaaattcatcccaaacatgtaaagacctgaaaaagactagaaaagactctagaaataacaattagactctaaaatctatacataaatcatagctaaaatcggtttaaatagggttatatcacatcatatcatcacgattttatataatttctcatcatttgtcaccactttgcatgtttaggatagttttgcatgcatgttgcatatttgtgttgtcttcaggtgatttggagctgttggcgagctaattggaagaagcggacctgatcacaacaaaacactctaccccctggtcgagtagattagatggctccacgacttcaaaaaaccacttgaccccttggtcgagtagaagacctcatcacttcatgtcaccactcgtcccccttgtcgagtaccaccatgagagtcactcgatcacatccactcggccgcatggtcgagtatcatcatctccatcacctgaccatcactcgatcacacaactcgaccacctggtcgggtacctctatcaccttcactcgatcactctaccaccaagccgagtaccaccatctctatcactcgacttcgtactcgattgccagcttcagattcttctccattccgcactcaacaagacactcgagcacaatgaagggaagaagactctagcttatcactcgaccattcactcgaccacctgggtcgagtgtcgttcttaattcgtcccaatactgtgtcgttttgagtattcgggtttcggaatatttcgctataagtagcatatattttacatttttgtaacaaaacgttttattctgcagacactgtgttcttgacgtttttgtaatccggatatctattaatttattcagtatttgttttttatttcgtttactaagttgttcaccatgttatcatcctgctattactctgttgctatcatgttttcattctcttcatcgtttatgttctctgcaatgatgtctgagtagtgactaggtttctgaggatgggttaaagtagtttagaattctcagtatgctaggtggttgagtttgatttgtagatccttctggattagttgttcttaatgcttattgctttttgatcaactggaatttgtgcctagacatttccgcgcccaaaaggtgttcgataaaatgtctgaacccctagttccagagatcgtggttctgtaccaaggtattggttacagggagcgttttggctttaacttgttgattcgtaatgcatgttaggttagctctcgtcaatggtgattgagtctgggactggtttaacttgagggtctctgttgcggtggcacttagatttggttatcgaacttgttgtctggggataatttattgagcatgtcaatcacctgtaaactgaagaaacgaaactactcaattaccccatcctcagaaattcttaatctaattgatttctttgtttattctgctgttgtttactgcatcttgttacatattgcttagtttttgcatttttcctgttactcgacctgatactcgaccacccagttttctgacaacagactgtgcagtcgaggggaaaacgggattttcatactcatacttttattcagagtgtattttcatacctaaacaaatttgtaaggtattttcatacctaaactgtatatttatttgaatttcatacctcaacttaagaaaaagtgcaaaattcaaagtcaaactaacgggtgttagtcaaatccgtaaagatgctgagtcagcggacatgtgaattatgacatgtctagaacgacgtcgttttgcataacagacgtttataaatgataaaaaatttgaaacagacgggaattgaacccacgtcgtttaaacctttacccggagaatctaaccatttttaccaacaaactttattggttataactcaaacgtttcaatatataaggataacagttttgtgttaaattgtttgcaaaacaaaggtgtcgaacttgcatcctcaatgtcttttaacggagtgtctaaacattccatctccattttcattggttatatcccaaacgttttaaaatataagggtaattattttgtgttttctcattaataaaaattattttgtattaggaggaatgaattaaattttatggtttgtaattgaaattctagaatatgaaaaatcaatttcaaatacaaaccctaagtttattcatttccctcaattcaaaacgttttcgttttattaatgagaaaatacaaaactattataaaatttattcagtttcagtttagaaagattttacattctaaattttttaacattctacattttagaatttttcaaattgaaatcgatttttcacattctataatttgatttcaattagaaacactaaaatttgattcatttcccccaattcaaaacgacttcgttttattaatgagaaaacacaaaatcattaccgttatatatttaaacgtttgacgtataaccaataaatattgttggttaaaatggtttggtaatcagtaacgatgctcttagggcgtgggttcgattcccgtctgttgcaagttttttttttttcttttttttttatcattttaacgtctattatgcaaaacaacgtcgttttagacacgtcataatccacgtgtccgttgactcatcgttttcacgaagttgacaaacacccgttagtttgactttgaattttatactttttcttaagttgaggtatgaaattcaaataaatatacggtttaggtatgaaaatacccgacaaatttgtttaggtatgaaaatacactccaaaaaaggtacgggtatgaaaatccccttttccctgcagtcgagtatctctgttacattttctgtctgttactcgaccacacccagtgcttggcaacaagctgtgttggtcaagtgttttaattgtctgcttgaatttctgtttcctgcatgttcacttaggactgctagaacaccccaaaacctgttcttgcttgacttgactctgtgaactctgattgcatcttgattgctagcatcacactcatttggattgacaaccttcagtactacaacgacatgatagtgctttaggattaattgatcttaaaaacctattatcacttgcttagctaagagagcttgattaaaaaattgaagatctttaaaaccaaaccctcctagtaagttaggcattgtaagcttctgccaacttacccaatgaattttctttgtattttgcaaattgttccacaaataatccatcataatacttgtaagatctttgtagagactaacatgcaacttaaaacgcgtcatagccctagtagagccattgcaatcgatttcaacaaaacctccttgccaccttgagataaagattttgcataccatcctgacatccggtcctgtaacttgtctttgataaaaccaaacaattggtgcttagatccactgaggcactctggtagccccaaataacgacctgttccaccttctaaatgaatcccagatcttcgcttgatccactctttcatctcttgttccacttttactccaaaggtaattgcagatatatctaaattgatcatctgtccagaaactctttcatacttagacaaacaattcaacatttcttcacattcttctttattacctttacaaacaaacaatgtatcattagcaaagaggcgatgattaacaaatggcattgaattattgaattgaatacccgcagctttaccttctcggcttgtttgattgagaaaatgaatcaaggcctcaatacacaagataaaaagcaaaggagacaaaagatctccttgtctaatgcctcttttaggtttaatgtaaccaaaaggttgcccattgatcatgactgattaagaaacagaagatacccaacccataatccatgaaatccacttcttatcaaagcctagagctaacagaattccttccaaaaaacttcattctactctatcataagttttagacatgtctgttttaaaagtcattaactcattggatagcacattattagactgaagaccatgcatgatttcatgagcaattagaatgttatcagatactaacctctcagccacataagcagattgcgtcggtgagactatctctggaagatagactgtcagtctactcgaaatgatcttagaaacaatcttgtataagactaagcataaattgatcggttgaatatctgtcattctctaaggattcaaattttttggaatgagacataagtgtgtatgattccactgttctggaagaacacctgatttaaagaatcccaatacctcctcaataacttgaaccttcacaactgaccagtatttctgaaagaaaagtgctgtaaacccatctggaccaagagcactttcaccattaattgaaaaaatagcattataaatctcctctttagttacttccttagttaaccgttgattcattgaagcagaaactctagattgaaatccaactaaataaggtgaaagcaaagcaggagaagaagatttaaacaaatcattaaaaaaaatagagaagcaagacgttctttttctctatttaatgtttgttcaacacctttcttatccagcaagaaattcaaggaatttttaactcgagtggatttcacactagcatggaaaaactgagtgttcttatctcctccaaacatccatttctctctgcttttttgtcgccaaaatatttcctcatcactaaaagcaacacccaattgctctttaatcttataaattctttcccagcaaggacatctaacactaagcccatcattcaacacctttctcaatctctgaattctatttttagcattaaaatcggcagatattttccaaatactaatacttctacgatattctacaatactaaaaatagaagagtgagtaccttttgaaatttcactgttccaagaactgtgaataacatttgcaagattaggatcatccgccattcttttgtcaaatcgaaattgcccacaaaacacttcttgatcattaatgaatttgactaacacaggtcgatgattagaacctaatttctccaaaaaccattgatgagaattaggaaacattgcaaaccaagctggatttccaaacatctgtcaagcttacactgaatccattgataattccttatacagccccaagtaaaactattccccgtacttcccaattcatgcatcccacaatcagtaaacatatctttaaagggtctaaaggaagatatcagcctaagaggacctcttgacttttccgcattagaaagaatctcgttaaagtcacctatcatataccacgcttcttttctcttgagaccaaaagtactaattctctcccacaacaaagatctaagactcgccacaggattatcataaacacatgaaacaaaccatctcttactaccatgagagatctgcaaatcaattagatgtttgtcttcaaaaaggaaatctaaatccagattatctttccaaaaaattgccaaacctccactctttccttcaggttctattgtacgatacttatcataacaaagccacctaaaaactttcaaaacaaaatcacctttattctttgtctccatgaggaatagaatatccggaaaatgttattttcgcatttctttcaggtaccgaattgtccagggattcctcaaacccggacaattccaacctagaatgccttactgatccaacggcggttcacttggaaccaccgtagttttatctttctttagacaagcagaagattctgaccatgtaacatggacttttctcttgaacactttagcaaaccgattctcagaatcatcaaaactaacttgatctccctccgacccatccgatttggatttagtttatcgtaacaaagtaattttccttttcttaggatttttctgcttcatacttaaccctgaagaaccagcatcagacatgtttgctttaaaacctgtagataaatcaaaaccagaaaaacctaagaagagatcatcattaaactccttggagaagtccgaattttttgatgaagaagaagccttcatcgcatcagctagtagtataggagtttcttgcttggagatagctttgcctccatcatttataaacaatcctttttgtttatttgtgactttagaaacctcactagaaactaacacatgacttggctgaagaaacagacacaaactcttccctcatgagttagcctttgacaatgaaaacatttaattctctcataatcaaaggttattgcaactatttcaccagtaggaagttgtacttcttttgacttccgaagcggattcctaacatcaaagagaaccctaacacagacataatcctgagcttgagatttttcaggatcaaaaagtaccagtaacaccttcccaacacactctgctacttctttaatcgtctcctttgtgtaatgttaaccggaatattacgaagacgaatccaaactggaatgaacatcaaataatcatctacaggtttttcaatccatctttccattacaacacaccaatcgtcttgtgtccaaacccttgtttttaagatttcatctaactcaacatcagagtttaaaataaactgaaatctctcctgcgataaggcaataccccgaactctagaggacaatctccaaattctaggcatgtctaatattcaattagccattctttgatgtgtaggattcaaaaaccgacccaaaatacaccactgatttctctttatagaaaaaaacttcgaatgatttgagagaataagaggcttctcctctgcaattgacatatcttgaagcgctttatgtatatccatatcagactttagaaacaaactatcaacagaaccaaaccaacacagatctagcagatcgaaacgattaaacagatcaccgactgatcaaacataattacaaacggaagaacagaacaattacaagatgaaatacaccaccgacagaaaatggaaatatctatggacaaaggctcagctcaattcgactatgattgagagagtagttctgaagcccaataaaaatgggacaacgacaataatcacggcgataataacctcaccattctattctgccaccaaaactgaaaaaaattctaacgtgccactagttattgtgagtaccactcaagggtgtgcaattacccttagctccttaatgagtaattgagaataaatgattagtaaaaaaagaaaaaaagaaaaaggttaattccatttcatttacgctccatttcccgcataatgtttatacctccggcgacttaagctccgattttgccggcgacttgagattcgatttcggcggcgacttgagctccgatttcaccgccgagttagctttcggggtcgctgtagcttcaaagacgaaaatctgctcccaaaattagcttcctcctcaccggcaaaagtaaatccgatctccttttgatttgtagattaatgtgaatttcttgtttgagttagttgttaataagataaaattgttgtattgttcattctgggttgttgtatcgttttgaatcatagagttcagtgagtcttcaatcaaaattaacgatttgtaaaaccctgaattgaccaactgggacaaatggtaacactgagacataatagtacaaggggtacaaacaataggacaggtggtacaaatggtattagtgagatataatataggtacaattatgtctaaatctgaatgattacgttattgtgttttaataatttatttgtaattataggaagcgatgaagaacaaacacacattcatacaatttgacaatgagtattattcagaagagcatgagtggatttcaaacaattctttaagcggtgtattgttgaagacgtcaaaggtaacatactcgttgttagtagaaaagatatgcaagaagattggaatagatgaaacctcaaggaaggtgaaattgagttacattctatgcacatctgagagagagacatctattgtagatgatgatgactttttagggtatataatggtagtgaatgctaagggaattagaccagctttgcacgtggaattagtaaataaagaatctgagagggtggaacaaatttcaagggtagagggaagaagttcagttggtgttaattttgaggagttgaatgcatttgatgtggaaaatggtggagtagtgacgatttttggagtagaaattgcaggaggtaattgtgtgaatgatgaaccgattattgaagagcctaattgtgtagaagaggctattgagaatgctgatagccgaatttttgaaaaggctatggagaatgtagttattgaaggtagggagcatgtggatagccagatggatgttgataaagataatggtattgatggtagaattaagtattatgagcttccatgtgctggtgaaggaagtcagagtagtgagaaaagtcagagtgttaaggaatgggaagatggaacggggattgaattgcaccaagaatttgtttctaaggaggtcgtgcaagatttggttaatagagctgcaaataagtattgttttgcgaccgcaactgtagagtcagatccaaagcgactcatgttacgatgtcggcaatctataacaacaggttgtaaatagtatttacgatgtgcaaaagtaaagagctcagattatttcggtgttaaagttcagaggaagatgtactcatgcaagcggtcttttaagacctcaagcaattgtaaacataccggcataccacgattaatcacgtctattttgcatgaggattatccagctgagtttcaaactccaccacctaaaagcataatgagtattgttcggggaagaatgggtttgcattttttgtatgctaccgcgtggagagggaaaaaacaacacattagtgatgtgcgtggtagtcctgaaaaaagctacaccaacttgtactcttatatgtacgtattaaaggaggtgaatcccgagacaatatcatatgtggaagttgatgcacaacaaaagttcaagtacttcttcgttgctttgggtgcttgcattgaagggtttaaagttatgaggaaatttgttattgtggacgccatttttcttaagaccgtatacggcagtatgctagttttcgcaacagcccaagatcctaatcatcacaattatatcattacgtttgctgtaattgatagggagaacgatgctagttggtcgtagttttttaacaagctgaaaaccgttataccggatgaaccaggtttggtttttgtgagtgatagacatcaaagcatcatcaaatcagttatgcatgtgtttccaaacgcgagacttggccattgtgtttgacatttgtctcaaaacgtaaaagtaagggtgaaaactgagaaggaagaagcggcggctaaattcctcatgagataagacaattgatagtcttactgccggataccacaactaaaccagggagaaatcaagaaacccagtttccattaacagtggaacgtcgtcgaaagaagactaataacaagtttcagcctgggattaatatcaacgcgtggttgcagcccgaggagtccgactgataattaaatgtatattttgtgttgtattgtgttgttatgtctgtaccgtgtacttgtaccgtctgtactattgcttcatgtattatgttttcatttttaagtactttggaattttgttaagtgttgttatgtctgtatcgtattcttgtaccgtctgtactagttctttcatgtttatctcttacaacaaaacctctataaattaagactcgataaattaataattgtataaaaatatcaactatatatattagaaagaaatttaattttagtattatttcttttacataaatttgcataagtctttttatttaattttaatatttttcttatatcaaaaactttttttgttgttttctatacatgataattattagggaattttgaaaactaccttgtttatgagtttttgtatgaaaaatacacttctctccacttttaattaaactactagattttaagccgcagtgtaccgcgggaacaatttatttttaaaagttagtatacataaaagtttgtaaattgtatctatctataaaatatttttattttatagtttacaattgttattaagtaacgtcctgccaaacccgtcccgccaacccgtcccgtaaaaaaaccattaattttattaatattgatcttatttatgatatgtttatgaattattgtctaaatattttgtaattttgtagtaagtaaatgctatcaaatatctctgcgatttgatgattataatcggattggtatagtcatggagaaaagcaatatcaaaaatgataattttgtagtaattaaatgatattaaatattttggaagttttattttaggaactaatcgtgtaggtaatgtggagagatttagggaacattgttaaatgttaaatatttaattcgaagatttgttttctaattatcaaaaacaaacattaaaatccagtggcagccattgtaaataagtcccaattacaggatttatttcacaaaatggctgcaaaaatatatatgtagataatttctaatatatttgtaggagaaaaaggaataaactaaattcaaaatcttaattattaattttgactatttatgaaacaaatacagtttatttattttatccactaaaatctatttggttataattttttgtaacaaaacaaaattaatttagtcctacatgttttggtacaaatcatacatggttctgaaacatttattaatcacttatactaattttcatacgatctaaaaaatatttgaaaatattttactcatcaattcaaaaaacacttcttacattatatggtatgcattgtatcatgttggaccaacttgacataaacatggcgaaacgcatatatttatacaaattgtataactaaaacattagattttattattaaacattttatatcatctgtccaactataagttaatgatatttatgaagtccaactctaaatattaaaacttccacaaagtacaaataacttgagaaccgtacaactgaataactgaacaactatggctaatgcgcagtcttttgtctgggcccgcattccacgtttattggtaataactcttgtgtgttcaaactatgtattttaaatttcaattcaaagaagagaatctttctcattaaattacatttctttctctctctttctttcttctcctttcttctctctttttcttctctccttctctgccgagttctcgaacaacagtgctgacgaacattcacgacgaacctccgccgacgccgaccaccgaatctttcgcatcagctgccggatccaagttctctgacatccgtttaagctccagctgtaagttttgggttggattgaaataaattagggttttgattttcccacttttgcatcgaattatggtttgcaatgaattagggttgccgtttatgatagtttgatatctagggttagatttttgattttcttaaagatctagtttggattttagggtttagattttggaatttatcccctttgattttcatgtgtttggctacagcaaataatgccgtttagttattggtcaccttcttcatcagagaaacgatccatcgatgatccttacaaatacgatggtgattttggtgttcccacaaactgtttttttggtaaacaactttacctttcagagcgtattattggcaatcaaaagaagacatttctcaaatgtccaatgagtggtcaagatgataattatcacgttcacgagcattgctttttcatcgacaaacaatttggcgagcacagggaattgattcaaaatgcattcaaatatggaggtgatagtaatcgtctccagattaaccaaatccgtgttgaaattgagtacctcaaagaccgcttggacaagaaagatgcagagatcgcaaggcttatggatgcacttggaaagaagtaaaatgggaattgactcttgatagtatttcctttttatgttacaacaagtatgttaaggtttgaaactatgttgaattcctatttctagagtcatttgtactttcttgacttgttttgaagtaatttgtacctcttttggaattgagttgtacctctctataaactacttgtacctcttgatatattcatttgtacttgttttgaagtcatttgtactatttctgacttgtaatttgcaccgcttttggaattgagttgtacctctctataaactacttggtccttctcatcctctctacggtataaggtggcttgtggaatctcgattgatttaccttacgcttctttttgccaccttcatccgcgtcttcaggatcctcatctctttttttcttgtcattcttcgtatcgttgcacttcccttttcccttcttccctttcttcttcgtttccttcttcgacgtctcatcatcgcctttatccactttcggtctcatcatgaacatgtccttcaaaagaaaagggaaccattcataaccaactaacatcatatattaaaaagatcaaaaattgacaaaaaaacataccttttggagagcctgcagcataaagaacgatggcagtattcagaccctccgtctcaacatcctcgggctcaacaccctcggtctcaacagcctcaggctcaacaccctttgtctcaaaaccctcagtcttaacacgatcagtctcaacaccatcagtctcaacacccacattcacgttcttctcattcttaccaccatctttcttctccttattcacatcggaattcaccttcttctcaaatggaggcacactctcaccggcttgtctcctttcaatggttaaaagcctttaattgtgttccgccaacatctccatcacttccttcaaagagctactgctgcccgaaacatccagaacatgtctcggaacattctctgagacatgttcttcctccatttgctcgccgcttcgagcccgcacatccgcttcaaacatgtccttccaccagattctcttcctctctttgatcaaacggtttctccagctatcgaaaaccggatcaacgaaacctatcccatcatcagcatcatcaccatctacaatgtgtctcaacaaatctttctcttcgttatccggttccaaaatgctagagataacctgtacaaactcaaacatcaaaataatcatattaaagctcatagtcacatgtaataagatataactaggacaactcttacctttacacttccaagctcctcgtttatctcttccaacgagaaccctttcatgacactactagagaatttgctcttacacattctcggacactcattctcgaaccttacagggtctctaaatttttgtcccaaatgtggaatagcctcaaatggcaaaatctacacattcaaattaaaagtcacataagtattagttttaagtctaataatgcatctcattatatataatactctaaattgttacctctaatggaaaaataaatccggagaaacaagtctgcagttttgctttccctttcatgttgttcattaccgacttaatcccttccatacaaccatcaaatgtgaaacgaccccatgggaatgtctcgcatgcatgcacatcatcaacaatcttcagcaagaaacgctaaatgttttcatcagcctttgacttcgcagcaatcaccttgcacaaaaaaagcaagatagccaacttctttctatccgccttcttcctttctccacaattcttcatttcatccaccttcttctcaacatcaatgatcttaatcccaaatacctttttaaagatctttttggcaaacttcaattctgcatccaagatcttaatactcggctgcaattccttcaggtactcatgacaatcaaaaccacataagagcgcatgctctttaatggagtacctagtaggcagtccaataaccacaaaccagcactcccgatccatctctgtttgtgttgtgcgaagcaaaagcatccccatgccttgagtcatgtggcttttctcctcaggcatgtggaatacattcctaaactgtgaatgcgccttgaaccatgacaaatcttctataaacccctccaaatacttcattatctgctgcacagtgtatctcgtccctaccttacacgtcttctggtattcgcttggaccaaagaacatcccttgtggctgcattggttgttcctcatcatcaagttcctgaaatttcatacacaaccataaaattaaaatttcgctgtactacttgtactagttatctcagaccaacattatcaactttgttcagaattcaattttctaatgcaaaccaatgtatgattaatcacgttaacgtataaatccatgcaccaatcacataagttgaaactatactattaagttgtcttaagtgttttctagttgtccttatacactacttttaattttcgaacacaattttcagaaattaatgttacctcagatttttcttcttccccttctttatcctcttcttcagggttttcttccatcccctgaggctgcatttgttcctcgttatcaatttcctgaaaattcatacacaaccataaaattaatatttcgttgtactacttgtaccagttatcttagaacaacattattaacttttctcagaattcaattttctaatgcaaaccaatgtatgattgatcacgttaacgtataaatccatgcaccaatcaaataaacctatactattaacttgtactaattgttttctagttgtccatatacactactttcaaacacaattttcagaaattaatgttacctcagatttttcttcttccccttcttttttcctcttcttcagggctttcttccatcacctgaggttgcattggttcctcatcattaattttctgaaaattcatacacaaccataaaattaatatttcgctgtactacttgtactagttatctcagaacaacattatcaactttttcagaagtcaattttctaatgcaaaccaatgtatgattgatcatgttaacgtatatccatgcaccaatcacacaaaactatactattaaattgtactaattattttatagttgtccctatacactatatcaatattcacataaaattttcagatatttgtatatacctcagatttttcttcttccggttcgttaaggttttccggatgctcttcgtcacagttttcgtcttccactttgttttcctctaccacttcttctcggttcacatccacttcacggatcgtgaccctctcatcttcactctcactcgaagtaggactgactaactttgcacgaaccataattcccttgcaaaccacacaacaatcaaagaaaccgttcaaatcaacacaacaaaaaccacatctaatatttcaaataaaaaaccgttcactttataaactaataagatacttacaagagtatagcggtaacggcggctaaacgacggcggtttggaacgacggcggtgacgaacatcggcggtttggaacgacggcagtgacaaacgtcggcggtttggaacagcagcggtaacgacttagcaaaatcatttggtgaagaagtagagatgaaaccggtgacggtgaactaatcggagaagagaaaacgacaaaattttccaagaatcgccggaataatcgccgtttaagttaatcggagaagagaaagcgacaatattgattttcgaaaaatattagttaggttaaaagttttgatttgggggaaaacctagtgacaatgggtcggatcctggagctatccttggatttgtggttggatcctgtagttttcctaacttaacaaggttatttcgtaatatccctctgcttctctatttaaaaaaaattcaaaacgaaaatcaattttgagattggcaaaatgaaaatttttcccgcagatgatggcagaatagataaaaatccgcatgtacacattaaaaccatttatttaagtaactttttttcaactaaaatctatatgacaaatatatccctataaaaaaatatgataaaaatcaggataattagcagataactgcattattgaaataatatcattaacaaatatagatggagtttgatgtatggatgaaatgatataacgtacaaaccaacttaatatgttaataatatatttgacgatataaacaaattctcagttattaaaccaatgattagatttcaaagactgatatatatgcaaaaaacattatatctactctattatttgagacgtatgttaagtgattctcagttaaaaaaaaatttaccttaaaatcatatgtttaaaatgttaatgtcatgaaaaaaattacctttaactgagaatcacttaacttccgttataatctttgccattcgattgaattgtttgtgtctgttcgatctctcgccttcactttaaaaacacgcggaaccttttgacccaggtttacaatttttgggtcatacgttataatcttggccattcgattgaagtgcttgtgtccgttcgatctctcgccttcacttaaaaaacaagcggatccttttgacccgggtttacaacttttgggttatacgttataatcttggccattcaattaaattgtttttatccgttcgatttcgcggcttcgcttaaaaaaacacgcggatcattttacccggtttgaaactaatgggtattcgcctctaatcttggccattgaattgaattgtttgtatccgttcgattacgtatttcccaaaaaaaaacacgcgcttctttttatcctgttttaaaaaaatgggattctccttttaatcctcgccgttgaatagatttatttcaagctgtccgattttgtagtttcatgcataaattcttccgactatatttcaggaaactaatcgtattaatttcattcaatatcttgcgtatcttcgttaacaattaagtatatatcacttctccataattatccatgaaacagtatttcgtgtggatcttctttgagaattatcttacattttctccataattatagcacatataatatttcgtttggatcttcttttggaattatcttacattttctccataattatagcacatctaatatttctttgcgatcttcttttggaattattttacatttctccataatcctatattcatacctacttttacggaaaatgataaatattttcctataatttactgatttttgatatggaataaacttgaattccaaggataatatcttttgcgcatatttttttgacctaaccactcattcttataaatatcggacgcctcatttcaatctactcactcagcttacactcacacagtttcattttcaatttcatttttttaaaaatgatgctcgacaatcctcttccattcactcccttgaaatcgctaaaaccttacaagaacgcttggcgtattcaggttaaattgcttcatgtttggaggcaatattctgtaaaggctggtgaatccatcgaaatgattttggttgatgaagctgtacgtattatagtttcaactttatattttcataaaccttatagtacaagcatcattttcctttactaattattatttaaattatttttgtcatatatggtgataagatgtatgctgctgtgagaagagagcacatcaagaagttttaaaggtgcttaaccgagggtgtttggaagatcattacgacaatcactctaaatcctacaagtggtcagtatcgtatttctgacttgaaatacaagattggttttgttttcaaaaccactgtctctccatgtgataccgtttctgatgctttgttcctctcacttgctaagtttgatgtgatcctctctagatccgctaactcaaatatcttgcacggttagattcaagttttcattttattttcgaacatacatgcattatctcttatatagtaattatattcatagatgtattctatttgtctatacatatgttatgggtcaggttgtcaatcggtctgaaatccaagatcttaacgctaacaacaagtccaccaaaaaaatcgatttcgatttgaaagatcagcagtacaaacaatctatattcatattcattcttatttaaagtttgttgtttttttactttttattaataaatttattctttccatttttagtgacactcgcttggcatgtacactttgggggaagtatgctgagattgttgaccaagcttgccaggagtcaaccgatggtattgttgtttgcttaatccgatttgcgaagatcaatctctacaacggtaattatattgttatgtgttactacatatctatactattttaaaaaacacgaccttaaatttttaaaacagatagtaggagtgtttccaattctttgatgtttcacaagtcttcgtggatcccacgttggctgagttgggtctttttaagcaaaggtaattgtatttatttgtcactaaatatattagcttctacataatattaagcaaagtatattttcttgatatatagcatactaactgatgggttaactttgggaagttctggatcttttcacaagaggctctatgcaccaagaactggcgatgacgatggtgattatcctaggcaaacaatcaaggaagtcctcacatcttatgatgtacgattcattaatttatgtggtggcaaacctttttattacattttcatattttaaacttagtttgtcaattcctctttatattcatttgaaagtgggtaagtgcaaaacagtttgttttaatccggcaattgatacaaattggccgtggtactatttttgttgtcgtgctcacaacaagaaggttgtcaaagaagaagttatcaaacttgaagatgtcaagctacctcaaaagccaagattttggtgtgaaatatgcaatggttttgcaaaatatgttgttgccaaattagtctttatgaaatccttatattgaatgtattatgatttataatttggtgtttagaagctaataatcctatttaacttttaggatttggttacatctccatattatggaccaaagtggtgaagccagatgcatgttattcgatagtcatgcaaaggaaattcttgccattactgcccatgatttgctttctaggtcatttgatgaggtttattgccttttgaaaaataaactctttcattaaaatgtctacgttcatgttataataatctatatttttctgtagatcgaagacccaactgttttgcctgatgttatcaatggtttgaaagggaagactttttagtttctattgtgcattcaaagggaaaacatatttggtggatatgattcattcactgttgcccgagtctacaccggtaacattgctgatgaaatcgttcaagaagactctgatgcatacgttgatccatcatccttaatttcgatcgaacaggtttgtcaaataacattaaacaattccaatcattaatatttatttcttagggttgtcttattaaactgtttatgtattttcatatagggttcccttatgctcactaatggtgttgacctttctgatgtggatttgtcatcaacctgtactccatcatcaaaacgaaaagaagatgatgttgatggaaatgatcaggcttccataagtaggaagaagtgttctaagatgaccatgtctgaggaagtctccggcgaatgatgctcaatgactactccagcttggatcgtttttttctttcttatttatttgcttaaagtgatgcaagttgttttatttttttaagatctaaactatctttattttattttattttatttcttgggaattaataaagttatttcaattatatgtcgttttgttaacaattttattacttaagttatactccctctgttccactaaattttatttgttatatgttcacacaaattaagaaaacaaatttaatgaaattttattattttgttatttaactataatattattaatatttctctcttctttttattatttaacaataaaatagtaatgattttgatgtagaacatcaattttttggaaacaataaaaaactcaaaacatcaattttccagaaaacaatattgttttttattacgaatccaatgattttatattatactgttaatcatactaaccacaagcaattttgctaattttgtattaaatattaaacaaaatcagaattagcatagattttgtacactaaataatcagtctaactaaacaaacatattcctattttttcatagattcttattataataatgaccattttttgtaacacgctaataaataaatgtcataattattgttcaaacctataagaaatcatattggttgtagatgattcctttcctttttacacatcaattatttcaacgaggagataattgatcaattatcccttaatttgtgttccaatttgcacaataatatagtagaaaaactaaattagaatatacattccgtatactgtgccataatagatttagattatagatattttggttaacaatatattttcatatatattgtttcctattttttagtatggctatgtttatcatattatatttcgtttctcatacatttagctttatactgaaaacaaataaacattttttgttattttttcatcgattacaatgaagaaaagaaaggataatgatgaaaatgatgtacatcaacaacaaaaaaaccagaaaaccaaaaaagaacaagacgtttgttcgatgaaaccaacttttcttcgcataatcaagcacttgggtcgaaaaatttagttcccatcggttctgtttttggtagagtgcttagtgacattaccaatgtcgatcttaccaaaagaagtcaaactcctcatactcccgtgtccttaccgctatacccggcaaataataatgggagttcctcacccattacgcctattaattcgttgaattcaactcttacaggtagtattctcatatatcatcatcatcgtttctttcgactttatattgaaccatatatttttgcacttcaaaggagacagagtaatttataataccccacacacaagagaaaatagagtcaatccatctaatagctcagaagttattaatccaacttttacaagagctgccgcaaaaactagaaaatcaggttagtaagttatatactattcgatatacaacattatcatataaatttaatcataaaaatagtattttatttatatgttattttttatttttatattctttaatgcaggaaatttatcgaaaacaaaaagtataccatcatcacttcgtaagaagaccaatgtcaaaacaaccaacaatggtgatattgttaacaaagcacctattagaagattgtctgctattaaaagaatggccagaaaaatatcaaacccatcaggttataattttttaatatttaatattagatacaatacatattagttaatattattatttttcttaatttggttgttgttttctcaggaggatcaccagacttcttaactcctaatcaaactaccccaaacgtaaacacattgtttggggtagattactctggaaatgtcttatcggatataacaaatatatctggagaatccatcgtctctaccattcgattaatgtccaataagaaggaaaaagtatcaaatgatcaaggttcgatttatatttaaaagtagctatttatgttatgttttagtatgtttgtctaatgtccaatagtcaaacagaaattatattgtttaataaatttttttgttgattgttaggagtcctccattcaactaaattacaatcaaaagagaatgttgcaagtattgtacgtgacaacatgctcaatgacgaagaaattgatcattctgaagcaatatattctgatagtggtataatgttaatcatacttttagaattaccacctttatataaaatgtataaaattgttttatttgtgctactttcatgttttcttctgtcttcagataggtcagaggaattcgatgatcatatatttgactgtagtagtcaagaagagtatgagtcagacaaagtttcaccgagcgatcaagttattggaccaaataatatgattgacatgaaagatttgttaagaaggaatttaaacaaggagtttactgcagcaacttcgaacaaagagcatggcagttcatccactagcggtaataattttaaaacatatattatatatattagaaacaatgaaaaacaacatgtattgatgtttgttcgattcagattatcatgacgaaggtgaagcgaatcacacatgtgtgcattgtggtgcaattttctggtacggtgaaagactaaatagaagaaggaagagtgctaattcggtttatacaggatgttgtatgcaaggtcagattgttctacctatgctaaaagaatcacctaaatatatgtggtggttgtttacaagcgaccatccagatgctaaaaattttagagcaaatgtcataccatacaacatgttgttttcattcacatctcttggtggcaaggtggatcgatcagttaaaaagggacgtggtccatctatgtttgctctacaaggagaaaactatcacttgatacgcgcgttgaaaccaaaacctggcgattatgcaaaatttcaacagctttatatgatggacactgataatgaagttgacaatctaattgaagttatgaggtaactgatagttttataaaagaactttatgaaaaaaaaatattttagaagcagctaatacattgtatttattaaatgtcttttgtaattatacaaaattgcagcaaaggtaataatagtgggatggaaggtggaaaacaaaagttcaagaaagaaacagtttcagctttgctaaagatgttggacaagataaaccctcatgttgcaaattttaggattgcccgtgatagattcaacatagtgaaagaagaggcaaattttcatatgaggattatatctaaccgcgagacagatgacagagtgtataatcttccatctgtagctgaagttgttgcattgatacctggagatttcgacgacaatctagataaaagagatatagttctacagatgaagtctggaaagttaaggagaatacatgaatgtcacgtttcatatctagctctccagtatccattgttatttccaaaaggagaggatgggtataagcttggaataaaaaaaactcctaccaaaacttcaaaaggaaagaagaagcaggaagatgttagtatgaggcagtggtttgactaccgtttacaagagagaaaagatgagaagcacatcctcctttgctcaaaacgtttacttcaacaattcatagttgacgcttttacaatgatagagtctaatcggctaagatttattaaaaaaaatcagacgaagctgcgcagtaccaacaagcaggcagttcaagatgcttctgatgctgggggtaatgatctttctaataaaggaaaaagtgttattattcctccatctttcagcggtggtccagcttatatgcagcagaactacttagatgcaatgggtacctgtaaacatttcggctttcccgacctatttataaccttcacatgtaatcctaagtggccagagatcacaagatttgtaaaagagcggaagttgaatgctgaggacaggccggatatcatttgtaggatttataaaatgaaactcgacaacttgatggatgatataacaaagaatcatatctttggcaaaaccaaatcaggtactacattatttcatatttttatacatatatttcatgaattttaacttacaagtgacattaactcataattattatgttgaaacagttatgtatacagtagaatttcaaaaaagaggtcttccacatgctcacataattgtttggatggatcctagatacaagtttcctacggctgatcatgttgacaagattatttttgccgaaattccagataaagaaaaagatccagagctatatcaagctgtctcagaatgtatgattcatggaccatgccgattggttaatcctaattcgccatgcatggaaaatggtaaatgttccaagtattatccaaagaaccatgttgaggacacgtctcttgacaatgaaggttatccaaatataggcgcaaagatactggtcgtttcatcgagaagaataagtatccatgtgacaaccagtatgttgttccatataacgatgtcctattacggaaatacagggctcacatcaatgtagagtggtttaaccaatccgtctctcttaaatacttattcaagtatgttaacaagggacctgatcgtgtaaccgtctctatagagcctcatcgaaaagaagttgtctccgagcaaaacaatgtaggagaaacaaataatgatatcaaaaccgtcgagggtgttgttcataaaacatacagagaattgtaacacccgtgaaccggaaaatcggttagggtttgtttttaaatcatccggtttaattggttgggttaattggaaatcctaaagtgtgcctataaaagaaggaaactcgaaattagggctttagttagcaacttttcgttttataaaggagaaaaagagagaaaaggaaaaggagcagaatcgttagggtttgggaaaaatcagtttggtcatatcaaatcatggtaaaaggtaacgaaatttagtagaattattcccaagtcgtttatcgttattctccagtttacagaactggatttggattaaaacaatttgagttattcgcagtttagtgagacacgttttctcagacgcgaattaggaccagcggagattgaaattgcgatcgtggtatcggttgttttccgatcgggacaatattttgtgggaagcttcgtgacgtctagggctaacgtttcactggagcgatttaatagttaacggttagtttgtattttaggttttcgtctttgaggttgattgtttctgtttttcatgtacagtttgcttcaaggttgcttttggttgtgacttgttgtaggacgtttctggactctttcagacgctaggagagtctctcccgggtttaattgttattagaattaatttgttaaggtgagtgtgtgaccatgagcttatctgagcgattgggttgtgtaatttgttttgtgtgatgataagtaggtgcggtgaatgtgttttgggtgaattgttcaatgactgatttatttgtgttgtatttgtgattatacccttttatttgcttgtgtgtatagctcgtagatgggaggatcgcctcactaagtatttatgttaatacttacgcatctcattgtgttgttgatgaaggtaaagataaagtgtgatcgtggaatcatggcaatgaagagaggatgatctaggaactcgtttgttttattttttgtgtttttggttattggaacccggttaggattgttagttattcttggttttgttggttgaattatttatttattcataaaatagtatttttaacttgcggtttaattgttattttattggttggtttaattagatatttatgggaatatttaattatattttttttaaaaatgggtcgggttgtttcaatttggtatcagagggatcacggttctaggatgtgtagaaaacttaattgatgaattattttcctgatgattgatgtgggatgagctagggtgttagcatattgaggattgattatggagtgtttagtcaattgtgtgttgtcggagtcctagcatcatcttctccgagccttaaatgagattccattgtaagttgtttgtgatatatttgttgttctagtttcttagccttttgttcttgagcagcgcagatggttagtggagctggagttcgtggtcgtggtcgtggtcgtggttgtggtcgtggtcgtggtcgtggtcgtggttgtggtcgtggtcgtggtcgtggtagaggacgagtcctcgagggtactggcgagagtgacgaccacagtgccacggttgagcagagtgtggattcgtagcctgagtttgtggagctcggggttggggacggtctttgtgccgatatagctggtgcagccggagtgggggctggtggagctggtgtcggtgccggtgtgcatgccggttgtgttgagggcccaggagtgatgggtgccgcagccagaggagcccaggttccagaggttagtttggcgggcctgctgaggcagttgttggagcggttaccaggtgtggtaccagtgcagactccagttgcgccacgagtggcggaggtgcagcagagggctgcggttgctgaggaggttccatcttatttgaggattcggttatgtttaaaagagttgcaaaaaatattgaaacggcatggagcagatctttggaggtataagatgttgccgcagcttgaacctggcgatgaaccttcctttaatcagttgatactcgatgagcgctactagaatcgtgaaacattgaaaaaaaaacatgatgattggttaaagatgctatctagggaacaaaagaaggtatatgatgaaattatggatgctgtccttaatgacaaaggaggtgtttttttcttatatggttttggaggagcagggaaaacctttttgtggaaggttctatccacaacgataagatgtaaaggagatatttgtttaaacgttgcgtcaagtggcattgcatctctgttattagaaggtggccgaactgcacattctaggtttggtattcctctaactcctcatgagacctcaacatgcaacatggagcgtggtagtgatcttgctcaattagtaacagcagctaagttgattatttgggatgaagctcctctgatgagtaagtactgttttgagtcattagataaaagtttaaaagatattctatcgactccagaagacatgccgtttggtggaaaagtaattcttttcggaggtgattttaggcaaatctttcctgtcatccctgcaaccggtagggaactgatcttcaaatcgtcactcaattcgtcttatctttggcagcattgcaaagttttgaagttgaccaagaacatgaggcttctccaagatatagacataaatgaggcacgtgagattgaggatttttcgaaatggatccttgcagtcagcgaggggaaactaaatgagcctaacgacggagtaactaagatacaaataccagatgatattcttatacttgaagaagacgaccctatagaatcgatcattaaagcagtctatggtacatcctttgctgaagagagagatccaaagtttttccaagacagagctattttgtgtccaaccaatgatgatgttaactcaattaacgatcatatgctttccaaactaacatgttagtgaattaactttgaatattactcaaaattatacatataatagagtagatgacaatgaactactactctttgcaggtgaagaaaagatttatcgaagttctgattctattgatccttctgacacacgtgcagataaaaaccccgtatatacgcctgattttctcaataaaatcaagatttctggattacctaaccatttacttcagttaaaagttggttgcccagttatgttgttgcgtaatcttgatcttggttgttaacattaggtgggtcttgtatatcaactggtctgttctgttgatccatagcaactggtctttgttgatcacagtctgcttttggtttttttgcttgtaactcacgagctattctttctattttgtctttgaaaggtagtatgtgtgcagaacctttggaccgagtttgcatgcacaaatattagtacctgtaccacaaaaacaaacagacgaaaagatgagttagtaacttgagtaatgtaaaagaacttgatcttaactttttctgatatcttgaatgtaacaatgcaacaatgaattggcaacggcgccaaattgataactaggtttttacgcctagttatatgctgaagtgtggtttagttcaattcccttaaacactaacatgtcgatgcagttatagggggtgtcaattgtggatgtcggattcacacactcaaatatttatttgtatagtgagacggattattcttgaggacaaaaataagtgtaaagaactattgattatggagaaagctatgagttttgtaagaaaatatgtatactaagtttgcaaacaaatgcgtgtgtctcttatggcccttggccctattatttatacctaagaattacaattaattctcatttacacacaattattctatcttaaatgtatccgtttcgatcttcgaattcattgttcaaacgttcgaatttgaattgacttcgagcttcctgggctttccccttccagcccaaaggccctttaatctaaccacctttaatcccgacttctcattcacctcgcggtatacggactgacctttcctcttcccaaggcactcgttcggtacttggccgctcttgaaattgctctacctcaattaacctccaaccttctccaatctattctagggattatcaccgtcgcggtggtggctgggtacataattggagttcccgaattgaacgagcttcttagcgtaagaagttcgtcgaagaaagttggttacttctcggcatacctaaatgccaacagaaacctcatttcccatctcccgaacaaaaacgagaactcgcaccatccttagttcttaataaagaaaaccattgcttcaattgagagcctttccgaagtgcttccatcaaaatggtccacgaaacctggtagaaattagggcagaaacatatttgtcttctgttcgtttacacgttcttttcctaacccgaatttgtttttgtttttgtgcagctttcattgctgcgactcttccgactgaagaataaatcgagttcttcaaagtggtcatcgaaggtgaaaccctttggaatttgtttaccctcgaccgattttttgaagctatatggaatctcaaaatgagtcctcctggacaactccatcatcttccaccgcttcctcccaaaccacacgggacttcagcccgtgatggactgagcagcaagccaatcgctgacttgatttgcaaaaagagagagagaccagctcgcaacagctcttctccttggagggaaaagtcaagggctcgaactgatcgctctcctcgatcatctcctccatcttgatcgatgggttctcctcctcttcctgtatcacatctccttctcttcgacctagtggtgagaagactgatcaaagtgctactcctcgacaagaagatgctgagccccgagatactcatccctagtcgaaggtcgttctcgttcctcaaacaaaatcgcttataggttcaaacgatggttttatttccctcgctttcggtataattcgaacttttagtaacacatctttcactccctattagcgatggagaaagagggcaacgtctttcggtgcttcaaaacctggaaagacacgatcctgcccaccttcgacaaatggcgacctacaattcgcgagcgatttttactccatgctcatcattcatctcgggttagtctcgttttcgcctattccgatatcgcttatttatacgcatgctaatttacttttttggatataaaactcttgcttaggcgaacaacgagcttaacgacatgatcgagcactatgaaggattactgctcagtatagaacaggatattgatgcttggaaaggcaagttttcttccctcgaggccgatctccgctcctcctctgactttaaacagaaactagaggatcgagtcgaccatctatcttctaagctcatgagatcgaatggcgagttgcatgatcagtaccaaagatacgacaagctctaggatgaactctcgactgctcgagacaggctctctgaatctaaatcggccacttatgatttgaacaatcagttcaccgaacttaaggctaagtacaaagcaattgctaagctttgagatgctgaattagccaagtctacgtcaaaagccagaagagaggtgaaaggtcgcgggatggaattgattcaaggggctatcctcttcattcaaactgagaaggccagatcggagctggagtcagacattaaggagcacgaaagtaacctgcttctgttggaccaaacccttgaggaagatttctctgaggaacaagaaaggtccaaactggaggctgttttagctgagaaaagaggccaccttgcttctcttcccaccttgtcctttaaccctcaacacttcgaggatttttacatcgaatcactgcctttgagtgaatcaggcttagattgggctggtaaacttttacatctgaatccttataatctatagttgttgtatttgtgttttttgctgacttgaaacgttcgcttcaggctctagtgaactggtcgatactactgtccggtcgtgaacagtgagacagtgatcatcccggatgttgaacatgaagccggaactgagccgggaaactcttctaagctactctctgccagtgaaccaaccaaaactgagtcagctgttgttgaaccaaccgaagccgatccggctatcgttgaccccgagaagattacggattcctagtggttgtatctactttaattgggggctttcccaaacacttccaaaactagaaattaaatttggataaatatgttgctgcctaaggaggctttatttttgaacaagtatttgcctgaggaggcttttaaaccttttaaaactatgattttgcaatagtccgtctttatatatcttttggccatgtggctaagtttcgagatttttaggttgatcatacctttctcttaaaacgcgagaaccgagctcggttttgaacgcgaattccccaactcgggtttaatcaattcagcttatttactaggcttgggccttaactgttttctttatatttaatgggctttttgtctttaatgcgacggttgccatctcctttctcgagaaacaagaaaaagcttcacgcctttgaggtaataattgctttttcttgattcccaaaaatggtttaaaccattcggacacgccacagttattaaacttgtggttccaaggaaaaaccctaaccctctataaatagaggtcccatctgccaccaaattctccaagtatgatttcagaaatttacttgataaacaatacacaaatggagaacgaagcagcctccactgtttctcttcttcaccccggcagccctctgttcctctccggcgacggtcaccgtgatatcaagggagcttcacacccttaactctcttcccggggattggatcaaactcggaatctccgagtttgctcgcataccaaactgtatgatgcctattcttgacctcgccggcgaaggagtccaagtgttttgcaagacaaaaatagtttcttacttcgaagggcacgcatgttgggacttcgtcttctttacttactgctttgaataaacgtagttttgtttcttgtttttgtatgttcgcacatccgaacttctttgccttgttcgttcatacagtcgaactccctttttcaaatgaataaaacaaatttattagtagttgaactcgtttccgagctgcctacatacccatttcgggataaagccacaccgtagttcgtgtacataacaaaaaacgcatgttacttaaacataaaacttctttaaattcaccatattccaaggacgtttgactggcctgtcttctagatcttttaagccaaaaacaccattccgaaccacttcggtaacgatgtaaggtccttcccaatttatgccgagtttgcctgctccttcttctttcttattgtcaaaaacacgctttagaacataatctcccatgaagaaaggtctactattgatcttggaattgtaatatcgagctgctgcctgttggtaattctgaattcggattaaagcttgatctcgcctctcgttgatggtatctaacgaatcgtcgagcattgctgaattttcatcttcatttaaaggagcctccgttcggcgtagtccaggcacgttgagtttggctggaacgactgcctccatcccgtataccaatgagaatggggtttctccggtagaacgtctagaagttgtgcgatacgcccataaaacaggttgaagctcgtcgtaccatcctcctttcaaatgatttagacgctttttaagattgaagctt

SEQ ID NO: 204 - DNA, 109974 bp, Arabidopsis thaliana
gaattctacagataatctagcaaagggggcaatctactaaaccatatgaatccctaatgagataccctattcctaacaagcagactactaagacatattgaatgaaacaaacaacataattgagatagaaagcataaacacagcaatagagataagagttagaaaagatttcttcacggtatttaaaactggaatgagtgtctcaagaacaatggatgaatagcttttgtctctcagtcacagggttttgcaaaagcttgataaaagactcgataaaagaaacttaggtctaaaaacaatatataaaaccctaaaaacgtccagagactaataatgcaaatagggaagtctgctggggcaaatttcctcttctgtaaacttgaaagcgtcgtggacttctgctgggccgaaactggtgtcgatcgacacaaagagtgtgtcgatcgacactcctcgctgattcctgaaccaaaatcgtccttagcttttgctctaaaatgtctccttatctctattgttatcccattgcatagaatacctgaaaagacactaaaaagactcgagaaataacataaaggcttaaaatcctatacctaaaacatagataaaatcagtgaaaatcgggttatatcaactcccccagacttagcttttgcttgccctcaagcataacacaaaagccgaacccttggaagaggttttgaaaacaaaggaactgccaacattctctagcctattgccatgatcattcaaactaagtccatatgcctaataagtctaatcaaatcctaaccaacatgtacttctctacaagcttacacaacattctagattccatacctaagttccagaactatatccaccaggctttcatagctgggtctcatcaaacaagctgacattcaagaccattctttatatatttgtttttctttttcgatgttctttctctcccccagacttattatttttagagagtaaacaaaggggaactcgcatactggatcgacaccctcgacatttttccaacctttataattgatcattccaattaaggtataataatgaggtcataggaaacattcctacccatatacactatttgaaagtcatctccatctctcattatatttttctttttataaggggagaggaacatattctttttatcacattggtctcaatatcaggtatcaacaaggagtcaagatttatgaatactaactacttgaagaggtaaaaggaagagcagtgagattagctccagccttagtggctgagttggaaactaggatatccttaagtctgttggtttgccatctagattttccaatagtcagattgactcgaacaagacaaatatagatcatgattcctaactaaactaaacaaaacgttttttttaaaaaaatttagaaaaggaaataaaagaaataaccaaatgaactgcaaaatgaaaaatgataagaaacaaaaataaaagccatattagtatgaaccccccccccccagacttaaacgacattgtccccagtggcattcaaatccagagaaagaggggaaaatgaaacaaaaataaaagaaaataaaagaaagtgaaaagaaaaatcaaaccagtgggttgcctcccactaagcgctcgttttgagtcaatagcttgacttggtggagttcaagatgtgggtggagtggtggaggattgatgctgcctcctcgccttccaaggcggtgtgtaaacggatctggctggggcagctgcaggtttcgatcgacaatcagggatgtgtcgatcgacactcatctcgtcacctgcaagaacaacaggagaaacaagctttcgaggaatctaggcttgttatcttgtgaagcaatcttcgaattatctaaagaattaatcaaaggtaaagcaggagaagagagagaagagaatttatcacataggtccttaagtggtgttggttgaagagagtgtgcagaatcctctgtctgtgaaacccgagggtatcgatcgacagggggtagtagtatcgatcgacaccgttgctctgcaactctcattggcgagctgagcgggttggagcattttgtgtggctctgtggtgggatgatcagtctgaggaggtgtatctatgcttgaagcaatgcaactgataggcttagtaagctctgaaccatccatgccaaactccatctccaaatcacaaaccttgagagagattctctctttcttcacatcaaacctagcaccagttgtagctaggaatgctcttccaaggataagaggatccttgggttccttctcatagtccaggaccacgaaatcagcagggataacagagttaccaaccttaacatgaacatcttcaaggattccttcagggattcgcttggaacgatccgcgaagagaagagtgatgcgagtaggtctgtagtgagtcatgcctagtctctcagcaaacagacttaggcatgaggttgatgatggatcccatatcacacaaaaagcggctaaacctgcttctggagatagagcaattaagaacaaagctacatggatctacaagctactcagtggtctgaccaggagtaatggtgcggatgtactcggctatgtctactctctatgccttctccttcttggccttaggcagcatgattgcactgatgtccctggtaagcagcttagcttcatctaagctaattccattgtcaacaagtcgcttgacatacctgttgagtgaggaagcagatgtctcagaagcatccttaggaagagtatggaagatcttctccattatggctttgcacttggcagcatgaagctcctgcttagaacgacgcctcttcggatacgcgacaggaggagtgtagacaggctcgggctacataggtatttgcaccttacagggtgcagtccggatccaatgtcgatcgacacaagaggggtatcgatcgacaccgtcgtattgagtcgtctctgataagagcgtcccatatggtgtcgatcgacacaggagggtgtcgatcgacaccctctctgcaactgcgagctccaactcgtctttagagtccaattcctcccacacatcatctccttctctaatcatgatggcattgcagctcttccttgggttagcatcaggattaccaggaagaaaaccctattgtctcttgatagattgtgcagttcgagctacctgtacatctagcttcttcaagtgagagctcagattgtcgatcttcccattaagatctgtgtagacagcatcaaacttgccattaaactccacaacaagctttgtttggctctctagaatttgctcaagcatcgattccattcttgtctctgctgagggtggaggggaggggggcttggtaagctgaattaccataggtcctgtgaaagcttctttgaggaaaggtcttctggaaagcaggatttggagtgtagttggaggaaccctggttccctgtaaacctgttgccactgaagttgccctgtgtttgcccaaacttcctgtatccctgaccatttatgtagaagactccttcctctaacttaggctcaggctcaatagtctcttcctcagctgcaaagtagacatgcttcttccctgtgagcaagttatgaactgaatccagcttagcattcacctctactatctgatttcttgaaatagctgataagtatgtattttgcatgttttgagcatccctttgtcatcattttagcaccatatcattactgttttataccatttctcatcatttgtcatcactttgcatgtttaggataggtttgcatgcatgttgcatatttgtgttgatttgaggtgatttggagctgttgacgagctaattggaagaagcggacctgatcatgtcaaaccactcgaccccgaggtcgagtagaagcttcaagacctcaagagaccactcgaccccctggtcgagtagaggacttctcgatttcatcatatcactcgaccctgaggtcgagtgtcatcatctccatcacctgaccaccactcgatcacctcacttgaccccaaggtcgagtgtcttcatctccatcaccagatcaccaccgcgatcacacctctctaccgggaagtcgagtatcaccatcaccaccactcgactacatactcgatggcaagcttcagagtcttcttcattccgcactcaaccagacattcaagcataagaaagaaaagaagactccagctattcactcgacctcccactcgaccacctaggtcgagtacagttcttaatccgtcccaatactgcgtcgttttaagtattagggtttcggaatattttgctataagtagcatgtaccctacattttcgagaacaagttttttttatctagttttattccgcagacactgtgttctagaccttttgtaatccggatttctctttatctattcagtatttagcattcagtatttgttcttgatttcgtttactgttgttcatcctgttatcgttttgctattacactgttgttatcgtgttttcatcctgttcaacgtttatgttctctacaatgatgtctgagtagtgaataggtttctgaggatgggttagagtagtgtagaattctcagtatgctaggtggttaagtattgattgatagatcccttctggattagttgttcttaatgcctattgctttctgatcaactggaatttgagcccagatatttctgcgcccaaaaggtgttcgatgaaatgtctgaaccattaattctagagattcgtggccctgtaccaaggtattggttgcaaggagcgttttggctttaacttgttgattcgtaatgcctgttaggttagctctcgtcaatggtgattgagtctgggactaggttaacttgagggtctctgttgcggtggcacttagatttggttaatgaacttgttgtttagggataatttattgagcatgtcagtcacctgtaaactgaggaaacgaaactactcaattaccccatcctcgagaattctttatccgattgattttattgtttactccactgctgtttactgtatcctgtcatctgctgcttagtttctacaattcttttttgttactcgaccttatactcgaccacccagttgtctggcaacagactgtgcagtcaattatctgtgtcatactgtctgtctgttactcgacctatcactagacctcacccagtgctctgcaaagagctgtgttggtcaagtgttttattgtttctgcttgaatttctggtttctgcatgttcacttagaactgctagaacacactaaaacctgttattgcttggcttgacttagtgacttctaatcacatcttgattgttagcatcacaccaatttggattgacaacctaaaatactacaacgacatgattggtgttttaggataattgatcttaaaaacctattatcaatttggcgccgttgccaattgggtgtttgtttgttacatttgagatttcagacttgcttagatagagttctttttcaatttttatttcagttactgactgtgtgtttttcttgttgtcttctcggttgaggtacacctctgctatattcaaactcgatcaacaggcaaccagaacctccttttcaacgataacatcagccgcctagctcgtgaactcagagaaaggagaaacacagtcaaccttatacctcaacaaccactcgaaatggctgacgaacaaaatcaacagaatggccctgcaaacattggtgctggagatgcaccacgggaccaccatcagaggaaaggaattgcacctcctgctatccagaacaacaacttcgagattaagagtggtctcatcttgatgattgaggggaataaattccatggtctgccaatggaggatccactcgaccacatggatgaatttgataggctcttcaacctaacaaaaatcaatggtgtcagtgaagacggattcaagctccgtttgtttccattctccttgggcgacaaagcacacatctgggaaaagaatctgccccgtgactcagtcaccacctgggatgattgcaaaaaggcttttttagcaaagttcttctccaatgccagaactgcaggactcagaaatgagatttctggctttttacaaaagactggtgaaagcttctgtgaagcatgtgagcgtttcaagggttacaccaaccaatgccctcatcgtggcttcaagaaagcttctctgctcagcactctatacagaggagttctaccacggatcagaatgcttctggataccgccaacaatgggaatttctagaacaaagatgttgaagaaggctgggaattggttgagaaccttgctcaatcagatggtaattacaacgaggactacgacagaactatcagaggcacaactgactctgataacaaatacaagaaggagatcaaagcgctgaatgacaagctggacaggattcttcttagccagtagaagcatgtgcacttccttgttgatgacgagcagtatcaagtccaagatgaggagggtaaccagttagaagaagttagctacatcaacaatcaaggtggctacaaagggtacaacaacttcaagatgaacaaccctaacctctcttaccctagcaccaacgttgctaatcctcaggatcaagtgtatcctccacaacaacaacaaggtcagaacaaaccttttgttccctacaatcaagattttgttccccagcagcaatttgaagggaactaccagcagcaaccaccacctgggtttgcacctcggcaaaaccaaggtcctgttgtacctgatgctgaaatgaaacagatggtacaacagctgctacagggacaagcatctagctccacggaaattgctaagaagttatctgaattgcattagaagatgaactgcagctacaatgacctgaatgccaaagtggaggcgttgaataccaaagtcagatacttagaaggacaatccgcatctacctctcctcccaaagttatgggacttccagggaagtcaattcaaaatccccaggagtatgctaatgttcatgctatcaacataaggagtggaagtgagttattcactaaagagagacccaagtcagtcactgaggacagtgcataccaagatggggaggatttcagtctcaataaagatcaagctgaccagccactcgaccagtcacttgagcagccactcgagcaaccactcgaccagccactcgaccagtcactcgagcagccactcgaccagtcactcgagctgccactcgaccactttactcaaccgacattcccagcaacatcaccaactgctctgaaaccagttgttgtcaaaaacaaagaaaaagtcttcattcctcatccttacaagcccccacttccatttcctggccgacacaagaaagagttagaaaataagtacagagctattattgcaaagaacataaaacaagttgaagccaggatacctcttgttgatgctctcacgcgtatcccggattccgaaaaattctttaaagacttgatcatggagagaattcaagaggttcagaaaacaacagttatgagccatgagtgtagtgccatcatacatgagaaagatgaaccagagaagctaggagaccctggttcattcactctaccatgctccctaggttcattgacattcaataaatgcctttgtgacctaggaacatcagtaagtctaatgccactctcagtagctaagaggttaggttttaacaaatataaatattgcaatatctccttgattttggctgatgggtcggttagacaacctcatgggttattagaagatttgcttatcaagattggaaatgtggaggtgcctacagacttcatagtgttgaacatggatgaagaaccaaaagatcccttgatcttaggaaggccctttttggctacagctggagcaatcatagatgttaagcaaggaaagattgatcttaatatgggaaaggattttaaaatgaagtttgacatcaatgatgctatgaagaagccgacaatagaaggacagaccttcttagttgaggaaaaggatctgctagttgatgaacttctagtggaacttaaagaagcaaataactcaaaaactgttttcaccaagagtggtaaagctgggtatctccctagtgaaactttgagttctgagaagtcattagactcacacaaggcaacagttggctcaaaggtttacaagggcttgatggggtctgacacaaaggttatgaaagctaatgaagtaagttcaacacatgctcgaccaactgattccaccaacaactcgaagaagcctccaacttgccatgaaagctcatgctcgaccaaacaactcatggcaagcactcatacgtcagatgattggttagaactcaaggagagatctaaatggcaagacaaagccatacaagagctaacacatattgtgaaagagctgaaggatcaaatcaaggagctcaatggaaaagccaaccaagtaccactcaacatcaaggatgcccctcacgatggagccactattcttgtcagcaaagaaggatgtgaattcacatcggaatggtgtagaggagaagactatcttgataaaaatgaagcttactgtgaggacatagcctttgagtacccaattgcagacctgtcaagaaaccctaatgagtatgatgatcactctactcaagaaggagaggagaccacatttcctctctgcaacccaccctaagcctaatgagtatgagaagtcaagcttagagacttaaaacaagctcacttgggaggaaatcccatgtctatctttgtacatatctttatttttccttgttgattttgatgcatttggttagtgtattcaggagataagtataaagagccgagtgaaatggattatgactctacgagtaaagcagtatactcgaccataaagcaatgaaaaatactagaccatgttttagcttatccacgccaggaggtcactcgaccgcggtgctggccgcagcagaagaagggaggtctagtatactcagggcggtgctggccgccatagagctgatgaggtcgagtacccacctgctggagctgatacagaacagggcggctcatctatggcctgggatcaatcacaggcagccattgacgaccaactccgttcattcttcgactgaggtaagcgcctcacttcaccattgtattatatcatttgttgtgatttgttctttattttgtttctgtgattagatttgtcctgagtactctcttccaagtttattcacacagtggactgtgtgatttaagtttgggggagggctcaggaagtgtatgttgcattgtgtatatttttgagtctgcattcatctataaggcatagaaaaaccaaaaaaaaaaaaaattgaaaaatttcagaaaatgatttcacaaaaaaagagtgttcatatagttgcattacatttaggatcgagtctagagtgtttcatttaggattgttgcatatgcataggggataatgatgagatagccttgtaagcattttggttcaccggataaactcagttccttcattgctagttgtttgttgcgtagtcaatgaatttgaaataaaactgaaccatgcctagattgctctactcgaccacactgtcatgatctgataccattccctatcaatttgaacctgaatctgatctttaattatcatgtctgcatcaaatttgaactcatggataccctaaaatacttggattttcttattcattttgatcactcttgttaatccaagtagctgactcttcttatgagagcagttaacccaaacccaaacttagactttctttcaagccatgtatcacttgtgagtgtttgtgaggtcgtattccgattaagcttggtagaaagtgttaggttcgtaacgatagagatagtgtctcatgtagttctagttcacatttttcagactagatatgactaggtgggcgcttatactttgggttgggatgtgtttaaaagaagagaaggggttgattcattgatgataaaaggtaaaagactctaggtgaagtaagctaaagaagcagaaaaagtctagtaaaggttttgggatttgtaaagaaaagaaagagttcttgttagctattgaagatgggcaaaagccctcggttttaaaatgttaaaaataggaaccttagttgttaaagaaatccaaatccgctagatgtatcaaagtattgagaaagcttctcctagagttaaaagaaaagaaaagaatgattagaaaaagggcttaaaggattcatgaatgcaaagggtagagttagggtcttatattgggattaccattagaccttcatttgatatactctgggtagatgggatcttatctctgtatgcatagcttgggacttacctttagcattctactaaagcttaatcaatttttgagagatcccctgttactgaagcctattctgtaagggaccatctttgtctcttgaccttttgccttagccaaatgagttcattgatgatgcattgtttgaatcacgttcgagaactaatgaatgttaaacggattggtagattttaaaacatgtgtaggtcgagcatatgagtcggattgattgataataaggcatggctaatgtttttgagtagaattcgaccatatcgaagcttagaactatcaacttggacattgatttcatcttgtttatatggtgctttggttctgagtccccgctttcaaacatcgcctctagcttgttcttgattgtttgcttaagggcaagcaaagactaagtttgggggagttgataagtgtgtattttgcatgttttgagcatccatttgtcatcactttagcaccatatcatcactgttttataccatttctcatcattttgcatgtttaggataggtttgcatgcatgttgcatatttgtattgatttcaggtgagttggagctgttaacgagctaactggaagaagcggacctaatcatgtcaaaccactcgaccccgaggttgagtagaagcttcaagacctcaagagaccactcgaccccctggtcgagtagaggacttctcgatttcatcatatcactctacctcgaggtcgagtgtcttcatctccatcacctgaccaccactcgatcacctcactcgaccccaaggtcgagtgtcttcatctccgtcaccagatcaccactcgatcacaccactctacctggaactcgagtatcaccatcaccaccactcgactacatacttgatggcaagcttcagagtcttcttcattccgcactcaacccgacactcgagcataaggaagaaaagaagactccatctattcactcgacctcccactcgaccacctgggtcgagtacagttcttaatccgtcccaatactgcgtcgttttaagtattagggtttcggaatattttgctataagtgttggtgtcggatcccgcaccatgggctcgggaccggccaaagattgctacacaagtatgggaggcccataagatgaaaagcccgtaagattcttcaaagtaagagtatgggtgagatgtcgattggcgaagtgggtgcaacatcgaagttaggactactcgaattgaagaagacaaatgggccgaagggtgaagtccaggaggcccggagtggtttcaaattcgaacgttgaataattaattcaaagactagaaacggatacatttaaggtagaataattgtgtgtaaatgaggattaaatgtattctttgggtataaattatgggtcaaagactatgtaaagacacacacatttttgtgcaaattagctatacacattttctctacaaaactcacagttttctctataatcatctatctattttctagtatatttgtcctcaagaataatccttctcactaaataaataaatacttgagtatgtgaatctaacatccacattttggcgccgtctgtggggacggaggattcttgagtcgtcagatttcttctgtgtattacataaccgaagtaagccgcaatgtatggagaggatgctaccaacgcttcgatagccgaaaccctcaagaccatgcaacaaactatgggatatggcgcagaagttttcaaacgtggaaaaaaccgtcgaaacactgcaaacaacccaggtatcgcttagccaaaatgttagtaccattccgtctcatgtccgttctttaaatgcgggaaattctactagagttcgaaggactatcttcggatccccaaactcccttccacgaaatgcaacaagcgatcaaacgaccctggatggtacaaacgcgaatagtcaaccggaatatggagaaacgcatcctaaagatgataaccagttcgatgatcagcacgagcaagaaaactttgatcagctcgaaaccatgagagaagtaagtcgggaactcaaagaaatgaggtcgaaattccatcaagctacaagttcggagccagacatcaaccaagttatcgaggaggctaggcgaacaccgttcacccgcgaattgcgagtttgagaatcagagattatcaaaaactcaacttagaaccatataatggtttggaagacccgaaaggctatctcgcagcttttctaatagccgctgggcgagttgatctaaacgaagccgatgaagacgcagggtattgcaagcttttctctaaaaatctatgtgggctagccctgatgtggttcactcagttggaaccaggatcgattagaaatttcaacgaactatcggcagtatttttaaaacaatactcaattctgatggataagagcatttcgataccgacctctggaatctatctcaagggccgaatgagacacttcgggcttttatcaccaaatttaaaaacgtgctttcaaagctcccaaggatctcacaacagtcggctctatcggctttgcaaaaaggactatgtcatgattcgaggtttaaggaagatctaatacttcataagcctgatactattcaggatgcattgtttcgagcaaacaattggatggaagtcgaagatgaaaaagaaattttcgcaaaaagaaataagcaagcaaaactagcggtcacttttccaccaaagaagttcgaacctcgggaaaatcagggaccaaggaagtttggttcacaaccattcaataacaacgtcggaaagcagtttcaggggaaaggaaggtcaaatacctgggtccgagatgaaacctcgtactgcgatatacatagagtcacaagacatctgaccaaagactgcagtatccttaaaaggcatatcgcagaattatgggccagtggagacatttcaaaattcaacatggagaactttgtcaagcaatatcatgaatcaagggataactcagaggctcaaaactctaaaagaccaagaccggctggcaaagaggaaccaagaactttaaatggtaaaataaacgtaattcttggaggatctaaactctgccgtgattccattagcgcaatcaagaaacatagacgcaatgttcatctgaaatcaagcttaagtgaagaagtagactttcaaggcacttcgatattattcgaggaaaaggagacacagcatctcgaaagacctcatgatgatgcacttgtaattacgttggattcgaagtatcgaggatcctcattgataccggtagttcggtcgatctaatttttcttagcactttggaaaggatggggataagcagggccgacgtggtaggaccgccatcccccttagtggcttttacaagcgaatcgctaatgtctctcggaacaatcaagctaccagttttggctggaaagatctcgaagattgtggattttgtcgtttttgataaaccagcagcctataacatcattcttggaactctatggatctaccaaatgaaagcggtcccctctacttatcaccaatgcctcaaattcccaactccgagcggagtggaaacaattcagggagatcaagaagcttcgagaacttgttatttagctagccaccgattaaaaattcaatagcaattaacgaagcccgcaaagaaaggagtagtcccgagattccctagcgggcagaaagtggatgatgtcgtggtcgaagtaattctagaagcagacaaaccggatcagaaagttcgaaacggagctaccttatctggcgaggtgaaggaagccttagttgaactgttaaaaaggaacaagaaatcatttgcttggtcggcagcagatatgcccggcatagatccaaatataatttgtcacgagttgaatgtggatccgagcttcaaaccggtaaaacaaaaaggaagaaaactcggattggagagagcaaaagcagtaaacgacgaagtggataaactcctaaagattgggtctataagggaggtgcaatatccggattggttagcaaacaccgttgtggtcaaaaagaagaatggaaagaatagtgtgcattgactttacagatctcaacaaagcttgtccaaaagatagtttcccacttccacacatagataatcttgtggaatcaaccgccggaaatgagttgttgtcctttatggatgctttatcgggatataaccaaatcatgatgaatccggaagatcaagagaaaacttcgtttatcacggataggggcatttattgttacaaagttatgccattcgggttgaagaacgcaggagcaacttatcaacggctggttaacaagatgttcaacgaacatctaggaaaaacaatggaagtctacatcgattatatgctagtcaaatcattaaaaaaggaagatcacgtgaaacatctagaagagtgttttgcgattcttaaccaatatcaaatgaagttgaatccggcgaagtgtacatttggagtcccatccggggaatttcttagctacattgtcagaaagagaggaattgaggcaaatccaaatcaaatcaacgcttttctcaacatgtcatctccaaaaaattttaaggaagtacaacggctaactggtcggattgcagcattgaatcgttttatttcgaggtcgaccgataaatctttacccttctatcaaatcctaaagggaaacaaggaatttctttgggatgagaagtgtgaagaagcgttcagacagctaaaggcgtatctgacttctccacccgtattgtccaaaccagaggtagacgaaaaactctatctatatgtctcagtttcggaccatgcggttagcggagtcttaatccgagaagaccggggagagcaaaaaccaatttactacataagtaaatctatgacggatcctgagataaggtatacgatgatggaaaaccttgcacttgcaatagtaacctcagctcggaagcttcgaccatattttcaatcccatccaatcgaagtattatcaaatcaaccacatcgaactattctccatagcccgaaccagtccggtagattggcgaaatgggcggtggaattaagtgagtatgatatagagtacaagagccgagttgccatgaaagctcaagtccttgccgattttttaacagagttaccggtactcggagggcaggagcaaccgccaaatcagacttggaagttgcatgttgatggatcgtcatcaaaaaatggatccgggttgggaatcaaattagaatctcccacttcggaaatccttgagcagtcatttcgattgttatttactgtatctaacaatgaggcagagtacgaagcattgattgctggacataggttggcacaaggagttggggccgatgagttggtcgcctactgtgactcgcaactagttgttaaccagttcaatggtgactatgaagcaaaagaatcacgaatggaggcatatcttgaggtggtcaaagacttggctaaaaactataagaagttcaaactcattcgcataccacggggagaaaacactactgcagatgcactagcagccctggcatcaacatctgatcccgaagtcaaaagaatcattccagtagagtgtatttcagaaaggagcattaaggacgaaaaggaggcattcgtcgtcacaaggtcctgagctgcagcccgagatcgcggcgaacctgttattgaattaccacctgtcaaaaggcgaaagtcaaaagagacaaccatacctaagcctactgtgcaagaagatagtggactcgaagaaaatgacgaaccaatagaagaaatcacctcggacaccacagtcgaagctagaaccgaaccgtgggttgatgaagacatactagcgccaaatgagcatcccgaaccagaagctcggatatttcacgaaatcgaccaaattccgactaaagattgggggctgattggagggagccaataaagcattacatcgttacaggcgagctcccaaaaaatagatggcaagctaggaaaaatgagaatcgttagcgcaaaattttgtctatcgaagaattcttttcgaagtggtttgaagttgaagcgtatgtaaacattaaagattcggcggtaaagactttcatttggcagaatatcatatgcaggtttggcgttccatacgagatagttactgacaacggaccacaatttatctcacacgagtttgaagcattttgctcggatttggggattaaggttagttattccactccacggtatccacaagggaacggtcaggctgaagctgcaaacaagacaattttaagcaatcttaagaaacgtctaagtcatttaaaagggggctggtatgacgaacttcagccatttttatgggcatatcgcacaactcctaggcgctcgaccggagaaaccccgttttcattggtgtacaggatggaggcagttgttccagctgagctcaatgtaccaggacttcgtcgaacataagctcctctaaatgaagaagagaattctgcgatgctccacgactcgctggataccatcaacgagaggcgagatcaggccttgatccgaattcagaattatcaacatgcggaagctcggtattacaattcaaaagtcaaaagcagacctttctttgtgggcgattatgttttgaaacgtgtgttcgataacaagaaagaggaaggagcaggcaaactcggcattaattgggaaggtccctacattgttatcgaggtggtctggaatggtgtttacaaattgaaagatttagaagacagacagtccaacgtccttggaatgtggtgaacttgaagaaattttatgtttaaaaacacacacgcattctttgtacatgaactacggtgtggcttgatctcgaaatgggtatgtaggcatctcggaaacgagttcagctattaataaaatttgttttattcatgttgaagaatagttcgattatacgtacgaataaaaataaggagttcgactatgcgaacatacaaagcaggaagcaaggataaatttattcaaagagaaaacaaagaaaagacgctgaaatcttagaaacacttcggattaggaaatccttctcatcttgcagaacactttgatcccttgactggcgagatcaagaatgggcatcatacaatccgggatgcgggcaaattcagcgattccaagtttgatccaatctccggggtgagagttgagggtgtgtaactcctttgatatcacattgactgtaatgcccctgaccttgactatacggccggacgtgcagtctatcgagtaaaatgcgagatcaagccaagaaaaggcaagatcagtttggccatttgatgtggcaagtcatgggtaaggagcattgcaatggatcaagtctacgggtaaaggaatgactctccaacagacggactaagcttagctacgatgcgactatcggtaaacctcgaaaccattaagctagcccttagacctaggatagcttaagaaaaccttagttttaggaaaccttagaaggactaggaaaccttagaaggactaggagaccataggggaatccatttgggcagtgggatatgagtatgggtcgtgaatggtcaaggtattgatcgaagaatgcggataagtgacgataacgagcttacttggttaattatggcatggaacgtgttatagacctaaggaagccttgatttatgtcatggagcatcatgagacattggagatggagtgacccctatcaatgctcttgcggtccagtgacagatcgtgggtttcgccggaatgaagaaacggacggccaggattgaactgtggctcatgtttatccgttaaggctcaagcttatccataattctggtcatccttatcctttagggtcgagcttatccattttggatgatgtttatccggaaaaaatggaggaaaccaatcggagaccgattagtgtcccggagcgtccgtggagtgacatttatcgaattttgattggtccgggccacctcctacttgttttggccgaccttttgaccgacttaagaccctataaatagtccacttcgtcccatttgttcctcagacccaaaatccactagaaaacgcctagctcgcgggagaagaccttagaagccaaacctctcggaaatccctgtgagtacttgagtcacgtgaagtatcacgtgaataggatagtgtattcgtttatttccttaatatagcttaggaggttaattaggattagttagcttaattattcgcttaaaacctgattaggatagttaattaggtttagtaatatttaattaggattagtgatgcctaattaggattagtattctctaagcatgattaggactagttaaacctagattaggggaactaaccgcgattagtggtaattaagtacgattaattgtttgattagtatagttttgcatataggatagttgcataatagtatatgagtctgttgtcattttagtagtctttaattagatgactaacattagacgaaccatgaggatcccgtccgtatgttgtgcgttgcgtgtaaccccgttccgttatggcatacgaaggctaggggctggatcgctaccgaccgggcgctacatgacgatgtagtattaaggaatgctatgtctcttgtagactttgtgtctaagagatggaggcatgtcctgggagatcatggattcttagaaggccttacctaggtttttagaagcatacttgcattagttgtccattgcatattaggaaatcgagtctgcatgcatttttctttgtccattatgtcttgcttgttgcgtgttttctttgtctttgtgttatttgcattattcgtatttattcttcttaggtcgtagtattagtatctgtcgatgctgcttagggtagaggtattagggtagttctgtctagatccggggctcattaagtaatactagattacttatgatgctactttttgtgcaggaaaccttagttaaccaaccttgtagaggccgctcgtgacttaggacaaaccaatgtagattttacggctttttgtaagatcttactaagtatattatgtatggtttttaaagaggatccgaaaactatatatgttttggtaaccatttctcgtatgatatatatataagtataagattcggatttctaaagttatatggttatactcactgatattattagtcttgtccggactaacacaactcacgtccgcagtacgggttgaaaagcattaggccacgggcgggaagctagactcttgtggttggacgactcgggcatacgaatttgttttggaaacgtgggttgaccgactgcgggcgtctaacataccgcttctatttcgttgttacaatgaccctccgcaacatttggttgattttctttcgaagtttcttcttttccgttgaacgttttttgtgttgagctgcgagagctttgataaaggccatcgcgatatcttgatctctgctcgaaaggtccttgattaatgcacctggagctcggatctgggatctaaagttgtgaagtggggagcatcggaagttgattaatgtcctcgtcgatcatcttgatcctcgaaaagtctggcatggattctgagcatcgtaggttgaaggccataactgcacaagaaaaggacaatacttttagtgaggaatgaagaaaaacctagaggggtaatttatagggaggtttcttagctttcaaagatgcgattccatttaaagccggagtgattcgcggaagcattcacgtcgccttgttcgcccagcattcaaagagtatctccaaaacgaatatttgatgaatcaaggaaagttggaaagtttccttaaataaaatgggccgaagcctagtaggtaagtccatgcgaaaataaaaagagtttaagtttcagggaacatttagggaaggggctcaggaacaggctcctttatcgccggttcggggttcgaagtggacgcctcgtttttaacattcacgtcgggttcattattcacgcgcttccaagggttgctatcctccacgtcgtcgtcacagtcctcactgtcaaacaggatcacttggaccggagcgtttacaggaccaggtacttgacctcgagcacaaaagtacatccggagcatgtgcgggatctttgccacgcagtcgaagttcctccactcccattaaaaatggtcgctctccatagcccttaccttcctttcaatatgggcaattcgggccttgagcgtttgcctcttgaggcccaaacgttgcctttcatcgcataagcggcgatgcttgtcaacgacctagaatgcgaactggttaaatacgagtaaagtttttccggaaaaaagaaggaaggaggatttaccttatccataaaatcgtacgcctcctttttgtctttcgaggggaaggggcagcaggcttgaggaaagagaacaccggcgggctcgaagccattgccggatagaaacaatggacttccgggatcaaagggacagacggtggaggctctttcgttttctattctagaggtgtttaccaagtaaatttctgagatcatattttgagagagttgtgaaagtttatgttcttatttatagtggtttagggtttactcgaaaccacaaaattaataatagtggcgtgtccgaatggatttaaccatttttgggattcgaggaaaaggcaattattgccttggaggcgtgacacttttcttggtttgcgaggaaggaaatggcagccatcgcatttaagacaagcggatcattaaataaagaaaatatatatatattaacaaaggctgaagcccagtaaataagtcgaacagactaaacccgagttggggagttcgcggattcaagtccgcatttcttagagataggtctgatcaacctacgaatctcgtgacttgacaacatggttaaacaaaaatgctatataaaaggtggagtttgccaatccatacttgaatcgagcgcaaagaaaaccctcttgggttcatagtcttaaaaaataataataaagatttaaaagcctcctcaggccaagtatttgtttagcctacttaggcaggtaaaatagtaatagtaaacttttagtctgttaacaaaaagggacaatccccattaagtggacacagccactacaggttctcaggcacctcgagttcgggttgagctgactcaggatcaactaaatcggcggcagctatctcagtctcacccggctcgccagtagtaggctgctcgctaggaaccttggaatctgaaccatcatcgtcctcgatgaccactgtctccgagttcgtggatggaggaatctctggcggggtggttaccgcctccggaattgtcgtcggcacgatggatgcttcgagctccacgggatcgctagcacctgaggcaattatctcggattaggaaaaatacaagagtaattcgctgtgtattggtttcaaaagtttaggaatgtaccagcccaatctaaacctggcatcatttaagaacggagatcgaactcaagggacgaagatttgtctttccacgtcataacctccttttccctgtctagcaacagtctctcgtagtactcaatcatgtcattgagttcgccgtttgcctgaaccaagtggtaacaaaaaagagttagcatctaagtggaggattaaagtttaaagaattattatgggtgaagagaactaacccgagatgagtgatgggcatggagtaggaattgcttgcgaattgcaggacgccacctatcaaaggctggcaggatggtgtcttttcaagttttgaagcaccgaaagacgtttccctctgttttcatcgctgttagaataaagaaagggttggaccaggcaaggagcgttaagtcaattaatcgaaatgataaggccggaaaaaaaaataaaaggtaatttctaacccgtgaacgacttggtctgaggaacaaaaacagccttagttccggcatctcggacctcagcttcttctcaccgggggtttgcactctgatcgtccttttcacctctggatccagacaaaggagatacggtgactggaggacgagggcccatagagcggggtggtggcgatggccgaggagagcgatcagttcgggctctcgtcttatctcttttgggggaggagctaccccgggttgatctgtctctctatttccgaatcaggtcagcaagcggctcgctgcttagtctagttcgggaggcaggccgaggtgattcgcggcgcggtgatcgttctctgcgggatgactggccgctatggccttcgcggtgaggaatgggtctgtaggcaccagcagattttgccccttcggcgctgccattgtcaactagcaaggttctgctatattctttcttgtcgactgcggattgaaggaatgatttgttcgttttgcaagcctccacgatcgacttggatagcgtcttgcgtcgagctgcgatgacccgagcagaagtcccttgaggtaagggagggggcaatggcagttggagaagatgtccaggggggctcatgcttagcttgtggttcgcctctacgaatcggtcgagagtaaaggagttccagagagttccagagagtttccccttcggcgaattcaacagtcggaagggtcggtgcgatgaaagctgcgaattgaaaattaagagttggtcagataaggcaagaagtaaataagggtcatatgcatgacctaacatctatcgggcttagtagtccacttcgaggagagcaagtccgaaaggtttccaatcgaagcatggctctttttgattaagaaccacgagtgatgccagttctcgtccttattagggagatgcgagatgaggttcctgttggcgttcagataggccgagaagtatcctaccttctttgaagaactcctcacactgagaagttcaatcagttcgggaaccccgatgacatatctggcttcctccgcgacagtgataatccccataatagtccggaggaggttgggggttaattggggcaaggcgatttcaagggctgacaagtatcgaacgagggcttcgggaaggggagaagtcaagccgcaacccttgaaatagatctcgtatacgcaaaagaacccgggacggtggttctccggcgactcagtgggctccggcatttgcgagtccttcataacttcagccggaatccgacagagatctcccaatcgattaagagattggagagtgcatgtggtttgatagtggggactggcgatgtcatttggccggatgcaaaggtcgttactagagccgacatcatcgaaagaggaggattcaggtctttcaatttcagaattcatcgtgtagtgaataaggggattgaaggttcggagagagaaaaaagaactttgctttgagagtgaaagcgtgaaaaataacaaggaaagagtaaagtgaatttacctttacgtttgccagtgatgatgatggaaccgtcttgggagtcgtggaggaagtggaagagtttccccgctttaatagttaataaacaatatacggtcataattgtgacagatgtaacgcgagtaattgtaggagtttccgagatcaaagcaataacgtgatttaggcgggaaatcagagagtcatttggcgcaatctttgcttctggaacattaaagtcctccgaactggagtatcatttcgaaagacttggggggctaattgttggtatcggatcctgcaccatggactcaagaccggccaaagattgctacacaagtaagggaggcccataagatgaaaggcccgtaagattcttcgaagtaagagtatgggcgagatgttgattggcgaagtgggtgcaacatcaaagttaggactactcgaattgaagaagacaaatgggccgaagggtgaagtccaggaggcccggagtggtttcaaattcgaacgttgaataattaattcaaagactagaaacggatacatttaaggtagaataattgtgtgtaaatgaggattaaatgtattctttgggtataaattatgggtcaaagaccatgtaaagacacacacatttttgtgcaaattagctatacacattttctctacaaaactcatagttttctctataatcatctatctattttctagtatatttgtcctcaagaataatccttctcactaaataaataaatacttaagtgtgtgaatccgacatccacaataagtagcatgtactctacattttcgagaacaagttttttatctagttttattccgcagacactgtgttctagaccttttgtaatccggatttctctttatctattcagtattcagcattcagtatttgttcttgatttcgtttactgttgttcatcctgttatcgttttgctattacacttttgttatcatgttttcatcctgttcaacgtttatgttctctgcaatgatgtatgagtagtgaataggtttctaaggatgggttagagtagtgtagaattctcagtttgctaggtggttgagtatggattgatagatcccttctggataagttgttcttaatgcctattgctttctgatcaactggaatttgagcccagacatttccgcgcccaaaaggtgttcgatgaaatgtctgaaccactaattccagagattcgtggccatgtaccaaggtattggttgcaaggagcgatttggctataacttgttgattcgtaatgcctgttaagttagctctcgtcaatggtgattgagtctgggactaggttaacttgaaggtctctgttgcggtggcacttagatttgggtaatgaacttgttgtctagggataatttattgagcatgtcagtcacctgtaaactgaggaaacgaaactactcaattaccccatcctcgggaattctttatttgattgattttattgtttactccactgctgtttactgtatcctgtcatctgctgcttagtttctgtaattcttttttgttactcgaccttatactcgaccacctagttgtttggcagcagactgtgcagtcgaggatctgtgtcatactttctgtctgttagtcgacctatcactcgacctcacccagtgctctgcaaagagctgtgttggtggagtgttttattgtttctgcttgaatttttgttttctgcatgttcacttagaactgctagaacacaccaaaacctgttattgcttggcttgacttagtgacttctgatcacatcttgattgttagcatcacacccatttggattgacaacctaaaatactacaacgacatgattggtgttttaggataattgattttaaaaacctattatcaatagctccagcaatcttcttcctctcaaaatcagcattcttggtactgttgctacaagcgaggttctctattagggttgtacgtcaactgggtaacgtgtgttgaagttaccattgctcgctacatttagagccatctggtatctccaatcaactcctctgaagaaggtacttagaagttgtacctcactgaaaccatgatgtggacaatctcgttggtactgcttgtaacgaacccaagcagccttgaaagcttcagctggaccttgtgtgaaggtacacagcttgtttctcaactcctcagacttagcatcattgtagaaattcttcaagaaggctatcttgatgcttctccaagtcttgagggaacctactttaagttgtttcagccaagtagctgcttccccagcaaatgaataagggaagagcttgcaaagtaggtagtcctctgagactccattagccttgatgctcagaacaaggtcctcaaatctctcgatatgatccattggctgctcatgagataagccatggaaaggatgctggccaactaaagcaaagtagccaggcttgaactcatagtcgttcctctggaatggtgggggtacaatcgctaaacgattagcatagaacaagtctggcctgttgaaatccccaagagtacgacgtggttccgcagctggaggaatagctgaaggaatctggtgttggtgtcgatcgacacctctgttgtgtcgttcgacacccagttggtgtcgcccgacaccgagccctgctgcatctcttgcagctaattgcgcattgaggcgcgcttgatcctcattggcgttctcatgtaggataagtccatgatcatccaatctctgaccaacttcattgtaggcttgcccatccacatctctcaaaactccttctgcatcagctctgatgactctgtcagccattgctaatttctgagttttttggtttgtgcgttcaagttttccaaagtccagaacagacaagttgataagctccttctgttttctgctccttgtttgccaaggcatagacatgaaacgcagaaaagaagaaaacaagaaacgcgtgagtaacaaaatagaagtaaaaactagacgaaatctctaaacaaaactcaatgatgattccgaagaacttcggcaacggcgccaaatttgatatgattcaaattacctagaattactctctcaaataagagatcaatttcagtatttaaggatcgaattcacggagttattttgttcaaacagtaagttgaatgtcgacattaagctagcagggtaatagtgaaaataaaagaaaacaaagtaaaaagacagcaggatgattgtgttgtgaacgatttaataaagacctaggaacagggtattctcaggaaactattggttagtagatctaatgaaagctaggttgttatcgaaccattgttaaactcaaactcttattatggaataaccggtgggcgtgccgcgaaactccctatatctatagctaataataaccggagaagccgagaaactatcaacctaaatatgcattcttagcgagttcaattgttcatcttagtagataggccgattcttattacacacctataaacttgactcatcaaataatagatccaactacagatacatatggcgggcatatcaattgtctggattcaagatctagttaattactctagatctagcattaaacataattaaagatgaagaattctacagataacctagcaaagggggcaatttactaaaccatatgaatccctaatgagaaaccctattcctaacaagcagactactcagacatattgaatgaaacaaacaacataattgagatagaaagcataaacacaacaatagagataagagttagaaaagatctcttcactgtattaaaaactggaatgagtctctcaagaacaatggatgaatagcttatgtctctcagtcacagggttttgcaaaagcttgataaaagacttgataaaagaaacataggtctaaaaacaatatataaaaccctaaaaacgttcagggactaataatgcaaataggaaagttttctagggcaaatttcctcttctgtaaacttgaaagtgtcatggacttctgcagggccaaaactggtgtcgatcaacaccaagagtgtgttgatcgacactcctcgctgattcctaaaccaaaatcgtccttagtttccttttccttagctattactccaaaatgtctccttatctccattgttgtcccattgcatagaatacctgaaaaaacactaaaaagactcgagaaataacataaagacttaaaatcatatacctaaaacatagataaaatcagtgaaaattgggttatatcacccatctgtgggaaaagacgctacccgagcgatcaatcacgacctaggatgactgcaaaaaggccttcttggcaaaattcttctccaactccaggactgcaagactccagaatgagatctcgggattcactcagaagcaaaatgaaagcttctatgaagcttgggaacgctttaagggttatcaaaccaaatgccctcatcacggatttaaggaagcttcccttctcagcacactttacagaggcgtcctgcctaatatacgtatgctccttgacaccgcatccaatgggaatatcctgaacaaagatgtcgaagacgcatgggagctagttgaaaacttggctcagtcggatggcaattacaacgaggattatgacagaagcatccacaccaactctgaatctgatgacaagaaccatcgagagattaaagctctcaatgacaaaatcgacaaactcctccgagtgcaacagaagcatgttcacttcgcctctgaggatgaagtattccaaatccaagagggggagaatgatcagtgcgctgaaatcagttatgttcgaaaccaaggcggctacaacaaagggtacaacagttacagacccaacccaaatctgtcatacagaagcacaaatgtcgctaatcctcaggaccaagtttaccctcagaagcagcagcggcagaacaaaccaaaaccgtttgttccttacaaccaaagccaagggttcgttcataagcaacagttccacggagggtattaacagcaacatccagcaccagcacttcaggaatcagacatgaagaatatgctccagcaaataatgcaaggccaagccgcagaagtaatggaaaatgctaagaagctggctgacttacacaacaaaattgacaaacagttcgttgaaatgagtagcgggatcgaatcattgagcaaaagggtacgacatatagaaggcacaaccgcttctacatcagccacaccaggatacatcacaggataaccaatacataattcaaaggagtatgcccactcaatcactctaagaagaggacgagcgttgccaccaaaaggagagcctaaccccaacactgaggacaatgtggttcaagagggggaggatttttatcaagacgatgttttggctgacaaaacaatcgaagagcccactctcaccagtcaacccactcaaccacgagtcccaccagctactccctctgttgaaaaactggtagctgcaaagaccaaagacacagtctttgtaccaccgccctacaaaccgccgcttccattccctggtcgtttcaaaaaagttctgattgcaaattaccgtgcttttttggaaaaagagataaacgatcttgatgtcactatgcccttggtagattatttcgcgctgatacctgactgtcacaaatacgtgaaagacctaatcacagaaaggatcaaagaagtccaaggaatggtggtattaagtcatgagtacagtgcaattatccaatagaaggtcatacctaagaaattggaagatccaggctcattcactctaccatgctcactaggccctttagcattcacaagatgcttatgcgatttaggtgcttcggtcagtctgatgcctctctccgtagcctagaaacttggttttgataaatataaaacttatagcagcttttttcaaattcctatccacccaaatgaccaagagaaaactacattcacgtgtccctatgtgacttttgcttataaacgaatgccttttggactttataatgcacccgccacttttcagcagtgcatgacttctattttctccgatttgatagaggagatggtcgagatattcatgaatgatttttctgtgtatggctcttctttctccttatgtttgcttaatttgtgcagggtacttaagagatgcgaagagacaaacctggtgctgaaattggaaaaatgtcacttcatggtcatagaaggaatcgtcttggggcacaaaatatcagaaaatgggatagaagttgataaggcaaaagttaatgtcatggtgcagttgcagccactaaagactgtgaaagacatcagaagttttctcggacatgctgggttctacaggagattcatcaaggatttctctaagttggctagaccactcaccaggctgctatgcaaagaggctgagttcacgtttgatgaagaatgtctggttgctttcaaattgatcaaaagaatcattgatctctgctccaatagtccaagcacctaattgggatcacccttttgaaatcatgtgtgatgcttcggattacgctgtgggagcagttctaggacaaaggatcgataagaagttgcatgtcatctactacgctagtagaacgatggatgatacacaagtaaggtatgccactacgtagaaagaactataagttgtggtctttgcattcgaaaagtttaggaactataagtgacagtctacactaatcatgctactctaaggcacatctatgcaaagaaagataccaagccgaggttgctaagatggattctgctgctccaagaattcgatatggagatagtggataaaaaggggatcaaaaatggtgtagctgatcacttatcacgaatgaaaattgaagatgcagtccctattgacgataccatccctgaggaacagcttatggtcatccaggaagtgaacaaaaaattcaaaagcagccagttttgggatgagatgcttgaagtagaggagaaacttccgtggtatgctgattatgtcaactatttatcatgtggtgaagagcctccaaatctttcaaggtacgaaagaaagaagttcttcaaagacataaatcgcttttactgggatgagcattacctctacactctctgcaaagataaaatctattggagatgtgtctcagaagatgaaatagaaggtatcttgcagcactgtcatggttccagctatggcggccatttcgcaacattcaagacagtatctaaaattttacaagcagaattttggtggccaaccatgttcaaagacggtcaagagttcatttcaaaatgcgattcgtgtcagagaaggggaaacataagcagaagaaatgagatccctcataacccgactttagaggttgagatttttgacgtatggggaattgatttcatgggttcgtttccgtccttgtatgggaataagtatatattggttgcagtagactatgtgtcaaaatgggtggaagcaatagccagccctacgaatgatgctagagtcgtcctgaagttattcaagagcatcatcttcccaagatttggagttcctagaatagtcattagtgatggaggcacgcactttgtcaacaaagttttcgagagtttactgaggaagaatggggttaaacacaaggtagcgactccttaccacccatagacaagtgcccaggtggaaatctctaacagggagataaaatcgattctagagaaagctgttgggaacaccaggagagattggtctgtaaagctcgatgatgcgttatgggtgtacagaacagctttcaagacccccattggcacaaccctgttcaatcttctttatgggaaatcctgtcacttacctgttgaactggagtacaaagctatgtgggcagtgaaacttttaaatttcgacatcaagactgctgaagagaaaagattgatacagcttaacgacctcgatgagctccgtgtagaagcatatgacagcttaaggaaagtaccaagtcgtttcataacaagaaaataacttcaaaatattttagagtagaagatcaagtgttgctattcaattctcgcttgaagctttttcctagaaaactcatgtctaggtggtctggccccttcaatgttagtgcagtaagaccatatggagctatcacgttgtctggaaaaggtgaagacttcacagttaacgaccaaagactaaagaaatatatgacagaccaaacaattccagaaggaacttctgttccactggaagagccacccaacccccaataagcgtgaggagtcaagctagagactctaaacaagctcacttgggaggaaattccatgactatctttgtatataatttaaactttcttattgttttctaactcactttggtggtgttttaatcttaggaaagtaagtgacaaaatcaattacaggatgaatagtgatctacagggtgaatagtgatctacaaggtgaatagtgaattacaaggtgaatagtggagtcactcaatcacgaagtcaagacgattttcaaacttttcgatcgagtgatttatttccagggaagtaacagttcgaaaattttgataacgggtcactgcacgttttcggtcaagtccaaggtgtgattgagtacgtggagtgggcgaaatcaggccatcacttcccaatgacaaaaccggtgaagcccaccttgtcccccatgacaaaaatgtcaacaattctatagttcttaccacccacctctcatcacgtttttgccaagggaagagctctcctcacctacgtacctcacctacgtaaggagcgcatctacctcctcctattcctataaataccaatctcctcatccaatgttaatcacacacaacaacatctctctctctctcatactcaatcgcaagcttctctgtctttaagcgatgccttcactcgatcgcaagcctctccacccttggaagtttacttcactcgatcgcaagctcccgacgcctcgccctctttcacttggtcacaaccctgtgacgctcaaccgcccccaacatctcacttagaagatcttaagccatcctcgtcaagttcactcgatcacaagctcaagacacccgattctcacctctttccactcgatcacaaacccgcaacgtctccacgtttgtttctctccctcttttactcgatcgtaaccactctgagctcaagtccacctctttcactcgatcacactaccgccgaagttcaggaagtcacttctctcactcctcttccttagatttgataaagtttagttgtgagttttgaatcaatttcaggaacaatgacctcatacaattatgattatccaatggatgctgatttcaacggtgatgaggcagagtcatggtcaacaagaccagagagagaagcgaaggaataccaacgtttccgagaagaaacggagcgagccgctgccaatgacaggagaagagaagagatagccagagggaagaggtcaatgacagagaattatgagccaatcgatgaagagatggaagatgacgcggagtaaattctggagcaaacccgtaagaccaccaagtctttgatgaaaaaagacaagctgaccccgggagactactacaaggttctcaaaagaaatccattttggagaacaagatatcctcacccggagacaatagcggagttaggcatcctggaggacgttcagctcttgttcgagaaatgccacatgacaacactcatgtctcatccctatcctacctatgaggatgacacacttcaattcctttcatcacttcaagtggaattgtttgaggggttgtcagctgctgagttaagagaagaagggcttggttacttaagcttcactatcgacgaccgcgactatatcatggcgatcaagactctggaaaccatgttcgggtttcccagttgcacgggaatgaaaccgaggtttgcccgagaagaattaaaatctttgtggaacacgatcgaagacaccaccagcttcaactccgctagatccaagagcaactccaatcgcaatcccgccattcgctattttcagagaaccatggccaatgtcccttacgctagggagatatccgccactgtgatgaatcaagacatggatacgttagacctagcgctgctgagtttcctctgttacaccaaagacaggaaaacgatgaaaggagatgccaatgacacacccccgtcaatgtatctcctcaatcacctatgcagctatagagggtgggcgctggccaatgacaagaagaacgcaaaaggagccctttgcattggagaagtggtcacaccaatcctcctatcgtgcgatgtcccgctgcgaccggatctaatcccaccacgttggatggatatcgtccatctcaagcttgcccatgtgatcgagcataaggtctatgacaggaggtacgctttcaagtttgatcacccatcaacaggagaagcaactattcttctcccattcagtgaaatgacaaccatcacggtgagagacaacatcgacttctcgtcatcacaagaaatcctccatgctgtgattggaggatccgcgtcccgcaatattgaaaaagtagaaggtcagagtgacaatgaggagaccaactatgagaactatgacactagctggtaccacattgaagaacacaagcccccttcacgagaaagcaagagtctcgctgaagcacaccggaagctcagtctaacccaaaggtggtgcaagtttcaagataagatcatccataagtgtgtcaaagccattgacaacatgcagaaggcactcaactgcaccacatccaccagtgcgatcaccagagacaactcgctagaagacatgccatccaggcgtcatgacattgctccgccaaggcaatctgcttatcaacagagagaactcgctgcccggcaagaacccgcacaacactcgtctcacgaggtcagggagcacaagaggaggaaaagcgctaggatggtcggatcatgaagcaagggtcggataatgtcgggccagagtgtcgtgctccacaacctactggggttgcgatcgagcataactacgaggagatggctgagccacatcaagaaccggtcatgcatgcggagtacactcaagcatatatggatgactacatctcagcacattctactgaggtaacacaccaaaaccctttgtaaataccgcttttgtttttgtttatatgtttatcttgaattctttcacaaattttgattacacaagggacagttaatttaagtttgggggagggttcaagacgtatttgacttgttttttttgtgaatatcttttgagtctaaatatcatctaagtcatagaaaaaataaaaacaaaaattgaaattttttgaaaataaattccaaaaaaaagagtgatcatttagttgcattacatttaggatcgagtctcgagtgtttcataaaggattgttgcatatgcataggggataatgaggaaatagccttgtaagcatgatgattcactaaaatgagttattagttctttgaggcatttgaatgcatgtcatgacaccttttcctgtcaatttgaacttgaatctgacttataattatcatgtttgcatcgtttttgaactcgtggatagaatacatatttggattttctttcacttattcaccactcttgttaatccaagtagctgcttctattattggagtagttcccccacccttaaccaatccttctttcaagccatgttattttgtgagagcatgtgaggcctattttcaggattgagcttggtagaacgtgttaggtttgagccgacaagagtagtatctcatgtagttccaatccgcgttttcggacttggtaggactaggtgggaacttatttggggattgagattgagtgtgaagagaaaaaggaagaaaaaaatgggttagagtctttaggagaaggaagctgaaaatcatattgaggtctcgtgaatgtttgggaagcacagaattcttaagatatgctctaaaaaaaaatatggcaacaaaacagaaaagaaaaaaaattataagagccataagagtttaagaaaaactcaattcactagactagactcatagagtttaagaaaagcttctccttaagaacaaaagtcaaagaaaagaaaggaaacattgatccaaaaaaaaatcgaaatatgcctttagtgcaaaagggtagacttaggatcatcattaagtttagagatatgaccatctacttgttattcacggtttatgtcattgggtagatggggtgctattcttgtatacataggttggcacttacctttggcaatcttctaaagcccagtcctttttaattgagagtcccctgctattaaaatctgaaccacttaaaagggaccatctttgtctcataacctgtcagtagttgcgcttattgcttgtttcactggctaatgtggaatatgaatccagacgtccaacgctcaaaaggcgtttaatggacgttggatctattaattccagagatatttgcctctaccccgaagggattggcttgtagagatggtattggctttaacaatttgattcgatattgcctacttagttagagatcgctaatgagaattagatcagtgtctagctttgcttgaggatttctatcaaaggagtgaattaatctgttgttgaacttgttgtctagggatagcttctgtgaagttttgtcaaccgcctgaatatatttaggaggcgacactattcgattaccccatccttaggaatcgtttatccatttgactgcctgttatcatttctgctttgttattcacctacctgttattgccatttctgcatttagtttcatttcatttctgttattgcataataggactgttaataccaaccaactctctgcttggcttgacttagagcctgttaatcatatctcatatgtttgcatcacaccggacttgattgacaacctaaaatactacaacgacatgatagtgttttaggattaattgagtaaaatcctactatcaacttctaacactgaaccgacgatgaaggaggctgttccggagcctcttcaataaatgtcccccgaattcgctgcttattttttattttcttttgaactcgttatgggctccggcccatttaatttgtggaaaatttgctactctccttgatctcgaaatattcattttggagatatgctttaaatgcagggcttactggaaggcgtgagtctttctgcgaatcactccagtcttaaatggaattgcgatctcctagggttacaaaatccctataaattgtggttccaagttttccttactttctatctaccccttcttttccttttttgcagcattggagtttaaccttcgatgctcggagttcatgccagacttttctagggtcggaatgatggatgaagatatcccaaatgtgccaggaagtgggccttcaccacctcgcagcttcttcaggtcccaaatccgaggtccatgtgcactgatcaagggacttttggacagagaccaagaaatcgcgatggcattcatcaaagctcttacggttcagcatcagaagcgttcgttggaaaagaggaagctccgaaaaaagattaaccgaatgttacgtatagtcaccgtaatatcaagggaacttcacaacctcaactctcatctcggggattggatcgaacttggaatctccgaattcgctcgcatcccggattgtatgatgccgatcatctatcttgctggccaaggagtccaagtgttttgtacgtcgagaagggtttcttaactcgaaatgtatacgtggtgaaactcatctttttgcttattgcttgaataaatgtcgttttatatcctgtatttgtatattcgcacagtcgaactttacttttctttgtttgttcgcataatcaaactcctttcccttttaatgaataaaacaaaattttattagtagctgaactcgtttccgagctgcctacgtaccaatttcggatcaagccacaccgtagttcatgtacataacaaaaacgcgagttaatttgaacataaaacttctttaagttcaccacattccaagaacgttggactggcctgtcttctcaatcctttaatctgtaaacaccattctgaaccacttcggtaacaatataaggtccttcccaattaatgccgagcttgcctggtccttcttccttcttattgtcaaaaacacgctttagcacgaaatctcctacaaagaaaggcctgcttttaactttggtattgtaatgccgagctgctgcttgctgatagttttgaatccggattaaggcttgatctcacctttcattgatagtatctaacgaatcatcgagcatcgctgagttttccttttcgtttaggggagcctctgttcggcgaagtccaggcacgttgagctcggccggaaccactgccttcatcctgtacaccaaagaaaatggagtttcctcggtagaacgcctaagagttgtgcagtaagccaataaaaccggttggagctcatcgtaccatcctcccttcaaatgacttaggcgcttttttaggttacgtaggattgtcttgtttacggcttcggcttggccatttccttgtgggtacggtggagtagagtaactaactttgattccccaatccaaacagaaagcttcgaatttgtgtgaaatgaattgtggtccgttgtctgtaattatctcgtatgggacactgtgtcgacatataatgtttttccaaatgaaggtttttaccgccgagtccttgatgctcatgtatgcttcagtctcaatccattttgaaaagtagtcagttaagaccaaaagatattgcacgcctcgggttgacctgtgcaatggtccaatgatatccatcgaccacctcatgaacaggtatggggcagagatggaggagaataactccgaaggctgatggataagaggtgcatgaagttggcaacctttacatcgttgggcgtacttaacacaatctgtgatcatagtgagccagtaataccccattcttttaatcttgaaagccatggcccttcctaacgaatgaatgccacacaaaccttcgtgtacttcgctcatgacgatctcgacttcgagcccaaaaatgcccaatagataaggatcgctgacacctcgtctatacaaagcatcctttgaaagacaaaattttgcgctaacgattctcattttcctagcttgccacttattttttgggagcttgcctgtcacaatgtactactttattggctccctccaatcagccctccaatctttagccagaatttggtcgatctcgtggaatattcatagttctggttcgggatgctcatttggctcaaggatatcttcctcgattagtggctcggttcttataattgtttctggaactgcatcttctgtcggattgatgggctcctcgctactattttcttttgacacgccgggcccgggtatggttgaaccatttgactttcttcatttgacaggtggcaactctatctcgggttcaccatgatcacgtatagctgctttgaaatgacgagggcttctttttttctctttaatgcttactctgaaatacattccaccgggatgactcttttaaccttaggatccgatgttgatgctaaagcagcaagtgcatccgtagtcatattttctccacgaggtatgcgaatgagttcgaactttttgaagcttttagtcagatctttaactacattgagatatgcttccattcttgaatctttggcttcataatctccattgaacattgaactggttaacaactagttgcgaatcacaataagcgagtactacttcggctccaattccttgtgctagcctaagtcctgcgattaaagcttcatattctgcctcgttgttagtagcgttaaataaaatcggaatgcttgttcaagaatttccaatgttggagattcgaaattattcccactccggacccttcttttgatgaagatccgtctacatgcaatttccaagtttgactctccggttgctctagtgcgccaagtactgataattcggtcaagaaatctgctaaaacttgggccttcatggcgactcggctcttttactctatattatactcacttaactccacttcccacttcgctaatattccggactgacttggactatgaagaattttttgaagtggctggttggttcaaacttcgatttgatgagactagaaatacgaacgcagcttctgggcagaggttacaaccgcaagtgtgagattttccatcattgtatatctggtttctggatctgtcatgtagtaaattggtttttgttctccacgatcctcccgtatcaagactccgcttactgcatggtttgatacagaaacgtataagtcgagcttttcatccacttcgggtttggacaatacgggtggtgtggttaagtacgccttaagctgtccaaatgcctcttcacacttctcatcccaaagaaatcctttgtttccctttagaaattgatagaagggtaaagatttatttgttgatcttgaaataaaacagtttaaagctacaatccgaccagttaaccgttgtacttcttcgaagtttcttggagacgacatgttgagaaaggcattgatttgattcagattggcttcaattcctcttttcgtcacaatataaccaaggaattccccggtgcatttcgccgggttcagcttcattttgtattgattgagaatctcaaaacattcttctaaatgcttaacgtggtcctttttcttcaacgacttgaccaacatatcatctatgtaaacttccatcgtcttcccaagatattcgtggcacattttgttgaccaatcgttgataagtagctcctgcattttaaaaccaaaatgcattaccttataacaataaatatctctatcgttgataaatgatgtcttctcttgatcttcgggattcatcattatttgattataaccagagaaggcgtccatgaaagttagtaactcgttcccagtggttgattccacaagacgatctatatgcgaaagtgggaaactatccttcgggcaagctttattgaggtccgtaaagtcgatgcataccctatcctttccattcttctttttgaccacgacgttgtttgccatccaatccgggtattgcacctcccttatagatcctatctttaaaagcttgtccacttcgtcatttaccgcctttgcttgttccactctgagttttcttatttttttgttttacaggtttaaagcttggatccacgtttagctcgtggtagattatgcttggatctatgccatacatatccgctgctgagcacgcaaacgatgctttatttttcttcaagagttctattaggacttcttttattttgccggttagagtggctccaattcgaactttccaatctggtttatcctcctctaacattacttcgatcaccacaatatccactttctgcccactcagaaatcttgggattattcctttcttcgcgggctttgttaattgctattggatcttcagacgatggctgactagataacatgtgcgcaaagcttcttgatctccctgaatggtttctactccacttggagttggaaatttgatgcattgatgatacgtagaggggaccgccttcatttgataaatccagggagtcccgaggatgatgttgtaagttgtcggtttatcaaaaacgacaaagtccacaattttcgacatctttccagctagaactcgtagcttgattgttccaagagacatggctgattcgctcgtgaaaaccaccaaaggagatggaggtcccactatgtttgcccgactaattctcattctttccaatgtacctagaaagattaaatcaaccgaactacccgtatcgacgagaattcttgacacttcaaagttagccacgtcgagcgtaatgactagagcatcatcatgagatctttcgaggtgccgcgtttcttcctcgtcaaatgatattgaagtgccttggtaattaacttcttctctcaagcttgatttcagtagaacattttgcctatgcttttaaatagcactaatagaatctcggcaaagtttggagcctccaaggatcacattgatcttccccttcgaactccttggttcttctttgttggtcaatcttggccttttcgagttttgaactggagagatctccactggcccatagctctgcgagatgccttttaaggacactacaatctttggttagatgtcatgttaccctatgcatgttgcagtatagactttcgtctcagacccaagtgtttgactttccttttccttggaactgcttcccgacattgttattgaaaggttgcgacccaaacttccttggcccttagttttccctgggctcgaatttcttagtagggaaagtgaccgccggttttgctggcttattcctttttgcaaagatttcttttttgtcttctacttccatccaattgtttgctcgaaaaagtgcatcttgaattgtgtccggtttgtgaaatattacactaaaagaaaacaggcaaacgacgactacgaaaggcgactaacaatgtagtcgtccttttgtgcaactactttacgactgatggacgacgttacggcaacatataaattggtcattccgtagtcgtattttagcgactacaaaaattagtcggtcaatggtcgtccaaatacgactatttgacgacgacattactgaaggaaataagtagtcgtaaagtagtcgtacgtacattgacgactacacttctgactttaatattaagtcgcaaaaaaggcgacaataatacgactaccttttgtttgtcgtcaaatagtcgcataattatcgtataatatggttggaaaatgtttttcgcgttgttgggtaggtatacctaattttgtagcgactacagtgtgtagtcgtaaaatagtcgtaaaaatcctctatataatgcacgacactcttcattctcattcaccaacaaatcaaaacaacatcaaaagaaaaaaaaaagatttcaaagaaaaaaatataagtttagtttatggtataatggcggtaaactacaattatggcggtggtggcggtttatatcgagattggatgtataagagatttgataaagtaacgggaattttgtctgccgaatatgtcagaggagtagaggagttcatgacattcgctagtagtcagcctatagtacagagtagtcgaggtaaatttcattgtccttgtagtgtatgcaagaatgaaaaacacaccatctcaagtaaaagagttagtagtcatttgtttagtcaaggattcatgctggattattatgcttggtataagcatggagaagaactgaatatggatagaggaactagttacaaggataggacatattttagtgagaatcatgaagaagtgggtaatgttgtagaagatccatatgtggatatggtgaacgatgcatttaattttaacgtggggtttgatgataactatcatcaggatagttatcatcaggatggtacttatcagaatgtggaagaactggtccgtaaccattcaaagaaattctacgacttgttagaaggtgcaaatactccattgtacgatggttgtcgtgatggccagtcgcatttatccttagcatctcgactcatgcagaacaaggcggagtataatatgagtgaaaagttggtggataccgtttgcgaaatgtttacagattttttaccagaaggaaaccaggctactagttcacattaccaaaccgaaaagttgatgcacaatttaggacttccatatcatacgattgatgtttgctcgaacaattgtatgcttttctggaaagaagccgaaaaagaagatcattgtcgattttgtggcgcacaaagatggaagcctaaagatgaccgtcgaagaaccaaagtaccatatagtcgtatgtggtatctacctattggagaccggttaaaaagaatgtatcagagccacaagacagctgcagcaatgcgatggcatgctgagcaccaatcaaaggagggagaaatgaatcatctttcagatgcgatagagtggagatatttccaagagttacatccccggtttgctgaagaaccttgtaacgtttatctcgggttgtgtactgatgggttcaatccgtttggcatgtctcgtaatcattcgttgtggcctgtgatcctgactccatataatttaccccctggtatgtgcatgaatacaaagtacttatttcttacaattttgaattttgggccaaatcatcctcgagctagtcttgatgtcttcctccaacctcttattgaggagctaaaagagttgtggtctactggagtcaatgcgtacgatgtatcattgagtcagaattttaatctaaaagcagtgcgactgtggacgataagcgacttttcggcgtagcatgttatcaggatggactactcatggtaaattgtcttttccaatttgtatggaaagtacaaagtctttttatctacccaatggacggaagacatgttggtttgattgtcatcgtagatttcttcctcatggtcatccatcccgtaggaacaagaaagactttctgagggggaagagacgcttctagcgagtatccacccgagtctttgacaggggagcaagtttattacgagcggttggctagtgtaaatccagcaaaaacaaaggacgttggtgggaacggccatgaaaagaagatgccacgctacggaaaggaacataattggcacaaggaaagcattttgtgggagttgtcttactgcaaggaccccaatcttcgccataatattgatgtgatgcatacatagaagaattttcttgacaacatcatgaacactctcatgagtgttaagggtaaatcaaaagataatatcatgtcaatattggatattgaaattttttgttctcggtcagagttacatattgatagtaagggtaaagctccatttccagcgtatacattaacacaagaagccaaacagagtttattgtcatgtgtcaaacatgaggttaaattcccagatggttattcttcagatttggctagttgtgtatacatggagaatcgaaagttttcaggcatgaagagtcatgattgtcatgtttttatggagcgactactgtcatttatctttgttgaactccttgatcggaatgtccaccttgcattatcaggtacaataaatgttgtctaagttgccacacttttttaacctctgatttaacttaaacatatatatatatatatatatatatatatatatatatatattttaggaattggagcatttttccgggacttatgttcgagaactttacagaaaaatgtggttcaaattctcaaacagaacatagttttaataatctgtaacttggaaaaaatctttccaccatcattttttgatgttatggaacacctacctatccatctcccatacgaagctgaattgggaggtcctgtccagtgtccaatatcggtggatgtacccatttgagaggtttttcaaaaagttgaaaggaaaagtaaagaacaaaagatatgcggcaggatcaattgttgagtcatatatcaatgacaagattgcttatttttcagagcactactttgtcgatcatatacaaacaaaatcaaggtaaatataattatttattttacgatgcgcaagctatacttcagaattaaaaccaattacatggatcaggttaacaagattcgatgaaggaaaagttcctgtatatcatgtccttggagtacctaacatatttatgcacgtcggtcgtccaagtggtgaaatgcacgtggaatggctttcagagaaagactaccaaagcgcacatgcatatgttttaagaaattgtgactattttcaaccacttgagaggtatttttaatcactccttaatttaaaatttccattatgataactttgatttatttatctttggttgtaaatatagtatgttcgaggattttctttctgtgaaatatccaaccttgtccgaaaaagaactctacgcgaaaagagctgaagaatattatctatgggttaaagaatatgtaagtctacatcattttagtaattttgaaaagtgatcatttaaattatgttgaaattgatattgtttatatattatgtcggtaacatattggaaccctacttctccatttcctacttgggttcaagagattgtgcatgggcctttgaacaaggttaaaacttggccaatgtatttcacacgaggatatttttttcatacgaaaaatcatggcgctggacgaaaaacatgtaactatggggtacgtgttaaaggagaaaattatgcggattcatctgatgaagcggatttctacggtaccttaactgatatcatagaactcgagtatgagggcatcgtcaatttgaaaatcacactttttaagtgtaagtggtatgaccctgtgattggtagaggcactcggcgaagccatggtgacgttgtagacgttctatcatctaggaaatacaataactacgagccatttattctaggtacgtaattaagaatacattaagttctctgttaattattaaataattttgtatatctattaatatgtataacttgcgtatgcaccatctcaaggagatcaagtttgttgtatttcgtatccatatacaaagaaaccaaaaaacatttggctaaatgttttaaaagttaatcctcggggaaacatttctggagaatatgaaaacaatgttccgactcttttgcaaacagaaaatgatgaagctgtgttgctgactacaattgaagatttggtaatagacaatccggtagaaagcttaaacccaatcatactcgattacaatgtcggagatgctgaacaagaagatgaattccgatgtaatttatcgtcttcagtcgaagatgatgaagagtactaaatgtgtgctttatatgtatatttatttgaaaaatgctgtttaagaatatatcatataatgtttaattatttgaataaatattacataaaccttataattttcatgaatatttataagtattattaatttgttgggctgtcaacatcccaagcccaagcctaaacccaataaacttaacgacgaaattacgattaacagacgacagacgtttaattatattgggctttcaaatttcgagcccaaacccaaaagaattaacgactaacgtgcgacaaacgttttattagttgggctattaaattccaaagcccaaacctaataatgttaacgacgatagtacgactaacatgcgacacactattaatttgttgggcttttaaattctgaagcccaaacccaataaaaatgaacgagtatccaacgactatttggcgacaattgtctttatagttgggcttttaaatttcgtggcccaaacccaattatttagtgacgaaaatacgactaaattgcgactacctgtataaagaaaaccctaattcgatcgattcacttctcatttcgtccaaacaacactcttcttcgatcttcttcttcaacttcttcttcgatccattttgaattgacttctccttcttctatctgttattcgatctgttcttcgtctcatctctacataaacccaatcgagttcttcttcttcttcttagatctcattcgattcgaatcatcttcgatctcttcgctttcttctactctttgatctcttcgctttcttcagttcttcgatctcttcgtctctcttcatcgatgcctaacgccggtcgtggaggttcacgaaagcgggagataacccccaatgttactcagagagccggagggtcaacaccgcttggaaaacccgcttcgctgcctcagcagtacgacttcactccggtgtcggtgcctcaatttcctcagacgcagccgccagagcctcaacgtcagccccccactaccgcaactatctgccgctgcatcaactattccagagctccaccactccgtgtgtagatccgccgccgccgcgatctgaagaggtgcagtttaatccactgccagaagctcctctaaaccaagatcaaccggagtctccaattcccaactctcaggcacacaaccatccatcttctcaaggcaacaactttcaagagggagctcctcaattgttgtcggagctacaagaagactcggggagggctctcaatgacatacttatggttctcggaagggaaatgtggaccactatattgtctcctattcccaagccgaagactgaatggtatgtgctcttcctcaaccctattagattttttagattgtctattagcttgtgttaggttgcagcaatgattagcttgtgttaggttgtgtcttgattagcttgtgttaggttgtgtcttgattagcttgtgttagattgtggtggattgctcttgtgtccgcttcgttaatttgttgtgaacatagattgtgtcttgattttcttgtattagattgtttcattggattggcttcttgctctcttgtgttcgcttgctatcttgtgtgacctattttgtgtgaacatagatcttgtcttgattagcttgtgtaagattatggttgcttgctatcttgtgtgaacatagtggtcatgtctagaaccgcttgtgttctgttgtggtggcttgctatcttgtgttctattgtggtggcttgctctcttgtgttcgcttgctatcttgtgttctgttgtggtggcttgctctcttgtgaacgcttgctatcttctgtgaagtggtcatgtctagcaatacttgtgttctgttgtggtggcttgctgatgagtgttttatttcatttcagacttttacctaaaagaccacacgactactacaagtgcacagtatatcggagtagtattttaggatcgaatccacaaggagagaaggagttcagagaaatccttaagaagagagtgaagctaggaccaaaataaagagagggggttgatgtatgctatgagtaactaaactaaaagactactaactaaactaaacgataaactataagagagaagcgttacgtcatcgggggtttctccggatgttcatggttcaataataaggtatagatctcaatctaggtgataacatggctaggtttgtttacttccaaattcccgaacatacgaaactctatcaagactagttaaccctaacggctaataggtgaaaactggctattatcactagtatattgtgtacgcagttgccctatcggatataggtgctaacatggtttcaaaatacaagatcaaagcattaagttcaaattcgattctagttcataagtccctatcactcggcgggcgtgcaacagttatagttctttattcagttgagttaggtcaagcatttaaacgagattttgccaaagaatgaaatacctaagggcaagtactaggtggcgttccggacatacaagcattaagaataaactcaactagaaggaatagtgtaaacgatcaaacaaagccatagaaaccaccaacctagatgtttgatctattggtccccatgaattctcctttgaaaaccccctcaaacccaactagagaactactcgctatggcaaaggggctaatcaaagttgggttgagtaaaccataactaaaagatgaataaaacttaaaaggggtttagagattacttctttgaatggagaatacaagaggcaaagctccaccttgagtcttacacgaaaccgagaaagagaaagagagagatggtgttcttcaagcttcaagaggtacggcggcaaggaggcagctcttggtgacggctagggtttgctggtgatgaaggcacacctagggttagggctaaggacaagtatttatacttgaggcccaagaattaggtttaggggtaagaacgtcattccgctggataagtaagtgatcgggccgagaagtgggcttcaaggcaagagcctaaaggtggcgacgcaaagagggaaagacttgggtgtgacctaatggtcggtggtgagctactaggagctgcccggggtcaagtctcatcggccagatgtgttttagacttattatttccaaatggctggttcttgacatgtcttcactctttgcgccatatcttctaaacggctttatggattgcttctagctttccatccataccgaaatatcatcatttcgaatctgggaagaccttggccggatgctaaacttccgaagcactggaatgatcgtcttttgatacttttagcttcaaaactcttaaaaccttcttggcacctagaatacgtgtttctcctcttactggctctagaatggcaccaaatgatctctgaagcataagaaaacaatagctaaaatgggctaaaaagccgtgttatcaactcccctagacttagactttgcttgtcctcaagcaaacaaaagaacaaatctggtggagaggtttgaaaatcgcgggaactctcctgttatcagtgaccatgtcttgaatatatcctacagaccacattaaacaaaagttgcgttagaacggacgctcaatagtcttatgcctttctcgtccttgtccatatgccttgatcctgcagaactctgaattcatgtcaatcaactctttacattctttaaatgttttggcgtggactttctcattagaaggtgtcattcggggtagacggcgcttggtatgaaaggggattttggttttaagtggtggagttaaagtgtttagggttaccgtatagtctcgaatgcaggatatgttgcaaaacagcaagagagaacggatcggttgaggtccacagtttccaagcacttcgtcttttaaacaccttcttctgctttacttctttcttactttcggttcccccagacttaggtttttccaagggggctctcttttgtaattggctcatctctcctttatgtttcaatgtctttccttggagctatgccactagactctcttggttgtactatttcctttccttcctttttttattattatttttatttatttttcttttcttttcttttcctttttttttctcttttttgtttttttatggaaggggaaacagaacttctaaacactaagtctattgagcataccttttgaattggttccaaggaaaaataaactcttgggccgtttgttgcaatcccttcttttacttccttcttccgtctttgtggcgagaaactatgttgttcttttctctccgacgtttatgcacatatctactaaatgaaaaaggaaaacagaatgcatgaggcttgaaaagaggatagggtttaagggtaggaaccactaaaagtgagtggccattcaggatcagcagagagtggtaaaaagggaaaagaagtcctaaatgtatatgctcgtttcctcgatctaacacctcttcatgagaaagaattaagttcaggttaatcgtccaatatagggtagagttgacgtcggaaccaacagaaatttccgcggggttaagcttccgggggacggtccgggcgtagtgttcaaggttgcctgttccttgcgaccatgtaagtgttcctcaagaaacaattctcaacacataatggtcaataatcatcatataacaaggtcttggttctctactggttttgactcaaaaaaacattactcgataaataagaaaaactttttgctttattacaaaatatcggtgtaaaaaatggaaaaatgtttcaagtcaacaaaatagataatagcattagtagtaacagattcattaacccccagacttacttcacaccgtcacttaagtgacccgcgtaaggacatcggccacgagcaagagtacgaatttttgaaagttgcccgaatgcatggccaattgaccttaggtgctcaaaacacaatagactatcaaagggcaagtttgggcaagaatgggctcgaatgggcaagttaaggcaagaacaagcgtgccgcgggcaaagtttgccccgccgggcgttgaccgacagttgaccgcaccaaggacgcgtggcttggctaacttggggcccaagaaaagttgcttggagccgaattttagttgcttggagtcgaagtttgggcggccacgtgttactcatccgctagagcggcgagcatgtcatcgcgggtggatgacatgtggattggtgactcgcccatactcatgacacgtggacatattgactcgccattcccttgcctatataatcccaactcgaccccaattgttttgtgaagagaaattgagcggaagtgagaggctgccgagtttaaaccgtccgtttgattcaagttaaagtcctgtagccgaaaactcagcccgaatcgttggaagcttttcgttggttactgagtgagttctggataatggtttaagtttcataatcatattctcatgcattcttgattgatttcgtgagttatacgtggtgcttgtggtaggaggcaaagaccataagcgtgccaagatcttgatatgtctggccttcgtagtgaaccgtgctatcgtggggtcttgtaacattgttacttgatcgccatgaggtgcgaagaactcggagagacgaggctagctaccgttggtgagtgtgtacacgacggtgtagcgtttggtattaatgctctcgttgcatacatttgtggttgtaacgcgggagatcacgggagtgtgcgtgtttgttgttgggtttgaaagcagcatatcagaccaaacttactaaaactggagtcttaatgcattgcatatttatgtagttgcttcggcaagctactgttcgttgccattatctgttgcgtgtttcatgttgggtatttgggttggggtaaactaatgtctgctgcagggaatcccgagctcactgagtaatcttagattactcatgattctactagttttgtagaaaacccgtagtgggaagtagagggcgtggtggacaataggaaacccggagtagttttgtgccttttgtaaaacaagtatgtttctattatgtaccgtgcttttggcactaggctgtaacgcccccgaattgccctatagccggactagccatgggcgacctggcactgataccaacttgtgagacccagtcccggacgtctcggcgtccggcgaccgtgtactcaagttcgcgcctcttcccgaccgaacctcttaattttttgcgattaaccatagaatggcctttacgaggctaaattctataatcgctttcttattacacagcggaagtctttctaaccttggtttaattctaaccaactcttgtaccggtttcatcgtctttgtcccttagacttagatcgatcctttactcggtcaagacatgcatattgttcgctaaccattctaggcctaacaatcgcatattcctttgtcctattttcacggtcaattcccaaacgtctatcctaactagtaagctagatcgttacataccttggccactatgcagatttgattccttagcccgtttgtcgctttactccattcgttcaacgactcgtatccgatcgtgaattgatgaaccaatctctatcgttacttagccatacaaccaaccaaccccactggtctaagtactacgatagagattggggatcatacgattcccttggttcacgatggccgaatcaagctcttggctcattcgtccatccgtcctccaaacgtacgccccttcggttccatggtggatgattcagcactcagcttatcgaaccatccatgtttcgatctggtcgtttactacgaccgcccatggtttactaactgtttatccgtctggtctatggtggtcgataaagctttcgtcttatcgatccatccttacgatccgaacgatattcttaacacacccaagggtccgtggattcatctatcagatcatcgtaggctagactatgaaatccttcttccgtcggccttaggtttgctcgcgggtccaacgtccgttttgtccatcggttcccaccgtggactttcctgttggttatcagtcgagtcaccctttggtcttaccgatctctgatccgtttcaccatggctgaggagatagatacatgaaggcggccgcgatattgatcctatatggtgaatcacgttccttacccattcttggtgctttctccctttatcggtgagattgcatccatgggcgacccttgagtgtgttcggatgcacttatccttgtgcttcctcgaacacttttcttgatccatcccatccgatgatcggtctgtccgacccgatccgtccgacgatcggtctaccagattcgattcgtctctaagacgaacggtctaccctctccatcctctacactccatcgaaccgttggaccgggaggtagcatgcgcatcagttcggtcgagttatactcgccgagccgcaccccctttccgaccaacaacttcgggatgtgttgggacacttttaagaatgttttgtggtgtatggatgatgtgtgagatgccttgggcgtcctcccttatatagggggcgaatagatgcttcccgaagcatcacatccgttccttgcacccttccgaaaggtcacatccgttccttgcacccttccgaaaggtcacatccgttccttgaacccttccgaaaggtcacatccgttccttgcatcctttgggcgttgcaaatgttcattggtacccgctcgactttacaccttttggccgagacacctcttcacccgtgagctaccacagtccatcagctcgagtgtcagctgaccggaccacccagctgggtcagtactcgatcagctcaccgagctcagtcgagctgtcggtcagctcacctagctgagctagctagtcttccagctggtttagctcacctagcttagctagctagttcatccagcttgtccagctcacctagctggttcaacttgaactttctcgttcttcctactaagtattttggtccgttcctcgaccatgatctagttttctcctaaaataaaccggcctctttatgaaagcgggacgcggtcgttacagacctagttacgctacagtgaaaatgatcgatcacaacttagtagagtttccagttgaatctggttctttaacgaaattataatcgaccctcctcccactaggaacaccactttggcttgctaatcttcatgatattctagtgttgagcgacccggagtaggtcttatatcatttaagaaaacactttatgcatagtatatagcttatacttggcaaagagttacccaaaaatatatcattttatcggatccttgttaaaatttacataataataagtaattttgcaaaagcaacgtaaagcatcctatttccggcatttcctagtgttcgtctccccgctatggtcatcctactatggttacctgtaagacaagtagactcatgagtaatctaagattactcagtgagctgggtctatgcacaaataaatctctagggtttaatcaacttaataggtaaagttatccatcagagatcacagagtacgtaataaacgtattatcatatacttataataataccagaatatgcagccaaactagacacatgaatgaaccttgggcccagcatactaccaaccttaccaaaaaggtgcaccacaacatcaacacaaactcctgcatacgtgtatatgtgttctccacgcgtatgctaccacacacacgtacgtgcacacccacaccacacgtacgtacacaattgtgaacacccgagctatagccacaaaggcttataaccagatcatcactttaatgcatcgtcatgcattactcggcatacgctccgagtcttgtgccatcatgtaagtgaccactcaggatcaagacttactatcacaatcacaacacaaaaagggagacagaagcttactctaaacatgatggtatcgggtaaaccttgaataccacttagacacaataacctcatgcagtactatatataagtagtttaccatgccccaaactagtatagacaatcaagcatcaaatcatgtatcaatatatattcataatatagcaaggatttattcacaacctcatagcatatctcatttaagtataacaatctaacaaggtaagtaagccctcgaatcatatctcaattcatcaagtaaacttatttaagtccatattcatttaatctagtcatgtagcctttcagtcgagtttttaatcagacagcctttcagtctctctctcttgctttcaaaaatgaaactaggcggagagagctctatttctaatccgcccaaggtcggccatgcagcaccgcccgctgccacatgtccggacagctgccgcgcccataggcgacaagtgtctcagacgacagcgtggtgataggtggcgacgggtgtcactccaccgccccatcaacttcggctccaagaattagctgactttggctccaaggttggtaacttgaggtgtcctactcatgtcagtttcgcgaccggcgggacaaacttcgatgcagcacgccgaactttttccatctttgcccattcatagccattcttgccctttgatgttttggcaccgtttggacacacgcggtcaattggctttgcattcgggcaaaagtttctcattcggtcctttggccgtgcccgatgcccttatgcgggtcactacattctcccctccttaatagaatttgccctcaaattctaaccttcggtcatttccaacttccatgaattctcccaacatttttacaagggctttgaatttccttgttctaattatacaattgcctgctcctcgaaccgaacttcctttcttttgcttatttccctgaagtatgcccgatctagacttatcttgagcccaactaagttcaatttcttttctctgattcttcatttggccgaacgttggtgaggcacttccgatggggtttcgaactcatctgatgcttatagaagttatttctcactcatataatggtcggccacacaaaagcaagaaaatacttaacttattatacattcaaaaggttcatacaagttataagtatcgaattttagtcttagtctttatatattattcaacaagttctaagccttagcatatttacaaacaaaatttcgctatgactcagccgattctatacttacgcgaaaagttaactatattcttcctagatgatcttacggaccatctgtcaagggttcctacacttaggacactcacaccttacccataaaaatgagggcatcccttcattcaaacacttctcctcctccgccgtagtcattaatggcccgattcctctcgaagatccttcgcccgcatttggcacaacatcaggcagtacatggacacatgccccagtcctccgcaacaatagcacttggtatagttatccatataggacatagtcggtggtggatacaagcactcttcggtcagatgatcggtatgaccacatattttgcacggacgcttagctggtgtggccaacttctccccaattgacttcctcgctgctgctcgtattatgtgtttaaccttggagttaatcccatatacgatcccaagtggatgcaggtttatttgaacgatccgctggtcctaagccttctctgatcccatttccaattctgccgctctctttcccttctgcctctcatcttctccctccttatcaaccatctttcctttggacctttcttcatcaagtcttaaacgattcatcaaagacttctgattcagttccttttcaagtagcatcggatcccacctcccatttccttcatcatcactcggttcattccctttaaacatttcatcctcccagcatgaatccgcctcgctagggttcaatattatcaagatagctttcaaactgtccaaggagatgttgatcacactcggactcttaggttctggcgttaaggattcaaatgagtccgactaggaatcacccccatcgttcccattttctcctccttcttccccattcggaccatagtcttgagcacactcgacaattaactgatcaattgcgttgtaatgaccctcaccttgagtatgactttgcccgtgatgcgcccgcagtttgccccagtatgccccagttcgcccgtagtgtgcccgcagtgtgcccgtagtatgcccgtggtacgcctgcagtgtgcccgcagtaggcagtgtgagcgacccgcgctggcctaagtttggccgagatgggcgtgtgctggaccatggaccatgtcatcgacctgcttaaggctgcgagcaggtgggtaagctgcttggtgttttgtggctgagaatcgaccatgtcgatctgccaaaattctgtggctgcggagcggccaccgagcaggatccggttggacgacaggtgggtgatgactcagggccggttgtcgccccttgagtagcccatggacggctgtcgactagcgggatgtgctgagtgtcttgggtggtgactcagcgccatgtgtcgccgggcaggatgcgattagtggcgagactccggtgactcacggctgggtgtcgctcccacagcgtgtccagtccgtgggtcgcctatcgagcgtggcttggtggtgacggccgtaacaagtctccccaagcaccttagctaaccaacttccccgaaaacctataaatagccctcattcctgatccttagaacttacacctcgaataaaaacccactataagtaccttcggccactagtaaaccagaggagaacccgcgaaaagacccaatttggaagtcggtaagttttccgaccttagttgcttttagtaaccgcagattagtacttaatagagttaggttgtggattgctagataaccgagtaagagaaggaaccaatggattcgagggggtaggtatggccgtttcccgaggatgcgtggatcaccagtaagtctcggacatgtgaagtagcacatgtttaggtgtttaattttatttacttataattgcctaggaggttagtaaatcatactaagtgataattattgtgtgatgcattgtcttttgttgtgattgcataatgttaaagtgtagtataaacgttgtgctacccaagttctgacaacattgtcgattgagtcttgcttgttgattgtaaattgcttggtatagttaggtgttccgatagcggtataggtgaaaccctagagatcccggtctaattgagtaatactaggttactcatgatgctacctttttgtttacacgaaaccttagcggggaatctataaacggcgcgatgatcattaggccaaccagcttagattttacagctcttgcaaatactgataatgtttattatatatgatttcctatgaaaattaataaggatccgccctatatacgagttttggtaacgttttattcgtatatatataatgtaatgatttaaccctttttataatggaattgatggttgaatcgataatattattagtctagtccaagactaacacaactcgtgttctcggaacgggttgaaaagccttaggccacgaacacgacgaaaagtttctcacggttggtcgactatgtgaacggtcgtgttccggacacctggttgactaactacaagggtctaacgtgatgcttccgaatttgtccttagttttaggacggttcgggggtgttacacgcgtgtgatatggttcaaattacctagaactactctctcaaataagagatcaattgcagtattttaggatcgaattctcaaagttcttttgttcaaacaatgagttaaatgtcaagattaagctagcagggtatgagtgaaatagtaagtaaacaaagtaaaaagacagcagattgattgggttgtaaacgattaggaaaagagctaggaacatggtatcctcaggaaactattagttagtagatttaataaaagctaggttgttatcgaaccattcttaaactcaaactctaattatggaataaccggggggcgtgccgcgaaactccctatatctatagccaataataaccggagaagccgagaaactatcaacctaaatatgcattcttaacgagttcaatttttcatcttagtaaataggccgattcttattacacacctataaaccagactcatcaaataatagatccaactatagatacctatggcgggcatatctattgtctagattcaagatctagttaattactctagatctagcattaagcataattaaagatgaagaattctacagataacctagcaaagggggcaatctactaaaccatatgaatccctaatgagaaaccatattcctaacaagcagactattcagacatattgaatgaaacaaacaacataattgagatagaaagcataaacacagtaaacagagaaggggaaagaaaggatctcttcactgtattaaaaactagaatgaatctctcaagaacaatggatgaatagcttatgtctctcacaatagggttttgcaaagaacttgataaaagactttatttacgaaacttaggtctaaaacaatatatatagaccctaaaaacgtccagggactactaatgcaaatagggaagtcttttggggcaaatttgatcttttataaactcaaaagcgtctagggtttttgctgggccaaaattggtgtcgatcgacaccaagaatgtgtcgatcgacactcctcgctgatttctgaaccaaaatcgtccttagcttccttttccttagcttttgctccaaaatgtctccttatctccattgttgtcccattgaattgaatacctgaaaagacactaaaaatactcgagaaataacttaaagactcaaaatcctatacgtaaaacatagataaaattggtgaaaatcgggttatatcaactcccccagacttagcttttgcttgccctcaagcaaaacacaaaagccgaacccgtggaagaggttttgaaaacaaaggaactcccaacattctctagcctattaccatgatcattcaaactaagtccatatgcctaacaagtctaatcaaatcctaaccaacatgtacttctctgcaagcttacacaacattctagattccatacctaagttccacaactatatccaccaggctttcatcgctgggtctcatcaaacaagccaccattcaagatccttctagactcattcatgtactataccatgataaattaaccattctttatatatttttttctttttcagtgttctttctctccccctgacttattcttttttgagagtaaacaaaggggaactcgcatactagatcgacaccctcggcattttccaacctttgtaattgattattccaaaaaatgtataataatggggtcataggaaacattcctacccctatacactatccgaaagtcgtctcaatctctcattatatatatttttttcattttataaggggagaggaacatattctttttatcacattggtctcaatatcaggtatgaacgaggaatcaagatctatgaatactaaccgtttgaagaggtaaaaggaagagtagtgagattagctccagccttagtggttgagttggaaactaggatatcctctagtctgttggtttgccatctagattttccaatagtcggattggctcgaacctgcagcactcataaatcaggcaataaacaagagaaatatagatcatgattcctaactaaactaaagaaaacgtttttttttttttttgggaagggaaataaaagaagtaaccaaatgaactgcaaaacgaaaaataataagaaacaaaaataaaagcatcaatagtaagaacctcccccagacttagacgacacagtccccagtggcattcaaatccagagaaagcgggaaaaataaatcaaaaataaaagaaaataaaagaaagggaaaagaaaaatcaaaccagtgggttgcctcccactaagcgcttgttttgagtcaatagcttgacttggcggagttcaggatgtgggtggagtggtggaggattgcatctgccgcctcgccttccaaggtggtgtgtaaacggatctggttgtagcagcttctggtgtcgatcgacactcagtggtgtgttaatcgacactcttctcgtcacctgcaagaacaataagagaaacaagctttcgaggaactctaggcttgttatctagtgaagcagtcttcgaataatctaaagaattaatcaaagataaaacaggagaagagaaagatgagaacttatcacataggtcctcaattggtgtgggctgaagagaatgtgcagaatcctctgtctgtgaaacccgagggtgtcgatcgacaggggtagtggtgtcgatcgacaccgttcctctacaactctcattggcgagctgaacgggtttggagcgttgtgtgtggctctgtggtgggattctgatcaatctagggaggtgtgtctgtgctggaggcaatgcaactgataggcttagtaagctctgaaccatccatgccaaactccatctctgaattacaaaccttgagagagattctccctctcttcacatcaaacctagtaccagctgtaactaaggatgctcttccaaggataaggggatccttgggttccttctcatagtccaggaccacgaaatcagcagggattatggagttaccaaccttaacatgaacatcttcaaggattccttcagggcttcgcttggaacgatccgcgaagagatgagtgatgctagtaggcctgtagtgagtcatgcctagtctctcagcaacagacttgggcatgaggttgatgcttgatcctagatcacacaaagagcagctgaatctgcttgtggagatagagcaatcaagaacaaagctacctggatctggaatcttctcaattgtctaaccaggagtaatggtgcggatgtactcagctatgtctactctctatgccttctccttcttggccttaggcagcatgattgcactgatatctctggtaagcagcttagcttcatctgaactaattccaatgtcaacaagtcgcttgacatacctgttgagtgaggcggaagatgtctctgaaacatccttaggaagagtatggaggatcttctccattatggctgtgcacttggcagcatgaagcttctgcttagaacaacgcctcctcggataagggataggaggagtgtagacaaactcgggatgcataggtatttgcacctcacagggtggagtccggatccagtgtcgatcgacagtagaggggtatcgatcgacaccgtcgtattgagtcgtctctgagaaaagggtcccgtatggtgtcgatcgacaccatctctgcaactgcgagctccaactcgtcttcaatgtccaattcctcacacacatcttctccttctctgatcaagatggcattgcagctcttctttgggttagcatcagggtaaccaggaagaaaaccctcttgtctcttgatagattgtgcagtttgagctacatgtacatctagcttcttcaagtgagaacttagattgtcgatcttcccattaagatctatgtagacatcatcaaacttgccattaaattccacaacaagctttgtttggctctccagaatctgctcaagcatcgattccactcttgtctctgatgagggtggggggggggggcttggtaagttgaattaccatagttcctgaaaggccccgatccagactgcctaaagtccggacgagttctctcgacccaagccactaagtgactcggccctaaccgtttatgaggttctttcctagtctaatccgttccatatgattccgtgattcaatatatgagacgaatagagtaaacaaccaatcggatactttattgattaagcaaaggattcgatacaacctatgagtttgcatataagctattacaagtcatataatcgatccctagactatccgaactatcaccacccatcagcccggccttgagtctctcgcgcttaagccaagtccttcccacgatcaccatttgttcctgaaagtcatagagccataagtaatctcatttacttaatcatatgcaagtccatgcaatgctctatatgccatacactactcggatacgtggagagaattcagagaggggaagatcgcgcatcagtccggccgattctcggcaggtcagttaagacccgccggtcctccgccgagccgcgtccctgcctcagccgatccctacctggaccgagtcttgtgtaggatgcacatgacccggatactacccagccctctagtcgatcctttcaaggatccgactactaactcacatcctagaacccttagactcaaagtctaggatcccttaccttccttctcgaggttaggtcgatccgaccctccttctttattgccggccacagcccggctaccgaatcctaagactatttattctcccaagagggagagagttttaatggtgagtttcttgtgttttcggtgtgttgtggtgagtggatgcttcccgaatcaacacatccgttccttgcacctttccaaagagttgcacctttccgaagagttgcgcctttccgaagagttgtatctcttcgcccataaccacccagctagtccgttactcgtccagttacctcgagctcgtccgtcactcgtccagctacctcgagctcgtccgtcactcgtccagctacctcgagctcaaccgtcactcgtccaactgcccgagctggactgtcactcgacctgagtaaccgtcactccttccagctgagcttgagctttgggcgagctgacccaactgatttctttacgatcctagcttagcctgcatgatttctcctttgtccgagcttatggccagctccttctcacttgtctgagactacaccttcttctctcggaccaagtcctagccaacgatcctattgaggatcgcgggcgttacaagtctccccccccttgaattggatttgtcctcgaatccgcatcaagttgatctttacccatctccttgaatcactccggaaaattggccttcatcttattctcggttttccaagtgtattcttcacggcctccacaattccacaagacttttaacaaatcccttgattttccccgagtccctttcgtcatccggtccatgatccgtaccggccatgcttccaccgtcatgttctcctttaacccgggaggtatatcttccacgctttcttcttgatcacttaaacacttccgtaattgtgacacatggaagacgttgtgaaacgcatttagttttggaggaaggtcaagtttgtatgccaccgcccctactcgttcgatcgccttgtacgggccaacataccttgggcttaactttttccttgaggtgaatcgccctgcccctttgtaggtcatcgcctttaagtacaccaaatctcctacttggaattccaattcctttcgatgtttgttggcgtagcttttctgtcgatcttgggcttcctttaacttgatttttaagaacttcattctctccgtggtttcatccacgatcgtaggtccaaacaaccgacgttcgcccacaggcgtctaacacaacggtgttctacaagctcgaccatacaacgccacatagggagacataccaatactagcttgaaaactattattgtatgcaaactctactaaccttagaaatttctcccagtttcctccccaatccaagacgcatgccctcaacatgtcctcaagggtttgaatcgttcgtttggactgtccgtctgtctgtgggtggtaggcagtacttaggttcgctcgagttcctaaggccttttggaaagccttccaaaactttgacgtgaaccttgagtctcggtctgacactatactaaccggaatcccatgtaaccgcacgatctcgtctatatacttctcggcaatgatttccgctccatccttatccaagatcgccatgaagtgcgcagacttagtcaatcggtctaccacaacccataccgcattgtgtttggatttgatccccgttggcagtccagtgacgaagtccatcgttatgtggtcccacttccattccggtataggtaggttttgtaacaacccacttggtacttgatgctccgccttgaccatttgacaagtcgggcacttggccacccatctggccacgtctttcttcattcctacccaatggtagtaccttttaaggtcgcggtacatcttgttcgacccaggatggattgagaacttcgattgatgcgcctctcttaggatctcctcctttaatgccctatcgttcggcacacatactcgatcgttcaccacgattgtaccattgttcgaggtttggtactcggtcttgttgtttagtgcccatccttttatctcctcgtcccgttcctgagccagccggatcctactaagcaagtcggcctgaccgtcccgttccgcctcaacttccgagcgcctcctactcagggcgtcggtgacttggttggcattgcacggatggtacgctatatccaagtcgtaatccgccacaagttccatccaccttctttgccttagattcaactccggctgagtgaatatgtactttaggattttgtggtcagtatagatttgaactttagcaccatacaagtatgatcgccaaatcttcaaggcaaatactaccgcggccatttccaaatcatgcgtagggtaattcttctcatgttttcgcaattgccttgatgcgtatgcgataacactccccttttgcatcagtacgcatcctagtcccactatggatgcgtccgtataaaccgtatagggctcaccttcctccggtaagaccaataccggtgcattagtcaacatggcctttaactccaggaagcttttctcgcactcatccgaccagttgaatgcggggtcttttccggtcagtcgagtcaagggttgggccatgctcgcaaaactcattacgaaccttcggtaataccccgctagtccgagaaaactcctaatctcggtggcattccgtggtcgtggccactcctttattgaccgtattttctccggatcaaccgatactccttggtccgagataacatgaccaagaaaaccaacgctcctttgccaaaatgagcatttacttaacttcccaaatagctcatgttcccttagccgttccagcaccgcccttagatgttcttggtgagcttcccaagatttcgagtaaacaaggatatcgtcaatgaagatgataacaaactcgtctaagaaatcccggaataccccattcatcattttcatgaaggctgctggtgcattggtcaatccgaatggcatgaccacaaactcaaagtggtcgtaccttgtccggaaagccgttttcctcacgtccgttggcgctatgggaatttggtgatatcttgaggccaagtcgatttttgaaaaccactgtgcacctccaagttgatccatcaactcatctatccggggtaaaggatatttgtttttcacagtaactttattcaatccccaatagtcgatgcatagcctaaagctaccatctttctttttcacaaacagaaccggcgcaccccatggtgagctactcggcctgatgaatcctttatccaacaactcctccaactgtttctttagctccgccatttccgctggtgccatccggtacggagctttagatatgggggttgtcccgggctcgagttctatcgtgaacgggtctgaccggtccggtggtacaccactaacagccgcaaacacgtccgagaactcgttgacgatcggaatgtctttcaactccgcactcgcccccacttccttggttgtgatcgtggctaaatatgcctcacaacctttcccgagcatcctttcagcctggattgtcgagattaccaagcttcccgaggttgttcttattccttggaattttaacataccctcgtccctctcgaattgtatccgtcctcggtgacaatctatgtgagccttgtacttccccaaccagtccatccctaagataacatcatgtttctttagtgggacaatgattaggtccgcgggcatattgacaccgttcactacaaccgagatgccccgaacaagtccggtcggatacattgcctgtccgccggccgctcgtaccattccataatcggtgtttggttctttcctgaacccacctgtttcaaccaattctggactaacaaaacaatgtgtagccccagaatcaaatagagtgtgcgttactacgtcaccacctctcaaggtccctacacattcccttagaatgctgagtacctcccctttcccatatgtatgatgcaatgcaaatgcagttattgaaataatgaatagggagttgtgagaacgtaccagtgatcgccctgaagtttccggcatcgttagcttcctccgacaactcataaactcgcggtgccacggcttgccgctttgggggaggcggcagtccatttcccccgcgattgtccctttgtccggcctgcttctccgcagtcaacttagggcactctcgctttagatgtccagtctttccgcaatagaaacaagtccttgtctcttcaccgagaaccttggactgtcctggttccattctcgggcaactttggatcgcatggtccttgcttccacaccggccacatgcacctatggccttccagcaagttccgctgtggctcttaccacaggtcacgcattccccggtcttagcatcggacttggtgttatccaccttgttaaatttccttttcttatccgcgggtttggtggattgattgttccggatcggtgctttctcccggttcaagtacctctcctcctcgatcccttcctcaatcattgctgccctttcaaccaattcggaaaccgagttgaatgtccggaccaaacaatggttgcggatctctatccttagtccacggataaatcgacgcacttgagcttgtttctcctcaagttcacgtcccacataacgccttaggcggttaaattcctcatcatattcacgcaccgtgcggttcccttgaactaggtcgaggtacgcacattcaagcctatcccaagcctccgatggaaagtacttcttgttaaactcgtgtttgaaatccgcaaaggaccggacctcgtcccctctgcgtttctcgacggttaaccaccagttatgggcgtctccttcaaggaagtggaccacaatgtccctttggtaatcctcaaggcagcgggtagacttgaagttcctcttgagtctactcctccactcatcggctacaatcgggtccgtactgcccatgaagtgtctcgtgcccagccttgagatatgttcgagaacaactatcgcgagattctcaagccgacaaggggtgataccccttaacccaacacctagtcctagaaccaagcatgctctgataccaacttgaaaggccccaatccagactgcctaaagtccggacgagttctctcgacccaagccactaagtgactcggccctaaccgtttatgaggttctttcctagtctaatccgttccatatgattccgtgattcaatatatgacgcgaatagagtaaacaaccaatcaaatactttattgattaagcaaaggattcgatacaacctatgagtttgcatataagctattacaagtaatataatcgatccctagactatccgaactatcaccacccatcatcctggccttgagtctctcgcgcttaagccaagtccttcccacgatcaccattcgttcctgaaagtcatagagccataagtaatctcatttacttaatcatatgcaagtccatgcaatgctctatatgccatacactactcggatccgtggagagaattcagagaggggaagatcgcgcatcagtctggccgattctcggcaggtcagttaagacccgccggtcctccgccgagccgcgtcccggctcagccgatccctacccggaccgagtcttgtgtaggatgcacatgacccggaaactacccagccctctagtcgatcctttcaaggatccggctactaactcacatcctagaacccttagactcaaagtctaggatcccttaccttccttctcgaggttaggtcgatccgaccctccttctttattgtcggccacagcccggctaccgaatcctaagactatttattctcccaagagggagagagttttaatggtgagtttcttgtgttttcggtgtgttgtggtgagtggatgcttcccgaatcaacacatccgttccttgcacctttccaaagagttgcacctttccgaagagttgcgcctttccgaagagttgtatctcttcgcccataaccgcccagctagtccgtcactcgtccagttacctcgagctcgtccatcactcgtccagctacctcgagctcgtccgtcactcgtccagctacctcgagctcaaccgtcactcgtccagctgcccgagctggactgtcactcgacctgagtaaccgtcactccttccagctgagcttgagctttgggcgagctgacccaactgatttctttacgatcctagcttagcctgcatgatttctcctttgtccgagcttatggccagctccttctcacttgtccgagactccaccttcttctctcggaccaagtcctagccagcgatcctattgaggatcgcgggcgttaaagttcctctaaaagctgctttgaggaaaagtcttctagaaagcaggctttggagtgtagttggaggaaacctggttccctgtaaacctgttgccactgaagttgccatgtggctgcccaaacttcctgtatccctcaccatctatgtagaagactcattcctctgactcatggtcaggctcaatagtttcttcctcagcagcaaattagacatgcttcttccatgtgagcaagtatgaactgaatccagcttagcattcacctctgcgatctgatttcctgaaatagctctagcaatcttcttcctctcaaaatcagcattcttggtgctgttgctgcaagcaaggttctctatcagggctgtagcattagctgggtaacgtgtgttgaagttaccattgcttgctgcatctaaagccatctggtatctccaatcaactcctctgaaaaaggtacctagaagttgtacctcactgaaaccattatgtggacaatctcgttggtattccttgaaacgaacccaagcagccttgaaagcttcagctggaccttgtgtgaaggtagacagcttgtttctcaactcctcagacttagcatcatcgtagaaattgttcaagaaggctatcttgatgcttctccaagtcttgagggaccctgctttaagttgcttcagccaagaagctgcttccccagcaagtgaataagggaagagcttgcacagaaggtagtcctctgagactccattagcctggatgctcagaacaaggtcctcaaatctctcgatatgatccattggctgctcatgagataagccatggaaaggacgctggccaactaaagcaaagtagccaggcttcagctcataatcgttcctctagaatggtgggggtacaatcgctgatcaattagcatagaacaggtatgacctgttgaaatccccaagagtacgacgtggttccgcagctgaaggaataggtgcaggaatctggtgttggtgtcgatcgacacctctgttgtgtcattcgacaccgactgcatcggcgtgctgctcccgatggtgtcgatcgacacccagttggtgtcgctcgacaccgtgcccttctccatctcaagcagctaactgcgcattgaggcgcgcttgatcctcattggcgtcctcaggtaggatgagtccatgatcatccaatctctgaccagcctcattgtaggctcacccatcctcatctctcaaaactccttctgcagctctgatgaccctgtcagccattgctaatttctgagtttttcggttggtgcgttcaagttttcccaagtccagaacagacaagttgatatgctccttctgttttgtgctccttgtttgcctaggcatacacctgaaacacagaaaagaagaaaacaagaaacgcgtgagtaacaaaatagaagtaaaaactagacaaattcactaaacaaaactcaatgatgattcccaagaactccaacaacggcgccaagtttgatatggttcaaattacgtagaactactctctcaaataagagatcatttgcagtattttaggatcgaattcacggagttcttttgttcaaacaatgagttaaatgttgagattaagctaggagggtatgagtgaaatagtaagtaaacaaagtaaaaagacagcagattgattgggttgtaaacgattaggaaaagagctaggaacagggtattctcaggaaacgattggttagtagatctaataaaagctaggttgttatcgaaccattcttaaactcaaactctaattatggaataaccagtgggcgtgccgcgaaactccctatatctagagccaataataaccggagaagccgagaaactatcaacctaaatatgcattcttaacgagttcaattgttcatcttagtaaataggccgattcttattacacacctataaaccagactcatcaaataatagatccatatacagatacctatggcgggcatatctattgtctgtattcaagatctagttaattactctagatcaagcattaagcataatcaaagatgaagaattacagataacctagcaaagggggcaatctactaaaccatatgaatccctaatgagaaaccctattcctaacaagcagactactcatacatattgaatgaaacaaacgacataattgagatagaaagcataaacacaataaatagagaaggggaaaaaaaggatctcttcattgtattaaaaactagaatctctcaagaacaatggatgaatagcttatgtctctcacaatagggttttgcaaagaacttgataaaagactttatttacaaaacttaggtctaaaaacaatatatatagaccctaaaaacgtccagggactaataatgcacatagggaagtcttctgggcaaatttgagcttctgtaaactcgaaagcgtctagggtttttgctgggccgaaactggtgtcgatcgacacaaagagtgattcgatcgacactcctcgctgatttctgaaccaaaatcgtccttagcttccttttccttagcttttgctccaaaatgtctccttatctccattgttgtcccattacatagaatacttaaaaagagactaaaaagactcgagaaataacataaagactcaaaatcttatacctaaaacatagataaaatcggtgaaaatcgggttattgatagcatgttgttaagactatcgttcgcttgttcttcggtcgcattctcggttggtaccagaaataaattgccatcatcggtgatcatccactcaacatggttcgcttcttcactagataacgggtcatgatgatcatcatcattctccgaacattcagacggatcagattcaattgacatatcggacttagtagatttactatcttcggccataatttgatcattcatggccacagacaaactgtcatcgtccgtactgctcggcggagcaaagttttcggggttgggcacattaagaccgtgcaacgaactgactgtgttgcttcctttgctagacaacatctgcaaaacgaggtaaacctatcccccacttagccatctaaaagacgaacaaccggaatctaatgttgcattctgcgacttaaatttactcgataaaatcatcgaaaacccaagtgtccacgagcatcgcataaccatgctctgataacaaaaattgtaacgcccccgaattgccctatggctagacaagccacgggtgacacagttacgctacagtgaagttgatcgatcacaacttagtagaggttccagatgaatccggttctttaaccaaattataatcgaccttccacccactaggaacaccacttaggcttgccaaccctcgtgatattatagtgttgagcgacccggactaggtcttatatcattaaacactcggctgcctttaagaaaacattttatgcatagtatatagcttatacttggcaaagagttacccaaaaatatatctttatatcggatccttgttaaaatttacataataacaagtaattttgcagaagcaacgtaaaatatcctattgcagaagcaacgtaaaatatctctagtctgaaacaagttattttgcagaagcaacgtaaaatatctctagtctgaaacaatgtttcctcgaccatgtgcaaggttttatcgattcaggcaagtttttcttagtttcggtcgagtttttaatcggacagccttttagtctctctctcttgccttcaaaaatgaaactaggcggagagagctctatttataatccgcccaaggttggccatgcattaccgcccgctgccacaagtccggacagctgccgcgcccacaggcgacaggtgtctcgaacgacagcgtggtgacaggtggcaacgagtgtcactccaccacccatcaacttcggctccaagactcagctgacttcgtctccaagactcagctgacttcggctccaaggttggtaacttgagccgcaaggcaccgcgagtgaggtgtcctactcatgtcggttccgcggccggtggggcaaacttcaccgtggcacgcccttcttttcccatctttgcccattcgtgcccattcttgccctttgatgttttggcaccgtttggacacacgcggtcaattggctttgcattcgggcaaaagtttctcatttggtcctttggccgtgcctgatgcccttatgggggtcactacataggccctagccatgaaatttataaatgtttggtaacatgttgtgtcgtaatgactgataatgacttaatcctagtcggcacaacacttaaatatcgcgagggttggcaagcataaacgatgtttaagtgggagagtggtcgtctatacactggccaagggttgggattggttctcgaacctcggttggatattgatgatcaatctcaatgtggcatttttggggagcccgtgacttgtccggtcatagagcatctcgggggcgttacagtccccggtgtgagaataagcattgggatgaatacgtgagaaagataagttataatcaatgtcaccttgtatgtggtgactaaccggatggtctttctccttgcttaacatcggccatactcggcttagtgaggtcgaattccatgatattgatctccattcgcttcttccttgaaacaaaaacctaaaaccactaatagctttaacgaaacaaaataaataaaaacatacctaagataaattgatattgttgtagtttatacgacaacaaataagatcaaattcgtggtgacggatggtgtgaatggatggtgggcagttgcgggcttggccgaaagggtggagtgggtgggcaagtaacgtccgggtgttggatggggtcgccgggcgttgcgatgggcagaatggtcatgtgttaaacgaatccattggcggaccgatcggtcgtggtggtgaaactccccttgtccattcacgtgtttgcccgagttggccaagtcttgcccggatgagtttgcattcggccggaccggtgggcaagttgttgcccgggctgccaggtggggcaagtctggcaaaggcgtggcacactccggcgaggtccggcgggtggtcggggcgcattggcaaactctggccaagtgatggcgcaaatcagcgtgctctggctaagacttggcatggctgggccggcttttcctggcggcaccggttactcgggcgagtagatgggcctgttgtcacggtgcctagtgactggtccaagtgacccttcttccttctcttctttttgggtttttctgttttctatttttctatttttgtttattttataaaatctgaaacaaatactagaaaggttaaaactaaaagcaaaataaaaatcccaagggaaaagtagctacctaaagggttgcctcccacttagcgcgcttgtttaacgtcgttggctcgacggttgggtcttactaggcgtggtaagataggttgtttcgccctaggcgacctttctttgattgaaactccttgggaggttcttccgtgctctcgccatttgacctccttctcctttttgagcccggggtaaacggcaccatcttgtggaacacttcatcatcgatgttggcgaagaatactgtttgattaagccaatccattatagtgaccgctgtggctaggaacccacctcctagtatgagttgagagggtcttcctttctcgacctttatgacatggaaattggtcggcacattgcaccttccaacccgaacatagacgttgcagactatcccttcgggaaccatgaaagacgagtctgcaagtccaattcgcacatccaaaggttgtagctccttgattctaagatccttcgatgtctcctttgtcataatgttgatgcatgatccaaaatcacatagggcatccttgaattcaacacatcgtatagaacaagtcacaaggaatcttctcgggctctctatctttcgaagagtgttgaacggtttcaagtggtgtaaggcttcctcgtacaattccttcatctctctccttgtttcgcaactctcaagaaagaaatggtcaatatggtaaaccgaacaagctttagagaaagggatacctcgaggtagcttagaaacggctcggttaaagtctccaagtcttctcaagcttatcatgcgtggatgccactggtcttctaggagagtgactggttgtaaacgcttgtcctcccgggaggatcttcattccttttgtcgatttcatcttctttaaggtcgtgaggatctcggtaagttgtagccgcatcgcaaagcacatgggggctagagtcttcttcttcgctctccattggttcatgcccttctatgcatgttattaggttatcaactttctggtccaaatcaagaattctatcaagcaattccacgtatttccttgaggattccatcgtcactatcctaagtgatgcctgtatccttgattgatcatcaacgttcttgacttggttctcctcaacttcaccttgtcttcttatcacgtcctccaaagccacatcttctttcgcgtcattatcttctagtcgattaatgcgcgtttgaagcctccatctgctatcatcgacgccttccatcctggattggattctccttaggtcatcttggctaattgaagagaattcttcacctgggcgaggtgacaactcacgtttgtctctcggttcaagatcatccccgcccgcggcaaggatggtcttttctgacaaggtttcgtgaaataggttttgccggtagcttagaccagcatcctcctttgttcctcatagaaactgtaacgcccccgaatcgctctatggccggacaagccaagggcaacccgaaaacgccacattgatagctcacacggacaacccaacttaggttccaaatggctttagacccttagccagattatccacatgaacatccctcacgaacacggtttaggcttttcaacccttgccatgatcgtgagttatgtcagtctagacaagactaatatcgcatgaaacacactcaactatccaaaacgtttcaacaatgggcccttcagcatacacgctcaaatccaacaaaaatcataatcattaagtttttcaaaaagttacaaactctatactggctttcctacgtcctgagcatccctctaatggttcccactaaggtttcctgcaaaacaaaatggaatcataagtaatctaagattacttagtgagctcggtctacctgcaacagatattagttccccatcccattatcataacccgaaacatgcaacagagaataacaacaaaaggcaacttaccgaagcatctaccaaaaatatgcacatgcaactaagactccagttttattaagtttttaaaagggccttatatgctgccttcaaacccaacgccaaacacacacactcccgtgatctcccgcgttacaaccacaaaggtatgcaaccggaacatcactaccaaacgctacaccatcgtgtagacactcggccagggtagttaggcccgtctctccaagttctccgtacttcatggcgatcaagtaacaacgttacaagaccccagaatagcacggttcactacgaaggtcagacataccacaatcttgatacgcttatggtctctacctcctaccaagagcaccacgtactaagacccaacatttaagatattatgagacatatggttactcaaactcatagaatcatcaatattcttactcatcacaacctcccaaacctaacccttaagcataagaatctaaaagatctcatatgcggcttagtaccatcacaccattagttaatactcatataattcatgaaataaatcaatgaatgcaagagtatatgatcatgcaaccaaacaagcaatcaatcacccaaataaacactcaaacctatcatttgccatatcacacgcttcgagactcacagagattcggttgaaggtttaaggttagcttcaacgattctcggacattccatggcttcccaatcttgatcccagctcaatttacctctcttcatcttgatctaacatctcttgatagaagcaaccttgattcatgaagctttactctgaacacacatttatgggacgggttcctcggaaggttctcgatcggacaggataacagcatggatttctcgctcatgggcaggaattctcgatcacggacatgatttcttcactcacggtcaaagaatcgcagtcacgggcagagtttttcaattgtgggcaagttttctctcgattacgggcgatttttatgagtcgggcagccattcggatcactctccattctcccatcaaatggctcgagtttggccaagcatttataggtggaacagcttgggctccaagcaaacgcatgtcatctggtggtgacaccttgcgggacacatgtcgcccgcccgtgaagacacatatgctgcaggaatgggacgatgacacgtggaaggggaaacttcggctccaatcctcataattttggctccaagcaactttcttgggctccaagtaagccagtccacgtgtccatggcgcggtcaaagggcggtcaatgcccgacagggcaaattttcgcccgtggaacgcccgtattgcccaatcttgcccatctttgcccattattgcccaaatagtaatatcttttgccctttgatggtttaacactttttgggcacatatgggaatcgaccatgtacccagggcaactttctcccggatgaccccatctcgaactagagttaaccatattcattcttgccttgatcgtctctttggatttcgttccttaactatttattttctctttcaggtcatcctcagatgttcctcgatgtttttccgcttgggcgtttaccccttagcgagggtcattacattctacccctcccccccccttaaaggaatttgtccccaaattttatcttttgggcatctccttcttcttaggtttctcctgacactcgctcataagattcttaagtccttctccatgtaatgctccttctcgccaccttggacaacttgattatcttcactatcactcattgcttattattattccaccttctcttgaattcgtctcgccacagttttcaccaatccctagtctttcatttggctgaatcgctctttacataatttcagctattgaaaacttctattctcgtcttgatggtaatatcttatccgaaggtagagataactcttcccacaagtttcttgctttgtcaatatttgataccacaaactactccattctgagaaatccttaaatcataaaagcttaagttggagtgattaggaaagcttcttcatctctagcatcttctgactctcttatattttttaacttcttggggtacgaaggttacttccttaatgtaccatgactcaagccatttcccaactgaattctcactacttgaacatttatctgaccggtaaagagattcttcgatgtttaccacagatacttcaactactcgcttctccacaacaagggttcggcttcagggaacagttcaatctaatgactactccaattaggaaggcaccctcaacaattacacacaaaaacttgggatcactcaacactccggagtcgaccccactcaacacggatgcatgcataatttaaattaagcaactaatctaccaactattcacacaatcacacaatcacattcaagagaataaataaaacccatacgtaccttatctgagactcttaaggtcaagaaggcttagggtaaatctatttctatggtttaactctcactcagtaacttgataccttcatgacttcccgatcgatagactggccggggtgacggaccgttgatgactccttcatctttttcaacaaaaagacttgacccattcataagttctcaaacacttccttaactcctctgactattcttcccataaccaacttttctctggtttcttctcaggtactttgatttgtccccatcattttaactttgccatttcctttaatgacttggatcattcttcatatatcatcctccgatattaactccaagacttgattccgtggatcattgtctctctactcctttaatgcttacattcgattgttttccttttcggtacgacttcctttcgttctcatatttacctttacgatacctccaatcttaacttcgtttaactgatcatcttctttgaatctacaacctcctcatattttgtacacttctccctttagcggcttcagttgaactacttaactcatcactcttctttaccgactttctcctttaagttttggatctttcataccttgcacctttactcgctcgataatctttttgcattatctctatcttgatcatcccgcttacacccgtttactctctgatcatgtatccttcttcgaacattaccatttgatccttagacgcagttttcttcccacatccctccgataacgatattcctttgatcaaacttcaccttctcagtttttgattcacctcaccttgtcttactacgcctcctttttccctttataatgatcccaaaaatatactccatctcctttctcgaactccatcgttactcaccatatattgatttgtgatcaccacctatgtctcttaaatggttttgctcccccaatactcaatctcttcttcacccactacttcgatgtgctgcttactcttcatttaagtgatctccaataactttccttctaatcacttacttcttctcagcttcatcacttccctcatgcctttctccgattaataagtcttgctcatcattcttccaaatgatttcattcatcttccgttttcctccttccttagaaatgatctttacaccttcggctcttgtcctctgcaactcgcatctcatcacccaccttggctcttactctttctctaaaaatctcctcaacttctccttcactatttcttagttttctccgaaacaacttacctgcttccccttttgctctcacttgagttacaagcccttgttactgagctcgaccaggattcttcaacactttaaatcttggttgcggtcccccacgaccatccattctcaatccaatccaaacgtacaactacaacaacaacaagggcaatacctaacccattccccactaactcaggacatacaagtttacctagttgcttttgcgactcatttactcgataaaacttttagaaaacgtgtgtcccgtgagcatcatgaaccatgctctgataccaaaacgccctcgaatcgctctatggcctgacaagccaagggcaacccggaaacgccacattgataactcacacggacaacccaacttaggttccaaatggctttagacccttagccagattatccacatgaacatccctcacgaacgcggtttaggcttttcaacccttgccatgatcgtgagttatgtcagtcccgacaagactaatatcgcatgaaacacactctttatatgaaaataatcttttataatatataaatttctcagacaaccaagtatccaaaacgtttcaacaatgggcccttgagcatacacgctcaaatccaacaaaaatcataatcattaaattttgcaaaaaacaacaaactatataccggctttcctacgtcttgagcatccctctaatggttcccactaaggtttcctgcaaaacaaaatggagtcataagaaatctaagattacttagtgagctcggtctacctgcaacagatattagttccccatcccactatcataatacgaaacacgcaacagagaataacaacaaaaggtagcttgccgaagcatctaccaaaaatatgcacatgcaactaagactcctgttttattaagtttttaaaagggcccgatatgcaaaacatcaaacccaacgccaaacacacactcccgtgatctcccgcgttacaaccacaaaggtatgtaaccggagcatcactaacaaacgctacaccgtcgtgtagacactcggccagggtagctagccccgtctctccgaattcttcacacttcatggcgatcaagtaacatagttacaagaccccacaatatcacggttcactacgaaggtcagacataccacgatcttgatacgcttatggtctcttcctcctaccacgagcaccacgtatcaagacccatatttaacatattatgagacatatggttactcaaaatcatagaatcatcaatattcttactcaccacaacctcccaaacataagccttaagcataagaatctaaaaaaacctcatatgcggcttagtaccattaattaatactcatataattcatgaaataaatcaatgaatgcaagagtatatgatcatgcaaccaaacaagcaatcatgcaaccaaacaagcaatcaatcacccaaataaacactcaaacctatcatgtgccatatcacacgcttcaagactcacagagattcggttgaaggtttaaggttagcttcaacgattctcggacattcgatggcttcccaatcttgatcccagctcaatttaactctcctcatcttaatctaacacctcttgatagaagcagccttgattcatgaagctttactccgaataaagacgggttcctcggaaggttctcgatcggacaggaaaacagcttggatttctcgctcatgggcaggaattctcgatcacagacatgatttcttcactcacagtaaaaaaatctcagtcacgggcagagtttttcaatcgtgggcaagtttccaatagtcggattgactcgaacttgcagtacttatcaatcaagcaataatcaagagaaatatagatcatgactcctaactaaactaaagaaaacgtttattttttaagacccaataaactcaaaaacggaaaataataagaatcaaaaataaaaccaatattagtaagaacctccccagtggtattaaaatccagagaaatcgggaaaaataaatcaaaaatgaaagaaaataaaagaaagggaaaagaaaaatcaaacttgtgggttgcctcccactaagcgcttgttttgagtaaataggttgactctgtagttgcttaatcaacaggtggatcctgaagatccaaaggcttttctactggaatcttggcttcagcccagtagtgtttgactctatgtccattcacagcaaatggtttttcattgttgtttttgagaatgactattccatatggcctaaccgagtggactatgaagggatctgtccaacgagaacacaattttccaggaaatattgtcaatctagaatcataaagaagtacctggtcattaggctcaaaggtccgagtgaggatcttcttgttgtggtaagcttttgtgtgttccttgtagagcttcgagttgtctaaggcgtgaattcataattcatcaagctcattcaactgaataagactcctttctccagttgatttgatgtcgaaattcatcatcttgactacccaagctgctttgtgctctaatttcactaaaagatgacaagctttaccatatagaagatgaaaatgtgtggtcccaagcggagttttgaaaactatcttgtaggcccacagtgcatcatctaacttgtaggaccactcctttttcgctttacccactgttttctcaagaatctctttgatttgcctgttgcaaacttcaacttggccgctcgtttgtggatggtagggagtagcaacccgatgctgaactccatactgtaaaagcaatttcgctagaatcttgttaatgaaatgcttacctttgtcactaatgactatgcgtggcactccaaaacgagggaagatgattaacttgaagagtttcatgacaatcgctaaatcgttctttggactagctatagcttctacccatttggagacataatccacagctactagggtgtagagattcttgttggattgcgggaaggctcccatgaaatctataccccaacaattaaagacttcgacttcgagtataaatttctgaggcatctcattacgcttgctgatctttccccttctctgacaagggtcacattgcgatatgaacttctgagcatcccgaaacattgtaggccaccaaaagcctgcttgaagaactttggatactgtgaaatgaccaccatagctagagctgtgacaatgcgatagtatatgaaataacccgattttcactgattttatctacgtgttaggtataagattttgagtctttatgttatttctcgagtcttttttgtgtctttttaggtattctatgaaatgggacaacaatggagataatgagacattttggagcaaaagttatgaaaaaggaagcttaggacgattttggttcaggaatcagcgaggagtgtcgatcgacacactcttggtgtcgatcgacaccagtttcggcccagaaaaaaccctagatgcctccgagtttacagaagatcaagtatgccccagtagatttccctatttgcgttattagtcccttgatgtttttagggtatatatatattagttttagacctaagtttcttttatcaagtcttttatcaagttttctacaaaccctattactgagagacataaaccagtcgtcgattgttttcagagttttattcagatctatatatagtgaagagatccattctttccccttctctatttactgtgtttatgctttcacactcaaatatgttgtttgcttcatccaatatgtctgagtaatcttcttgttaggaatagggtttctcattagggattcatatggtttagtagattgtcccccttgttaggttatctgtagaatttttcatctttaactatgcataatgctagatctggagtaattaactagatcttgaatccagacaatagatatgcccgccataggtatctgtagttggatctattatttgatgagtctggtttataggtgtgtaataagaatcggcctatctactaaaatgaacaattgaactcgttaagaatgcatatttaggttgatagtttctcggcttctctggttattataagctatagatatagggagttttgcagcacgcccaccggttattccataattagagtttgagtttaagaatggttcgataacaaccttgctttcattagatctactaactaatagttaccctgagaataccctgttcctagctctttattaaatcgtttacaacacaatcaatctgctgtctttttactttgttctcttttattttcactattaccatgctagcttaatctcgacattcaactcactgtttgaacaaaagaactccgtgaattcgatcctaaaatactacaattgatctcttatttgaaagagtagttctaggtaatttgaaccatatcaaatttggcgccgtcgccgaagttcttgagaatcaacattgagttttgtttagagatttcgtttagtttttacttctattttgttacacacgtgtttcttgttttcttcttttctaagtttcaggtgtatgcctaggcaaacaaggagcacaaaacagaaggagcttatcaacttgtctgttctggacttgggaaaacttgaacgcaccaaccgaaaaactcagaaattagcaatggctgaaaaagtcatcagagctgatgcagaaggagttttgagagatgaggatgggcaagcttacaatgaggctggtcagagattggatgatcatggactcatcctacttgaggacgccaatgaggatcaagcgcgcctcaatgcgcagttagctgctagagatgtagcagggctcggtggtgagcgacaccaactaggtgtcgatcgacaccatcgggagcagcacgcggatgcaatcggtatcgaacgacacaacagaggtgtcgatcgacaccaacaccagattcctgcagctattcttccatctgcggaacctcgtcgtactcttggggatttcaacagaccagacctgttctatgctaatcgatcagcgattgtacccccacattccagagaaacgactatgagctgaagcctggctactttgctttagttggctagcatcctttccatggcttatctcatgagcagccaatggatcatatcgagcgatttgaggaccttgttctgagcatcaaggctaatggagtctcagaggactacctactgtgcaagtttttcccttattcacttgttggggaagcagcttcttggctgaagcaacttaaagcaggttccctcaagacttggagaagcatcaagatagtctttttgaacaatttctacgatgatgctaagtctgaggagttgagaaacaagctgtctaccttcacacaaggtccaactttcaaggctgcttggatttgtttcaaggagtaccaacgagattgtccacatcatggtttcagtgaggtacaacttctaggtacctttttcagaggagttgattggagataccagatggctctagatgcagcgagtaatggtaacttcaatacacgttacccagctgatgctacagccgtgatagagaagcttgcttgtcgcaacaataccaagaatgctgattttgagaggaagaagattgccggagctatttcaggaaatcagatggcagaggttaatgctaagctggattcggttcataacttgctcacaaggaagaagcatgcccactttgcagctgaagaagagactattgagccttagcctaagtcagaggaaggagtcttctacatagatggtcagggatacaggaagtttgggcagccacagggcaacttcagtggcaacaggttaacaaggaaccagggttcctccaactacactccaaagcttgctttccagaagacctttcctcaaagcaactttcagaggaactatggtaattcaacttaccaagccccccccccccctccaccttcagcagagacaagaatggaatcgatgcttgagcagattctggagagccaaacaaagcttgttatggagtttattgggaagtttgatgttgtctatacagatattaatgggaagatccataatctgagctctcacttgaagaagctagatgtataggtagctcaaactgcacaatctatcaagagacaagagggctttcttcctggtaatcctgatgctaacccaaggaagagctgcaatgccatcttcatcagagaaagagatgatgtgtgggaggaattggacacttaagacgagttggagctcgaagttgcatagatggtgtcgaccgacaacctccagtgttgatcgacaccatacgggacccttttctcagagacgactcaatacgacggtgtcgatcgatacccatccagtgtcgatcgacattggatccggactacaccttgtgaggtgcaggtacctatgcagcccgagtctgtctatactcctcttgtctcgtatccaaggaggcgtcgttctaagcaggagattcatgctggtaagtgcacaaccataatggagaagatcctccatactcttcctaaggatgcttctgagacatctatgtttcattcaataggtatgtcaagcgacttgttgacaatagaattagctcggatgaagctaagcttcttaccagagacatcagtgcaatcatgccgcctaaggccaagaaggagaaggcacaaagagtagacatagctgagtacatccgcaccattactcctggacagcccactgagaaggttccagatccgggtagctttgttcttgattgctctatctccacaagcaggttcagccgctctttgtgtgatctgggatccagcatcaacgtcatgcttaagtctgttgctgagagactaggcatgactcactacagacctactcgcatcactcttcctttcgcggatcgttccaagcgaatccttgaaggaatccttgaagatgttcctgttaagattggtaactctgttatccgtgctgattttgtggtcctggactatgagaaggaacccaaggatccccttatccttggaagagcattcctagctacagctggtgctaggtttgatgtgaagagagggagaatctctctcaaggtttgtgattcggagatggagtttggcatggatggttcagaacttactaagcctattagttgcattgcgtccagcatagacacacctccttagactgatcagaatcccaccacagagccacacacaacgctccaacacgttgagctcgttaatgagagttgcagagcaacggtgttgatcgataccactacccctgtcgatcgacaccctcgggtttcatagacgaaaaattctgcacattctcttcaacccacaccactcatggacctatgtgataagttctcttctctctcttctcctgtttatctttgattaattctttggattattcaaagactgcttcacaagataacaagcctagagttccttcaaagcttgtttctcctgttgcttttgcaggtgacgagaagactgtcgatcgacacacccctgagtgttgatcgacactagaagctgctccaaccagatccgtttacacaccgccttggaaggcgaggaggcagcaacaatcctccactaccactccacccacatcctgaactccgccaagtcaagcgattgactcaaaacaagcgcttagtgggaggcaacccactagtttgatttttcttttccctttcttttattttattttatttattttatttatttttaccgccttctctggatttgaatgtcactggggacagtgtcgtttaagtctgggggaggttcttactaatgatgcttttatttttgtttcttattttgcagttcatttggttatttctttcccttctttccaggaaaaaaaaaaaaaaaccttttctttagtttagttaggaatcatgatctatatctctctcttgtttattgcttgattgatgagtgctgcaggtttgtgtcaatccgactattggaaaatctagatggcaaagaataccagatattgagaccaatgtgataaaaagaatatgttcctctccccttataaaaagaaaaatataatgagagattgagacaactttcagatagtgtataggggtaggaatgtttcctatgaccccgtttttatacattatttggaataatcaattacaaaggttggaaaaatgtcgagggtgtcgatccagtatgcgagttcccctttgtttactctctaaaaagaataagtctggggagagaaagaacaccgaaaaagaaaaaaatatataaagaatggtcaatttatcatggtatagtacaggaatgagtctagaaagatcttgaatgttggcttgtttgatgagacccaacgatgaaagcctggtgggtatagttgtggaacttaggcatggaatctagaatgttgtgtaagcttgcagagaagtacatgttggttaggatttgattaaacttgttaggcatatggacttagtttggatgatcatggcaagaggctagagaatgttgggagttcctttgttttcaaaacctcttccacgggtttggcttttgtgttttgcttgagggcaagcaaaagctaagtgtgggggagttgatataacctaattttcactgattttatctacatattaggtataagattttgagtctttatgttatttctcgagtctttttagtgtcttttaaggtattctatgcaatgggacaacaatggagataaggagacattttggagcaaaagctaaggaaaaggaagctaaggacgattttggttcaggaatcagcgaggagtgtcgatcgacacactcttggtgtcgatcgacaccagtttcggcccagcaaaaaccctagacgccttcgagtttacaaaagatcaagtttgccccagaagatttccctattagcattattagtcccttgacgtttttagggtctatatatattgtttttagacctaagtttcttttatcaagtcttttatcaagttttctacaaaccatattactgagagacataaaccagtcgtcgattgttttcagagttttattgagatctatatacagtgaagagatccattctttccccttctctatttactgtgtttttgctttcacactcaaatatgttgtttgcttcatccagtatgtctgagtaatcttcttgttaggaatagggtttctcattagggattcatatggtttagtagattgtcccccttgttaggttatctgtagaattcttcatctttaattatgcataatgctagatctggagtaattaactagatcttgaatccagacaatagatatgcccgccataggtatctgtagttggatctattatttgatgagtctggtttataggtacgtaataagaatcggcctatctactaagatgaacaattgaactcgttaagaatgcatatttaggttgatagtttctcggcttctccggttattattagctataaatatagggagtttcgcggcacgcccaccggttattccataattagagtttgagtttaagaatggttcgataacaacctagctttgattagatctactaaccaatagtttcttgagaataccctattcctagctctttattaaatcggttacaacaaaatcaatctgctgtctttttactttgttctcttttattttcactattaccctgctagcttaatctcgacattcaactcactgtttgaacaaaagaacttcgtgaattcaatcctaaaatactgcaattgatctcctatttgagagagtagttttaggtaatttgaaccatatcagtataccaggaacctctgttgcagcaatgcatctcctataaactccatcagaacaatgcttatagagataaggttcatcccaataatatcgcctaatttctcttaggaatctcttcttgttgtaatctgtgaaattatccggttccacatctgcagctaggtaattaataatatcaccataccatgggttatccttctcgatcgctgtgatggtgcaattctcagttggtgaccaatttcttgtcgatttagaagggtgtcgatcgacaagtgtagtggtgtcgatcgacaagtgtagtggtgtcgatcgacaccatcgcgcaacttcgaatgtctacttcctctgaaatgtgagtgtcgatcgacatagtaagagtgtcgatcaacactgaagctatcacgtttgcagtcatcttcttcagttgtatcaatcatgtataagttctcttcaggcaagaaatcgtttatagggacatcatcatcgatcctaatgcgtgataaatgatctgctacaccattctcaactcctttcttatctctaacctcaatgtcaaattcctgaagaagcaaaatccatctcaaaagtcttggcttagcatctttcttttgcatcaaatacttcaaggcagcatgatctgtgttaacaaaccttggatccaacaagataagatctgaatttctcgaaagcaaatagcacagctaagaactccttctctgtagttgcataattcctttgagcatcatcaagagttctacttgcatagtagatagcatgaagtttcttatcctttctctgtcctagaacagctccaactgcaaaatcactcgcatcacacattacctcaaaaggtagatcccaatctggtggctgaacaattggtgcgctgatcaaggctagttttatctgctgaaaggcatcgtaaaactcttgtgtaaactcgaatttgacttctttacagagtaaagcagtcatcggtcttgcgattttgctaaagtctttgatgaatctcctgtagaaaccagcattgccaaggaaactcctcactgctttaacattatcaggcgcttgaagacttgtcataacttcgatattagctctatcaacttctataacatgctcagaaattctgtgtccgagaattatctcatcctgcaccataaagtgacatttcttccaattcaaaactagatgtttctcctcacatcttgccaacactttgtagagattctctaagcaatcctcaaacgatgatccataaactaaaaaatcatccatgaaaacttccatgatatcctcaatcatgtctgtgaagatagacatcatacctctctgaaatgttgtaggagcattacaaagaccgaagggcattctccgataagcaaatgtaccataggggcaggtgaaagtcgttttctcctggtcatctggatgaatcgggatctgaaagaatcctgagtatccatcaaggaagcaatagtacgtatgatttgctaacctctccaacatctgatcaataaatggtaaggggaaatggtctttcatggtagcaacattcagctttctataatcgatgcacatctgatgacctgtgattgtccgagtaggaattagctcgtctttctcattcttgactactgtaacatctctcttcttaggaactacatgaactcgactaacccaactgctatctgaaattggatagataattccttcttccgacagtttcataatctccttcttaaccacttctttcagattcggattcagccttctctgatgttcaacgaagacttagactcatcctcaaggtgaatcctatgcatgcatacatctggagatatacctgcaatgtcatcaagagaatagccaagagctttgcgatgattgcgcagcttgcttagcaataaggtgagctctgcgggattaagagaaacattcacaataacatgataagtagaattttcaccaagaaaagcgtaccttagccctgctggaagtggtttcaaatcgatttgaggagcctttgctggatcccaatctgaattaatagtcggtgttggaatcacagatggaagagcttcttcaaccgtaagttgcatcacatgttctgtctcatcttgcagcttagtatatgtagaagtttcactgtccaaatctgcactatccactatggaagagaccaaaactcgctctagtgggtcttctaattccatctgtgaaatactatctgaagctgatgaagtgaaagaatctatcaagaaggtttttccttctatgatcggtttcttgaccaaagtgttcatattgaactgcatagtaagattgccaacattcagccctatcctcccttgtcgaacatctatgattgctccagcagtgtgcaagaaggatctcccaaagattaatggatccttaggttccttctcataaggcaagactacgaagtctataggaatcatgctctttccaatcatcccgggaacatcaataagaattccatctggaatccgggtagaacgatctaccaacacaagagtgataaaggtaggctcaagattggaatacccaagacgcatagcaactgaacgaggcatcagattcacactagaaccgagatcacataaagttcttggaaaggatcgtgattgatggtgacactaagtacaaaagttccaggatcacgtagctttcttgggattcgttcctgaatgatgtcgctgcccctgctctgaaatcatcatagcactgcattctttcgtcaaattcttagtgaccattggcttaacataccttctaattgtgggagatagatgaatagcttcaactagagccatctcaacaatcagtttatcaatcataactttgcatctgacatcatctaaggcttgtcttgactttttaggacttttggggaagggaattcgccgatttgctgacttggttgcagctggaatttagacattgtctgaacgagctgggtgtcgatcgacaagagctaagtgtcgatcgacaccatcgggaatagtttcctcctcctgcgcgaaattgtcgattccattcgacaaaggaaaaacagagtcttctagagtaattggtgtcgatcgacaccctggtgtatcgatcggcactgattcattgtatgcaattggaaaagatgaaggctgagctgatcattcgcgctgaagtattgggttgagctgctttccactacgtagtgtgactgcattgatagaagttgatgtaggtgaaagattgtagaattgagagcatagattgtcaatcttgctattgagatctgtggagagagaatcatagttgatatcaagctttgtggagagagaatcatatttgctatcaagctttgttaggcctgcaagaagatgcacaagcatagactccattctggtctctgatgagggtggaggcggggcttggataggagtagaaattgcgaaaacaggagtctctttgctcttgatagctttctcagctgaaattcttcgttctttgtcaaatccctgcatcgaaagacaagttaaagcattggtgatgaggagtaatgcttcactagtagttcttgtcatgaagttacagtagctcgctacatcaatttgattctggtatggcttgtctattcctttgtagaataggttgatgagttgggtctcttggaagccatgttagggacattcaagctgataagacctgaaacggagccaagatgctctaagggactctgttggtgcctgagtgaatgaagagatttgcaaacgaattgcctctgtcatggattcatcgaagaagtgattcatgaatgcattctttgtatcagtccaattggttaatgaacctggttccagttgacgcaaccatgatattcctctgctcgcgagagagtgggggaagagtttgcaaagaaggtcatcagcatggtaacccttctgctttaatagaggaaacgatgtctacgaagacttccaaatgatctaatggtgattcgtcgggagctcctctaaactttcctcttgatacaatatcataataggcagggtgtatagcaaagtcatctctttctaatggaggtagcttgaatgctgatcggtttgtgtagaagaggtcaattctgttaaaatcgcctattgtagcagtctggttctgcagagggtgtagatcgacaccctgatggtgttggtcgacataaccgtgaaagtctgccatgggaacgtgattctcaatctgaaggtacctgaaatacaagagaccaaaagacaaagaaacacgtgaataggtggtagaaaagtagtatctagacttaatatgacacctagtctaatggtgaactaaaagagaacttcggcaacgacgccaaatttgatatagctcaaattgccttaagcttactccctcaaataaaagatcgtctttagcacttaagggtcgaattccactgagctctcgatgctcacacaatggacttatgatgttgtttaataagctaaatgaagtaattgaatgtaaaagacaaataagcaagtaaatgagttgtagattcaagtgattaaagcatcgagtctaaggaattgtctcgggagatatataaattgtagatctagctaatatcaggattgtaatcgcacgattctcaaactcaaactatgattctagagtaaccggtggcgttccgcgaaactctctatacttaaagctaagataactagagaagccgataaatcctatgctaaagtatgcattgttaataagcttgattaattcacctagtatctaaaccagagcccttctatgagcctacctgttctttcttaaacactacaagaaaacagtcgatttgcaagggaagaattactcgctaatccctcgcaaacagctaaaagcaagggatttgtgaggaaaacaagttcctcgcaaatcgcttctcgcaaatggtaaaatatcgcaattccctcgcatattttgcgaggaactgttttcctcgcaaatcacacgcaattatcgtactagtacttccctcgcaattactgcgacggatttgcaattcttttttttcgcctagcaaatctctagcagaatttgtgatggatttgcaagcgttctgcaatgttttctgatatattaagacttgattagtgtctgattagcctctaattacctagttaattagttgttaattagagatgattttgtatgcaattcaaagctgaaatttcataaaaaaacttgttctaaagagataaaacacacaattgaagctgaaattgcataagtaaaaaatgtatactaaattgtttgaaaccataagaacttgttctaaagaaagagataagaaggcaaaaaagaaagacaatgttttcaaaatacagttgatggaggagaggatcctattgcaaggttagctagggcagcaactgttgtctcctcattagccacctgctgttctggagcagtagccacaggtggagcatttgcgttggcctgtcctgtctgtgtcgaggaaccacgtcgaagaattgcagctaaagcaggatctttatcagcaagatagtcaaacaggatgtcgaagctattgatcctctcagcctgagattgaatgcatgcttcagcggcagccagcttctgagaaagtataaccggatcatcactaggaagcgttggaccactatgggctgaggatgcttcaaactgcagagatccaaccccataaatcctttctttctttcgtggagcaacctgcaaagattacaaaaacttacaaggacacaacaaaaaaaccatgagaaacaaagttcaaaagaattcagacacaaagtataatgaataagctgccaagattacgagaactttatatcaaacactagagacacaacacaaacatttcagacaagtacacaacacaaacacttcagacaagtacacaacataattcagaaaagtacagaagtacacaacagaacagaattcaactgccaagtacacaacataattcacacaagtacacaacaaaatcagacaagtacacaacacaaagaattctgacacaaagtataatgaataagctgccaagattacgagaacttgatatcaagcactagagacacaacacaaacatttcagacaagtacacaacacaaacatttcagacaagtacacaacagaattcagacaagtatacaagtacacaacaggacagaattcagctgccaagtacacaacaaaattcagacaagtacacaacagaattcagacaagtacacaacacaacaagctgccaagaaaaagcacagaaaatttacctcagtaaaaatcttgttcttggcatgaaaagataatccacctgatccagtgctctccggattgtccagtgagcacatatgagactcttcctcttctatcctagatgtcacttgcttgtagatctcctctgacttcccatcgatgaaagttccatccgcttttctgtgtgtctcatctagcagctcaaggaaatcaggagttgtttctccagtttctcacactgaaacacaaagagataaacaagttagattcataacattgtagattaagtaatggtaaggagagaagactacttatcttacccgttttcttgcacgagctttgtatgaggtctggcctgaacggtgtttatatatgcccttgccttccggatcatgatatctagcatttctgctgttggtactctttttttctgacttaggatcttgccaaaactgtactagacctttccacacatcaggatcaatccattttggcttggcttcatcacccttctccttccaatttcccttccatcgtgacacttgatcagacatcctagactttagctttgcttcaaactcaacccttactcttttgttaattgaacggtcccagttatatacttgctacaaaacagacaaagcaaacatcaaactatgaaaccaaacaacaaaacaagcataaacatcaaaagagcacataacttaccgcaaacgtttcataccatcgatcgattgtagcctttgatgtctgtgaccaattggcatgaggctctttgaaatctttttcacataaggatctctatgtctttagaagtctctggaaatgtttgtacttctaagaaatctctttgaaacctcttctaaaaaatctctttgaaatctctttcacataaggatctctatgacgaggacatcgtcaaacctacaacaacaacaacaaaacacataaggatctctatgtctttatacttctaagaaactacaatgctaagtacaaccaagctaattccagagacttctaaggcagaaacaaacttctaaggcataaccaacctaattccagagacttctaaggcaggaccaaacttttaaggcagaaccaacctaaatccagagacttctaagggagaaccaaagttctaaggcagaaccaacaaccttacaagacctaaatctagagactatgaatttaaccttaccagagagttcccgtaggacgctttgggtcttatcttgtcaagccagcacgaccaggactatcgaggagctcttccagtgtcagattgttgagacggtcaacttgagcatcagaatgattgacataaggctgagtcgttggcgttggaggcgatggtggattggtggaacctgaacctggaacctctgagatattcccaccactaacagaagaattgacatgcaacaggtcacgctgatgttgtctaaaccgtacataagtattatccgacggcatcttgcacaaaaaacaaatcaagagttagatttgggaaaaagaagtaagattggagaagaagaagaagttagatttgagagaagaacttagatcggagaaacagaggttacctttgaggcaaaatagatcgagtcagagaagaagagacgcgacggtgattgcatactgatcggagaagaagagaggcggcaatgagtataacagattagagaagaagaagagatgcgctgacggaatcagatcggagaagaagagatccggcgccgaagagatcagagaagaaaaagagaatcgaagaagaattttagggttagggtttgatgcggctggtttgagctttgctcaaactaggtcttcgagtatatatagatatatatttcctcgcaaaaccctcgcatagattgctttgaaattgcgaggaagatttttaaaccaattaaaatgcaccacatactgcgagggaattgcgagatcttctagcaagtccctcgcaacctttgattttaaataatttaggatttagggtaatatttgcgagggaagtgcgagtgcgtctagcaattccctcgcaatccttaaaccaattaactccaccattttgattcagtgtttgactcagatctgatttagattctcttatttcgaataagactctcagcaaataaaaacatgactaaatattttaaataatttaaggtttagggtaaatatttgcgagggaagtgctacgacagccttgcaaatccctcgcagagacctcgcattgttgaatcaatttgaaaaaatacaagaaaactttacttaaaatcattcggattcgttattctgaatcattaggaagttaaatatctacattagaatctaatttcatctcaaaaacttcaaatgtgcattttcgccaaagatatcaatgatgaacttatgtgttttcaataatttgaatcataagtgtttaacattttcaaaatgaaatgttaatattgaaacatatacaatatgtttttgtgcatcaccatataatcaacttgtatgattatacagtcatttagatttacatttataaatgaaaatcaaagatcccatatcacttctatgtattttagggtttagggtaaagatttgcgagatttttgcgggtggtttgcgagggatgatatagttcattgcaaagtactcgtactttcctcgcacatttgcgaggaagcagtttctcgcaagatttgcgagggatttgcaacgtgcgtccgtggtctagcaaaatacctgcaattccctcacaaatttgttcctcgcaaaacgactgttttcttgtagtgttaaatgcctaggctcatgtatgatagttcaaataacaagtacctatggcgggcatacctattatctaatatcaagttctaggtgatcaatcttaaactagcaataagaataatcaagatgaagaactctaagaataatccaaaggggttttcgatctactaatccatctaaatccctattgagacttcctaaacccaacaaggtgataacctagacacgataatagaaacacaaatcataatctgaatagtttgcattgatgaattaagaataatagtaaaagagatcagaatcctctctaaaagaattggattcttctctcaaaaatgtgtaacaaaaactaaaacaaaacttaggtctaacaatgaccaaacaattaggtatattcgtgactaaaaacgtgcagggactactttgcaaataagcaagacttcagggcttctcaaatacttggtcgaaaacgaaaattccttaggcagcaataagagtgtcgatcgacacaggtgtggtgtcgatcgacaccagcttctgaaaaacgtcgttcaagatcttcgttgctgaaaagcttccaaaattccttattgtgctccatagttcccagatgtgtaagtgtacctaaaatgactcaaaacatacgaaaaaggctacaaagactctaaaaaccattctaaaactatgttagaaatcagtaaaaaccaggacatatcatgttacatgatgtgggcagtctcgttggtactccttgaaacgaacccaagcagccttaaaagcttcagttggaccctgtgtgatggtagacaacttgtttctcaactcctcatacttagcatcatcgtaaaaattgttcaaaaaggctatcttgatgcttctccaagtcttgagggaacctgctttaagttatttcagccaagaagctgcttccccaacaagtgaataaggaaaaagcttgcacagtaggtagtcctctgagactccattagccttgatgctcagaacaaggtcctcaaagcgctctatatggtccattgcctgctcatgagataagccatggaaaggatgctggccaactaaagcaaagtagccaggcttcagctcatagtcgttcctctggaagggtgtgggtacgatcgctgatcgattagcaaagaacaggtcaggccagttgaaatccccaagagtacgacgtggtttcgcagctgaaggaatagctgcaggaatctggtgttggtgttgatcgacacctatgttgtttcgttcgacatcaatcgcatcgtcattcttctcccgagggtgtcgatcgacaacgagccctactgcatctctggcagctaattgcgcgttgaggcgcgcctaatttgcatcgacgtcctcaagtaggatgattccatgataatccaatctttgaccagcctcattgtaggcttgcccatcctcatcagctcctatgactctttcagccattgctaatctctaagttttcccaagtccaaaatagacaagttgataagctccttctattgtgtgctccttgtttgcctagccatacacctgaaacacagaaaagaagaaaacaagaaaagcgtgagtaacaaaataaaagtaaaagctagacaaaatctctaaactaaactcaatgaatgattcccaagaacttcggcaacgacgctaaatttgatatggttcaaattacctagaactactctaaaataagagatcaattgcagtatttaaggatcgaattcacagagttcttttgttcaaacagtgagttgaatgtcgagattaagctagcaggtgatgattaaaataataagtacacaaagtaagaaaacagtagcatgattgtgttgtaaacgattaaataaattgctaggaacaagatattctcaggaaactattggttagtagatctaatgaaagctaggttgttatcgaaccatttttaaactcaaactctaattatggaataacaggtggcgttctgcaaaactccctatatctatagctaagaataactggagaagccgagaaattatcaacctaaatatgtgatagtaggatttttactcaattaatcctaaaacactatcctgtcgttgtagtattttaggatgtcaatccaatccggtgtgatgcaaacagatgagatatgatcagaaagctctaagtcaagccaagcagagagttggttggttctaacagtcctagtatgcaataacagaaatgaaatgaaactaaaagcagaaatggcaatagtaggcaagtgaatgacaaagcataaatgataacaggaaatcaaatggataaacgattcctaaggatagggtaatcgaatagcgtggtctacttaatctattcaggcggttgacaaaacttcacagaagctatccctagacaacaaggtcaacaacagattaatccacttccgtgatagaaatcctcaagcaaagctagacactgacctaaatccctttagcgatctctaactaagcaggcactatcgaatcaacatgttaaagttaataccctctcttcagccaatcccttggggtagagtcagatatctctggaattaataggatccaacgcccattaaacgccttctgagcgctggacgtctagactcatactccacattagccagtgaaacaagcaataagcgcaactaatccagaagggattctagtattctaaactcaaccacctaaaacgaccaagtaaaccacaactattctatcccatcctcagaaatacatttcactactcaaacataatcaaagacaatagcaaagcaacaattgaaaacatgataacagaaatgacgaaagacttaaacaaaaactgaataacaaatatttgaaagtgaaaatacaaagtcgcaagagaaaaactccggctatcaaagttgcgaaaatgtaaaagcgagataattatggataatagcggatgccctagggaaaaccctaagaggcaatttatataagcgagaaataaaacaaataaggaaactaaatatatagcgaatcttcacgtcatgatcttgcgaccgaatgtgtcattggcatctcacgggctgaaatgagcttcctagtgatcgagtgataggcatgggacttcctcccaagtgagcttgttttaaatctctagcttgactcctcacactcattaggctcaaggagggtaatagagtagaattgacgtctcctctccttccttagtagatacaacatcaaattcagcatgctctcgtgacaagtctgtaagtgagtactcaatggccctttcttggtaagctcctttttcatcatcttgatagtcgtcttttctggactgttttgatgtgaattcacatccttcttttctaaccataggaataacttcatcatttgggacgtccttgatgtcgagtggagcttggttggctttcccatcgagctctttgacttgatccttcaactctttcacattgtgtgttagctctattatagctttgtcgtgccattttgacctctccttgagttctaaccaatcatttgatgccctcacgcttgactctagctgtttggttgagcattctagtcgagtatcagttgagccttcctcgttcaatgtaacatcctttgtttctgacgcaatgtcacctttaaatatctctgatcctggtacttcgttgtgtgagtctaatgacatctcatagctcaaggtctcactggagagaaatccagtttcactacttttggttaaagtagtttgaaggtgatctctgtcaacaatctcctctagcagttcattacctagctgatccatttcctcaactaagaaggtttgtccttctattgttggcttcttcatagcgtccctgatgtcaaacttcattttgacatcctctcccagattaagattaatttttccctacttaacatctattactgctccaactgaagccaagaaaggtcttcctaagatcagaggatccttagatttttcatccatctcaagcacaacaaaatcagtaggcacctctactccattaatcattacttacacgtcctctaaaaggccaaaaggtctctttgaagtcctatcagcaagaatcaaggttaggtcacaaggcttgtattgaacgaatcccagcttctttacaacagagagtggcattaagctgactgaggctcctagatcacatagacaattgttgaaagtcaattgcctaatggagcatggtagagtaaaagatcgtggatcttccaacttttcttgaacaatcttcttctgagtgattgcactgcactcatgacttaacaccaccattccttggacttctttgatcctttctgtaatcaagtctttcacgtacttgtgctcgtcaggtattagcgcgagacagtccactaaaggcatatcctttatgtgtttttccaggagggctctgtattttgcaaccagaactttcttgaaacgaccagggaatggaagcagaggtttgtaaggcagtggcacgaagactgtgtctttggtctttgtagcttccagtttttcaacaaagggagtagctaggggagcttgtggtcgagtgggttgactggtgagtatgggctcttcgattaggttgtcagccaacacatcatcttgataaaaatcctccccctctagaattacactttcctcagtgtttgatgtagggacatatcgagttggcagctcgcgatcatgtgtgatagtgatggcatgggcagtggcatactcctttggattctggattgctttccttggaagctggcatgggttgttgttaacagatggtgaagcgaggatgccttccacatatctcatcctagtgctcattgattcgaacttgctgttaagtttgatgccttatcggtcgactttgttgtttacttcagacagcttcttagcgatttccattgctcctgtggcttgtccttgaatgagctggtagagcacagtcattatgtctgaattctgaggcgcaggtgcttgttgttgatgtggtgtgaaaccaggtggtggttgttgttgttgatatcctccttgaaactgctgctttggaacgaacccttggctttggttgtaaggaacaaacggtttggattggttctgctgctgctgctgagtctagacttggtcctgagggttggcgacattggtgcttctgtatgacagatttgggttgagtctatagttattgtaccccttgttgtagccaccttgattatgaatatatctgatttcagcacactgatcattctccccctcttgtacttggaatggttcatctttagagatgaagtgaacatgtttctgttgcatttggatgattttgtcaagtttgtcattgagaggtttcatctctctatggtgcttgtcatcagtgtcagaactggtgtagatgcttctgtcatagtcttcattgtaattgccatccgattgagcaaagttttcaactagctcccatccttcttcaacatccttcttcagaaaatttccatttgaagcggtgtcaaggagcatacgtatcttaggcaggacgcctctgtaaagtgtgttgagaagagaagcttgggtaaatccgtgatgagggcatttggtttgataacccttaaagcgctcccaagcttcatagaagctttcattttgcttctgagtgaatccggatatctcattccggagtcttgcagttctagagttggagaagaattttgccaagaaggcctttttgcactcatcccaggtcgtgattgaattctgggctagcgtcttttcccacagatgggcttcatctccaagtgaaaaaggaaacaagcgaagcttgaaaccatcttcactaactccatggattttagtaaggccacagagcctttcgaactcgtcaagatgatctagcggatcctccattggcaggccatgaaacttgttcccctgaaccattgcaatgagaccgcttttgatctcaaagttgttgttctgtactggaggtgggacaattccatgacgctggttgtggttgtgagggaaatcaccagcaccaatgttggtaggttgctgttgctcatctacaacgttagccattgtgtctgtgtctgtctgttctctcagttggcaagcaatacggtcgatgttatcgttgaataggaggttctgatttccttgtgaccgtgtatgcatgcaacagatggcagcagggctataatcgacgaatcagagatgcgtttggaaagcaggttacaaggtacctgaaacacaaagacagaaaaggcacaatgttagtaacttcagtaacaaaaacgaacttgatcttaacgtttctaatgatctcaaatatagcaaacaaacaccgaactggaaacggcgccaaattgatactaggatttttactcaattaatcctaaaacactatcctgtcgttgtagtattttaggatgtcaatccaatccggtgtgatgcaaacatatgagatatgatcagaaagctctaagtcaagccaagcagagagttggttggttctaacagtcctagtatgcaataacagaaatgaaatgaaactaaaagcagaaatgacaatagcaggcaagtgaatgacaaagcagaaatgataacaggcaatcaaatggataaacgattcctaaggatggggtaatcgtatagcgtggtctacttgatctattcaggcggttgacaaaacttcacagaagctatccctagacaacaagttcaacaacagattaattcactcccgtgatagaaatcctcaagcaaagctagacactgacctaaatctctttagcgatctctaactaagcaggcattatcgaatcaacatgttaaagttaataccctctcttcagccaatcccttggggtagagtcagatatctctagaattaataggatccaacgcccattaaacgccttctgagcgctggacgtctggactcatactccagattagccagtgaaacaagcaataagcgcaactaatctagaagggattctagtattctaaactcaaccacctaaaacgaccaagtaaaccacaactattctatcccatcctcagaaatacatttcactactcaaacataatcaaagacaatagcaaagcaacaattgaaaacatgataacagaaatgacgaaagacttaaacaaaaactgaattacaaatacttgaaagtgaaaatacaaagtcgcaagagaaaaactccggctatcaaagttgcgaaaatgtaaaagcgagataattatggataatagcggatgccctagggaaaaccctaagaggcaatttatataagcgagaaatgaaacaaataaggaaactaaatatatagcgaatcttcacgtcatgatcctgcgaccgaatgtgtcattggcatctcacgagctgaaatgagcttcctagtgatcgagtgataggcatgggacttcctcccaagtgagcttgttttaagtctctagcttgactcctcacactcattaggctcaaggagggtaatagagtagaattgacgtctcctctccttccttagtagatacaacatcaaattcagcatgctctcgtgacaagtctgtaagtgagtactcaatggccctttcttggtaagctcctttttcatcatcttgatagtcatcttttctggactgttttgatgtgaattcacatccttcttttctaaccataggaataacttcatcatttgggacgtccttgatgtcgagtggagcttggttggctttcccatcgagctctttgacttgatccttcaactctttcacattgtgtgttagctctattatagctttgtcgtgccattttgacctctccttgagttctaaccaatcatttgatgccctcacgcttgactctagctgtttggttgagcattctagtcgagtatcagttgagccttcctcgttcaatgtaacatcctctgtttctgacgcaatgtcacctttaaatatctctgatcctggtacttcgttgtgtgagtctaatgacatctcatagctcaaggtctcactggagagaaatccagtttcactacttttggttaaagtagtttgaaggtgatctctgtcaacaatctcctctagcagttcattacctagctgatccatttcctcaactaagaaggtttgtccttctattgttggcttcttcatagcgtccctgatgtcaaacttcattttgacatcctctcccagattaagattaatttttccctacttaacatctattactgctccaactgaagccaagaaaggtcttcctaagatcagaggatcctaagatttttcatccatctcaagcacaacaaaatcagtaggcacctctactccattaatcattacttacacgtcctctaaaaggccaaaaggtctctttgaagtcctatcagcaagaatcaaggttaggtcacaaggcttgtattgaacgaatcccagcttctttacaacagagagtggcattaagctgactgaggctcctagatcacatagacaattgttgaaagtcaattgcctaatggagcatggtagagtaaaagatcgtggatcttccaacttttcttgaacaatcttcttctgagtgattgcactgcactcatgacttaacaccaccattccttggacttctttgatcctttctgtaatcaagtctttcacgtacttgtgctcgtcaggtattagcgcgagacagtccactaaaggcatatcctttatgtgtttttccaggagggctctgtattttgcaaccagaactttcttgaaacgaccagggaatggaagcagaggtttgtaaggcagtggcacgaagactgtgtctttggtctttgtagcttccagtttttcaacaaagggagtagctaggggagcttgtggtcgagtgggttgactggtgagtatgggctcttcgattaggttgtcagccaacacatcatcttgataaaaatcctccccctctagaattacactttcctcagtgtttgatgtagggacatatcgagttggcagctcgcgatcatgtgtgatagtgatggcatgggcagtggcatactcctttggattctggattgctttccttggaagctggcatgggttgttgttaacagatggtgaagcgaggatgccttccacatatctcatcctagtgctcattgattcgaacttgctgttaagtttgatgccttatcggtcgactttgttgtttacttcagacagcttcttagcgatttccattgctcctgtggcttgtccttgaatgagctgctagagcacagtcattatgtctgaattc

SEQ ID NO: 205 - DNA, 85682 bp, Arabidopsis thaliana
  modified_base (85362)..(85481): N = A, C G, or T/U
gtttcaactgtagtagctcatttatatgctcagttttccataataaatgagtcttcatggacttgcctaatccaaattcataaatatctatctaattcgatggtgattgagaactgagaagtaaacaatggtactcttattgtctgtttttcttccaagaagttagttcagaaggaattgattcttcattgcaacttaaaacagctttagccatgagtttcccaagctatgcatgatagagtaaagtaattggccaaaaatatgttaaatagagaagcaattatctctcaacaacacaagaacaaaatgaaattgagagattccgggagcttcagaaccagttcaaaattcaacaacatactagttttgtaacccgaaccagtttaaaagaagaacattttgagtcaagttcaaccatggttatttatttcatttttttttcaaggtaacaacattctactaataacaacattaagaaaattttaatttacatatacgttcagattacacttttactttatcaactattctatctgcatctttactttaactatcggcactagattataccattcagcaatcttcaaacgctttcctaacattggcgtgacattttaactaaggacaacaaaggtggagaatacattagtttgaagcaagcgtaaaagtttactaagaatcttcatcaaatacacatgacataagcttctctttctactttttgcctacaaattaacttgataatattaaatattttgttttgtttggtcatcgctgctactaaagaagagagattgcatgcctagacgatcaagctttgcggacaatagaacgtctctctcgctggtactcaacttcacctctctggtgcattatcaacaaagctctcctcacctgccattttaacatgcacattacctcaaaaatcccattcacattactgaaaattaaacaacaaagatgttagcttaggtaccattgaatcgttcattcccattctagccagatcctctatcagtcttctctctgataatcgagctccgatccccattcttctctttatctgtgtttccgcttgctgttttttcacaccaataccaaatttagttattacatctagagatacgatgattctttcttccccacaagcaactaaccttgatttcattggccatctcgcctgttatgtttatctgttgatttatccctgatcttgctgcatccattgtcgaggtatcaaaaagtttaaaagctttgtctacatcatctggtgtggcctcgtgtgacctgacatatttaacaatgtcaatggacggcacatcccatcaggtttcaggaatcaggaatctctatgttaataagattacttacagtctcatttttgcaagtgactcactcagtctgacaatagcttcgagttgtctcactgtgataggtatcggagcagcctctcctgtttcatgtgcacgtctcttcatatcctgtttagccgaaaattttatactgacaccaactttgttttttaaccatcttattgtcaaatctaatgtaaatgacaattaccattctgattgtgacatatttccgctgcaggttctcagcagcgtcttttgagagacggggatgacaccttgctcgacagtattgtatatacctaacataaaaagagcattatattttagagtcatgattttgtacagaaaactgcgagaacacattgttttctcgacgaatgaaaacacaccttttgagccaattatcttctttagaatctgtgttttcatccgaaaatttgtttgcagatgcatgaacccttataatatggctggctatttcctgtgaaaagattataaacattaatcatgtctacataataagcaagcaacgaagcaaactttccaataacagtgacctccatcattaatctctgttttcccttttaactacataaaatttctgaaagaattgttcctttccttgcttaccttgtcttgggaatacttcctgatgtccttgacaatgaagataagatcaaatctagaaagaattgttgtctgcagatcgatattgtcctgagcagtctgcaaatccaaagaaaaaaaaacacacccatctcttaagaatattgcaaacaagaatcgggaaaaccatgatattgccaaaggagagtaccagatttcaaaccttaaggtcatcatatcgaccagatggcgggttagcagcagcaagcaccgaggttctagaattaaggacagttgttatcccagcttttgcaatggagattgtctgctgctccattgcctcatgaatagcaaccctataaagaaaaaaaaaacattccatcaattctactcatagagaaaaattagattcgtcaacactatgattcagatttgaattacctatcttccggtctcatcttgtcaaattcatcaatacacacaacacctccatcagccaaaaccatagcaccaccttcaagatagaactctcgctgcaatgaacatatgtataaataactgagaatctgtcatagcaactacttttaaacaaatcatagaaaaacacttgaagataggacatacagtgctgctatctcgaatcaccgaagctgtgagcccagcagccgatgaaccctttccagatgtataaacagcaattggagccgtcttctccacaaacttaagaaactagagagaaaaaaaataagcaattaagctttaaacatgtaagctacaggtgttggaaataacacagacattttgtaaggattgtaatctaacacttgaacagaaggatgtaagacgaatatcaagcaaataagagagacgtaagaaaatataaaaagaataacacacttattataaaccattgatactgagaccacattacaaacctgtgattttgcagttgatgggtctcccaaaagcaaaacattaatatcacctcttagtttcactccatcgggcaggctctgaatcaaagatagaaatgtatataaatatatcaaaaacgtatacaaagtgcacagaaaataaaaactgctatcacagtttcctaccttcctggatcctccaaagagaagacacgcagctgctctcttcacatcctcatggccaaatatagaaggagcgatcttggtgcaaatgttcttgtatacatcttgactatcagcaaactttttgaattcttcctcctaaaagtaatattatggaagacaaaactgataaatggaattgtacaactaggcttccaagcaggcctaaatgtttcatagtaaactagtagcacagagaatatttccagaaaacaccatcacattcatttgggagttacacaaagaatttcatagagccaacagctacctaaggcatttggtttccagtaacaataattcagccatgttaacttcaatagttcattgtgaaaccatggatgacataggctatcaaatgagaaaacaaaaagaaccaaatgatgcgatactaacttcgtcaggagtgaagttggcagggccacgggaactggcctcatttgtgtcttccagtccaacaactcggatataaggctggcgaattgcaactgctcctttatgcctacatcagaaagtaggaaaagatgtccatcattgttgtggtgtaactctcccagaaaacaatctacactctcatttgacataaaactacaaagcttacgagttagatgatgacgaagcttggaaaatgctgtagatacccattactgtcagtctggttccaggtacaattgtttgtacaagatgccgatcaactgagagaagcatatttcttggaagctctccagtaggaacatccttcaaaactcagaagcatttaatatatacaagtgcaaaaaaagcgaaaacattacaatgtaaatctatacctccggattctcctgtagctttaaggtctgttgatcaacatactggctcctatcaggaaccaccatccaaggatcaagagggcaaggctcctctccaggctaaacaaattccaatttggtctaatcaacaccaaggataactacaaactcaaatcacaaacgaatcaaaagaactcacctgtggaatattatcacatgatcgaggaacaattgccccaccaagacccggacgacatggaacttcccttgtctttttacaattcttacataccaaaaacacataagtcgcctttgctttcactctcgaagctgcaatactaatcccagagattttcaccaactttgagatgtactgtgcctatcaagagtaaagagtacattatagacataccccaagtaatctcattgatactaaaaacaaaaaaacagacataccccaagtaatctcattgatactggatcctctcttgaagtgagcaaaatctgcacatctctagtcagaggttcctccattacccctccctcattagcctccctcattttcaatccagtcaacacttcaccagctgctttctcaaactacaattcaaagattgactcactcaatacaaagcttatatgaaccctaattttttttgaagtcataccacagggagataatcggcaggagcagatcggattaaggaggggagatcggaatcaaaggagaggagatcttcgaggtggacaacaagtcgcttagggttatcgaggagagcttctctgtaggggaaacaattctgttcgatctcgaagtttcgaatgaattccttaaatttggttaagacggcgtggggactgatggttgcggcgtctccggcctccgggaactgcggctggtcgctgtagtaaactgctccttcgtcccatcctgacatcgttgcttcgtctccgttacgaatttctctatctctttctctcttatcaaaaagttctaaacgaagagagagagtgggggcaagggctttatgtcgactatgagttttggcgggaacaatgtggcgggaaactgatgggccgaacccaagacctatggacgggtaaatggatttcgttggttattgggtctttctttctttttctttttagctaaggttacattttttatccattttttctaatttattataaaaaaccaaacagataaaaatataattatggactacatctaggaatcttaaatttatgaattgcacattttagaatttcatatttttaagctacttaatatcgttgtaagcattttcaattccatcgtaattttcttcaatgtcacttaaaatttaaggctatattaatatatatgtttaaaagaatagtttttagttttataacattaataatttgaaaattaagtaactataaaaaagaaaagaaaaatcaaccatatatatccttctcatttacgttaattacagaaatgtcattaacatgataaatgtttttgagaatattaggtaattggacacttttttgaaactcaattacgcaataaagcactttagaaagagtaaacactttttaaagtttttttactactacaccatcaacccaacctaagcaatccaaacttaccataatttacaaccattactttttctctcttttcattcatttttttctctactctttacaaaattaaacacacaaaacacttaaaatatcttaatgaaaaaaggaaatggtttgagacattatctctcttctctctcatcaaaaacaccaaaaagtagatctagatttttcttttttctttctcttcttagatcttaaaagttggaaattttcaagatttttattcagtttctcattctttaatcaacctcataaggttaaaattttcatttttaattgctaggtttcttcttctcttagtgtatccatcattgtcttggtcaaatttttgtctttttacaaatcttagatttggccaccaaatatttgtggaaattcctcaaagagagagagagagttgaattaaagaacccaaacatatattcttactataaatttgtaacttaaaggtagtttgatgctattttcattaaaacacatgagcaaataatgaaaaaatggaaaaaatacaaaacaaatcaaagaagagtgataggcgataatttgaaatgaccacatggtcagagtttggtggatgtgtgttgacggtcgataattcaaaatgattgtgttttgttaatactattcataaaaccagtgttacgttatgtaaaagatgttgataaaatgtgatgaaacaagttttgttggtcatatcaacaaaagtttatttatgaaaatgtttatatttatttatccacgattacatattaacaaaacataaatacgagtgtatatcgtaagattgtgtatgaacacatcgatctcaataatattttacgttttcaggttaagaagcgtgctttagattatcatggatcaaaagtggtggttatagattatgtacatataaaacttaggttttagggtttaggctttaaagtcaagggctagggtttaatgtctagggtttaagatttagtatctagtgtttacattttaggatttaggctttattgtttaggatttcgcgtttagtttagatgatttagggttttgggttgaagaatcaaagttgtctacaatgatttagggtttatggttacatgtttctcattggagattatatattccattgttgtccatatggattggataatatggattttctatctcaatttgtttatatttaggggatttatgtttaatatttatggacaacaacaagaagttttaaagtgaagatcttagaatttagggtttagggtttagggtatacgtgatatggtatatgtatattgttaagggtttagtctttatggtttaacaggtttagggtttaatatcaagggtttagagtttagggtttagggtttagggtttaggggtttagggtttaggatttaggatttaggatttaggatttaagatttagggtttagggtttcgggtataaatttaggggttagggtttaatgtttagagtttagtatctagtgtttagggttttagatttagtgttaaggaactatgattgtttacaatgattatagagtttattgtagatggtataaggtttagggttaattgaccatggtcatatacaattatttttgggtttagggttatatgcttcttgttagattatatatttccattttgatcatatgaattaaatcatatgaattttttatgttctcaattggtttatgtttaggggatttatgcttaatatttataagcaataataagaaggtttaaaatttagggtttatatggtaaatggtatatgatatatttctatggttaagggcttagtgtctatggtttaaagtttagggtttatggtttaggtgtttaaggtttagagtttagggtttagcgtttagggtttaaagtttagggtttagggtttagggtttagggataagaggtttaagcttaatatttatgggcaacattaagaaggtttgggatttagggtttatggtatatggtatatggtatagggtatacgtatatggttaagggcttagtgtttatgggttaaagtttagggtttagggtttagatatagaagttagggtttaatgtatagagtttaatatctaatgtttagggtttagaatttagtgttaaggaactatgattgtttataatgattttagagtttatggttatatggttctcattaaagattatatatttcattgttgtccaaatggattaaatcatatggattttttgttttctgaatctgtttatgttttgatgatacaataaataatagtatgaataaatatagtaatatggatttcatgaaggaaaaaatgttattattatatattttataaaaaatgatttttaatcaaatagagaatgtcttaaattaaataaaaattaaataacaaaaggaagagagagaagaaattgacaagaaagataagaaagtgatagatagagaaaatatgttttatttatttaaatttgacggtcaagattaaaagagattaactttacctttcaattcgatggacgagatgattccgtcaaaaccatttcttaaccatgctacttgatttaaggtgaagagaataaggggtaaactggtattgatttttttaaaatagtgaaaaaactccaaaaaagtgtctattctcttcaatgtgccctaaatgcactaaaaacttggaaaatgccccaatcatgaaagaagcccaattttttctgacgtaatatgtggcgacacagttcataaaccgctcgataacactgctcacatgcgaccgaaacactattcatcagatgatatagtaaaacatcatatgatttaagcatttatctatttgttttatatgctaaaaaatatgatatcgcgataagtttacttttaaacaaatcttttatcgacctagaattgaaaattaatatatttttatttatgtaaatatcagttcaatttaaagaattagtttatttcttacataattaatataatagcagttaaaacaacatgttatataaaataataacatgctaacatatttaatatctagataatatttgtatgaacgtgccatctcaatccacgttttcattcacgccacctctttttttgtcaactcaccaatactgattttaatatctttgtttcgatttgattttatgtttccattattattcttatagttttgtatcgtcagaaattaaataaaagagaaacaaaagaaagaaaaaaagaaaagagagaaaaggggtaaaagagtcaaaaagaggatgataaaaagaggataaacaaaaaagaggatgatagtgacatgtgcacagtgatcaagtggtcaacctaattaatgagtcgttcatgtatatctattgatattaccctaaaatttaaagatgtgattcaactaaataaaataagtttattacaaaaatataaactttttattaccttctaaattcacaaaaccacgtagtcaatttcaagtataaagcaaggttttgacaatttttagaataagacaattttttttacaaagatttaaccacttacatccaatactaaacgatgattttgttactattgtggtgattaaaatgctaaacacataaagacgctcataacctccatgtacgttaaagacatcaaatctaaatatttttccaaatttgatgttgtgttgtcaaaaccaagctggatgctcctcttaacatcaaagagatcatgtatgatatagacatactaaattaaacaagtatgattattatactatgaacttgaaatgtgaattgatttaagaatttacacccacaacctcatatctatcccataactagaatggtaatgtactaatcccgataatttagcaaacttgaattaaatcttcctagccatctcttctactctcaaatcactaataaggttcaaattaccctagaactactctctcatataagagatcaattgcagtatttaaggatcgaattcacaaagttcttttgttcaaacaataagttgaatgtcgagattaagctagaaggtgatgattgaaatagtaataaaacaaagtaagataacagcaggttgattgtgttgtaaaaaattaggaaaagaggtaggaacagagtattctcaagaaactattggttagtagatctaatgaaagctaggttgttatcgaaccattcttaaactcaaaccctaattatggaataaccggtggctttagtaccccgcgcattgaccccaggcaagaaagaagggcaagagaagaagaagagagaatggtgcgtgaaatgaaaggaagggccgagtatttataatccgcggaagctagagtagagcccaagtcttaaaacgtggagccgaatccattcgggcaaagccgacttggtgaccaagttttgtcctgagcaatgcacgccaactttagccaacttggtgagcaagttttgtcccaaagccaacttggtgaccaagttttgtcccactcctcatatccgaaccttgagcctataaatagaaccttacccccccccccttagttacaccttagaagctttcgcaccaaaactctgcccaaaccgagagggagagagagaaatcatccgaacccttaacccgagagagagagagagatcgtccgaaccttaaaacccgagagagagagagagagtctgagcaagagatcgtcgagccttaggatagtccgaaagagagatcccgagtagaaaccatcggtcgagttaggaagattcatcggtgattgtgagttccggtttttgttttgcatgtttgattttccttcttgcatgttctcgattctcccttctcttagttttgttgttgttatggttgagtttgttgaggttgttaacctaatagctaggatagttgagaccgaagcaccttgccctataggagtggttgtgttagaatagcaccattcactttagagggatggttgcattgtcaagacactactcgctagtattcgggagacatttagagagaactttatgaacatgtgcgttgaaaacgaaccgcatgtttcatagtgttgattggaagatcgtagtgtgtggagcttgaagagtatctaagttaactccataagcatgctacggtcaagtgggatgtatctgacctttccttgtgattctgttcgttcgtggggtgtgcttgacgagatgcaagtgacctcaaggggttcaaaggacctatagagactgggttagctacccaaggcccggtgtcgcttacacgatggtgtagccaaggtgatgttccagttatatgcatttgtggttataactagggtgttcacgatgtgttgaggaaggcagtgcattcgggtcctaattaaaactttaagaaacgttatcttcttgttgtgttgtgtgttgcttacttccttctttgtgtactctgattatttatgttatgcatgtgggattatgggtggggattaaactaatgtttccttagggaacccgagctcattgagtaatgctagattactcatgactttacttgttttgcatgaaaccttagaggggattagagggagtggtgaacactagggaacccggagtagtttttcaatgtccttttgtaaaacttaaaatatgtattttcgtatcgtgtacttttggacctcatgccttggccacaaaaacgatgtttatgttgtggtttttccttgtattttcgtaactctaaaataatgaaatcggtatttattttagagtatacgggtttcaaactgataagactttgtccgagtcgacacaacatttgggtgaagtgagggttggcaagcctaacactacaaaaaaatttgaatattcttacggaaaaattgcgaccattttttcgtcagaaaattgtaaccattttcttacaaaaatgtgacgtatttatttagtcataaaaacgttactatttcgttataatattatgtcttaattgaaagtaactaacgtttgtcactaattatattaaatttgttacgaattatatagtcataaatataaatacggatttgcgaccaaatatggtaactaaattatacaataattgtgactaaacttatgtcacgtatagttacgagagttttgtaactatcatgtcacaatttgtcactgttttagtgacttttgcgtttggtcatagattgtgacataattattaccaattttatcacaaaaataaaaacatgtgaactaaaagtcaaataaaaaaacagcttcaattttggaaagaaaaaaatctgataatacataaaattttgaaaagagtataaaaagttatataagaaaacagtttcaatttctttgttattttttctttttatttccaatgctttgttttaaaaaaaaaaatcccacgatctctcttttgcaatgcatgatctccaaattaacttcccagttttattaattattttcatcaatttcactttctttaaatcaccatatatatcccacaatcgatttatctcaattgttcttccattcatcccttctggaaaaaaaaactgtaaatacttttacggaatcgtcattcaacaccacgaattcatcttcattgttcgctaaatccaacattccacgactccgatcgtcttcttcctcctttcgtaaggtggtttcagtaacccaaatcaccacaaaatctaatattttaagagaaaatctttgttttgatttttttgatgtatttagttgcaggcactactgtttgcaacatgaagtcaaaatccccttctttttatatctccagaaatatgaacagttaatgctaattaaaaggtgtgattctgcttcttctaatgtggatctttttgtctaatttagatacattatataatatctaccctatttacatcctattctctgtcagctatccacctctacgtccacacttttgttttgttggagcggcatcaatcgttgattatatgtgatcttcatttaaggacaaaagttggaatatcatcatatgcttcgatcatgtcaaagaacccaaattaaagaagcacaatcaaatgatcaactgcttgaaggagacaccaaaagtttcgtcatcaaagaagaagataattgagtgacaaagaagaagtcaggtgatgagaagcaagagatgttcaaagcatcaaaaggccaactcacggtttcaataaaacattacgaaaagtaatggtttttgtggggggttgacattatttgaattcattttcaccctttttatttgttcaaagtttaggatctaatatgtagtatacaaaagcaaagaatcttgatcatcaatatatagacctattttacgttctatttttttaattacaaaactccaataagaaaggagtaaatgaataacgccatgtcaagttgttttaatttctggatatcactaaatttagttttatagataattttaatatgttaaaatggccatgtaacgggacagagcatgacattgtgtgactataatcgagtcactaattgtgttggatttgtgattgtattttggtcgcataatataacgggacaatgacttaaaaatatgagtagtaataatctgtgacaagtatgttacgattttatcgccactagttgtggcataattgtgacagtatcgtccgccacgaaatgtgtccatttttgcgactatattaacgtcgtcacaattagtaacgaattgttactattgttaatcgtcacatttgtttgtgacttttttgagaccttcatggatttgtgacgattttattgtgacattttaaatttcgtttcagtttcgtcataaaaaaattattgtgaccaaatatttttttattgtgacgttaatcatcgtatcaatattcagtttttattgtagtgtaagtggatcccaaatggggaaatgggtaaccttgagtgggtaaagggtcggaatgtgtttttgaacctcagctactctatgggaattcatttccattgtggcgtctccgagccgtgccgactggccgagttctagcgcggaccgggggcgttagaatgggtggtatcagagcatggttttagggcttttgggatccgttttttttttcaaacgttttatcgagtaaatagtcgcaaaaggcacttaggataatccgagtcgttcaccactattaggataggggggaaatattagatacctaatatcgttgttggattggatgcagatgtcaaggcaggtgtcggacgagaactagtcgagagatgtgatgtctagtcgtggaaactttgcgcagtatccggagtcggataactagataccgagtgagagtggtgagataaatggagattatattcacttggagccgtatggattacctgaatgggaaacccccgattccacgcccaggcactcgtcgcccgtatcgatgttcttcgatacatcaaatgagagttactttcgttctcgatcacataaccccgtacaatccccatcgatcgagcaaaaccatggaaaccctatccctgaaaccaagaaccaaggagccccgaaatgcagcaaaccttagacattattcagagtcaattgggtcatatgattgaaacacaacaacatcaacaacaaattcaagaaagccagcgagaggaatcaacatccgcaaagttcctgaagctcgtgatgatgatgagagacttaggaattcgcgtgtttaaaggagaacataacacggtcgtggcagacaagtggctacgagaccttgagatgaattttgagatttctcgatgtcctgacaatttcaagagacagatcgcggttaacttcttggacaaggatgcacgaatttggcgggagagcgtaactgccagaaaccaaggccaaatgatatcatgggaagcttttagaagagaattcgaaaagaagtactttccaccggaggcccgtgatcgattggagcagcaattcatgaagttagcacaagagacaaggagtgtctgagcatacgaacaagctttcacgcgactaaggaggtacttatataacggacaagatgatgaagcattgatggttcgcaggttcttgagaggactcaggctagagatatggggacgactacaagcggtcaaatatgacagtgtcaatgagctaaccgaacgggcagataatgtggaggagggtattgagatggagaagagtgtaaccaacaaggaaaatgattgatcgggagggaggaagactaataacgcgtaggccaaaaacaacgctcctaaattcacaccaaatcaggagagagacaatgatcgaggaagagcaagagcgaacttcacaaggtgtttcatgtgtctcaattaaaaagacatgtacccaaacccgatgctgtaatttcagaatcgatacccgaattgaagaccaacctcacatatccggaggggccactcgagatcggagaacggcgcattcgaaagtttaagaagcggttaattcctcaagttcaagtaatttgggaaaacaaaaccgacggttaattacattggagggtgaaaaaaagttccgggcaaaatatcctcaactgttcgacgttgaagaagaagatgacaatgaagccagtccatccaatactcagggaatttgggacaaattcctataaggagggcaaatgtagtaccccgcgcattgaccccgggcaagaaagaagggcaagagaagaagaagagagaatggtgcgcgaaatgaaaggaaggacgggtatttataatctgcggaagctagagtagagcccaattcttaaaacttggagccaaatccattcgggcaaagccgacttggtgaccaagttttgtcctgagccatgcacgccaacttcgagcccacgccttagccaacttggagccgaatccacctgagcgagccaacttggtgaccaagtttcgtcccaaagccgacttggtgaccaagtttcgtcccactcctcacatccgaactttgagcctataaatagaaccttacccccctttagttaaaccttagaagctttcgcaccaaaactctgcccaaaccgagagagagagagagattgtctgaacccttaacccgagagagagattgtccaaaccttaaaacccgagagagagagagagtccaagatagagatcgccaagccttaggatagtccaagagagagatcccgagtagaaaccatcggtcgagttaggaagattcatcagggattgtgagttccggtttttgttttgcatatttgattttcctttttgcatgttctcgattctcccttctcttagttttgttgttgttatggttgagtttgttgaggttgttaaccgaatagctaggatagttgagaccgaagcaccttgccctataggagtggttgtgttagaataacaccattcacttgagaaggatggttgcgttgtcaagacactactcgctagtattcaggagacatttagagagaactttatgagcatgtgtgttgaaaacgaaccgcatatttcatagtgttgattggaagatcatagtgtgtggagcgtggagagtatccaatttaactccataagcatgctacggtcaagtgggatgtatctgaccttgccatgtgagtccgttctttcgtggggagtgcttgacgagatgcaagtgacctcaaggggttcgaaggacccagagagactgggttaggtacccaaggcccggtgtcgcttacacgacagtgtagccaaggtgatgttccggttatatgcctttgtggttataactcgggtgttcacgatatgttgaggaaggcagtgcattcgggccctaattaaaactttaagaaacgttatctccttgttgtgttgtgtgttgcttacttccttctttgtgtactctgattatttatgttatgcatgtgggattatgggtggggattagactaacgtttccttgggaaacccgagctcattgagtaatgctagattactcatgactctacttgttttgcaggtaaccttagaggggattagagggaatggtgaacactagggaacccggagtagtttttcagtgtccttttgtaaaacttaaagtatgtaattttgtatcgtgtacttttgggcctcatgccttggccataaaaacgatgtttatgttgtggttttttcttgtattttcgtaactctaagataatgaaatcggtatttattttaaagtatacgggtttcaaactgataagaatttgtctgagttgacacaacaattgggtgaagtgagggttggcaagcctaaatggatcccaaatggggaaatgggtaaccttcagtgggctaagggtcggaatgtgtttaaatatgcatttttaatgagttcgtttgttcaccttagtagataggccgattcttattacacacctaaaaaccagactcatcaaataatagatccaactacatatacttatggtgggcatatctattgtctggattcaagatctagttagttactctagatctagcattaagcataattaaagatgaagaattctacagataacctagcaaagggggcaatctactaaactatatgaatccctaatgagaaaccctattcctaacaagcagattactcagacatattgattgaaggaaacaacataattgagtatgaaaacataaacacggcaaatagatttaagggaaagaagggatctcttcactgtattaggaactgaatcaatctctgaaaacactcgatgaatagcttatgtctctcagtaacagggtttgcaaaaagcttgataaaaaacttgataatgaaaacttaggtctaaacaatgtatatacaccctctaaaaacgtctagggactaataatgtaaatagaaaagttttctagggcaaatttcctcttctgtaaacttgaaagcgtctaggactttgctgggccgaaactggtgtcgatcgacactaggagtgtgtcgatcgacactcctcttgattcgtgaaaccaaagtcgtccttaccttactttttcttagcttttgctccaaaatgtctccttatctccattgttgtcccactgcatagaatacctgaaaagacactaaaaagactcgagaaataacataaagactcaagatcctatacctaaaacatagataaaatcagttaaaataaggatatatcaatcaccacaatctacatattcaatttataggaagttcaacatttgtagtaggatcctcactctcaccttctttatctttctcatttgacttatcttgattctctatttccatgttgtcctcagctggttcaaaagtacccaaatattcttgctccacatccgtctggtcattctgctttctctttttgggacgatccatttacttcacctgaaaagttcaatcaaacataaataatgaagaagccagtcattagccatttaaatatcatgaagtagaacaaggtcaattttctctctctacaaaggcaatttattagaggttaggtctcggccgaaagggcctttgcctgggaactcgaagtttgtccgactggtagccagttcccacctttccgtccacactggttctcacacttgttctcatccacatgtggaagtccgatctactattgggaatccctcttcgattgctgtttttgattctcttccggttgagacgctgggaacctcttcccctattcctagaattgttgaatttccctttagtgacgaatctttaaagactcctttacttgccgttatccccttcgacgacaagctctcttcgataaaacattatgtttctggcgaaagctcctccgatttggcaacaatgtctgagaactcctccactatcgtcagagagtctgatttggtccctaattctcgtttggtcgaggcaaagggctattccaccctatcacctaacgtgggggcgtcaatgcctatcgatacctctggcctgagccacgctgtaccttcgtccataccctctgagcctaccacaatatctgagaattcctctgctgcggtggatacaactctcctgaaaaatcctgctaacactggatcaagctttcccactaattttggtgccactgccactcctcttccggttaacaatcctcctcacacttccgctacccttccatgggcgaagaaatttaaggcctcgttgctaaaccttaagcaaatgtccagcccaacctttctcgatgatggtacccctgttgttgttgcgccaccctctgtattactgaagacagcagagatgtggaaaggccatcttatagcccaattttggggcctttgtccaccggattcaaatatcttcaatgatcttaatcttatacgatgaatttatggcgccatcacggttcgtattatctcggaaacagcttctttgatctacatctcgtctttggcaacgcgagaatgggtagtggatgtggggtccttgtacagtgtacccttggtatccagaaggccctctagaactcgaagaattacaaacggctcctacttgtacaattctcaagaacgaccttccgtagttgtgtttacttgatggaataattgttatagcaactggaattggcgagcccctgcatagagagcctttcttcacatttactcgacctcgtggtcgagtacctcagtctaggccactcgatgacaccactcgaccacgaggtcgagtaacaccttgccataccactcgatcatcacacgaactgtcactcgatcataacactcgatcacaacactcgaccccgatcgattagattcctggcccatcccttatcggtttactttgttttgtataaataagtcttcaagaattttgtcccaaaacatttaggttttgcttcacttttgatttctatttacctagtttattctatcattgcgccgtttgctctacacacttgtaattcgagattttccatgttattcggattctacatttgattttgtttagcacctagtttctctactctttatctctttatatatgcagtctacttgtttattggcaattatgtttttgagcatgtaatctgaatagtgacttagaatttttaaggataggatagaatggttggttgatctgtagtctataggatggttaagttttagaattgattgaaacccttctggattagttgtgtttaaggcttatttctctctgataaattggaattcgatccaaagcactcccgcacccagaaggtgttcgataaatgcttgatccactagatctagaggttttcgtctctatcccaagggattggccgtttagagcgtttattgactgtaataggttgaatcgtattgcctgcatagttagattctgttaatgggaattagtttgtgctagctttgcttgagggtttctatcacgatagtgaattaatatgttgttgaacttgttatgtagggatagcttgattgcgctttgttaaccatatgagcaggctaaggagaccactccatttgattacctcatccttaagaatttctcgtccatttgatttctttatttcattgctattgtttaaccatttttttttgtgttgcttagttttcacattttctacctattattaccaacttactcgaccacacccaatgtgtggcagtagattgtgcggtcgattatagttgttataatttctgtttgttattcgaacagttactggacctgtccctgctactggcttcaaccagtcgtggtcgagtgttttgtgtaattctgttagaatttctattttctacatgttcacttaggactgctaaaaactccaaaacctgctattgcttggcttgacttagtggcttccgatcacatctcatctgtttgcatcacacctaaagtggatttacacctaaaatactacaacgacacgatagtgtttaaggattaattgatcttaaaaacctattatcaattttgtgtcgttgccatttgggtgcttgtttgctatattggagatttcagaatatttaagatccagttctttttcgtttttattcaacgttactaactctgtgtttttttgtttgtctgatttgatccaggttttgcgaatcactagctttactcaacttcctctggaccgtgctaacgtatggttgttgctcagtgcatgcaaactcgatcgcaagggcatcagaacctcctttttaacgataacatgaaccgtattgctcttgaattaagggaacaattaaacacaaacgctatggctgatgaccagaacccagaattaccaaccaacattggtgcaggcgatgcaccatgcaaccacaatcaccgtaatggcatggttcatggcaacaagtttcacgacctcccatgaaggatccactcgaccacctagacgagtttgataggctctgcagcctaacaaagatcaatggaggcaatgaggatggcttcaagcttagattgtttccattttctctaggagacaaagctcatcagtgggaaaagtcgattcctcaaggctcaaatgattgcaagaaagccttctttgctaaattcttctcaaactcaaggactacaagactccggtatgagatttttggtttcacccagaaaaatgctgagactttctgtgaagcatgggagcgcttcaagggatatcagacgcaacgtcctcatcatggtttctctaaggcatcacacctaagtactctctacagaggcgttcttcctaagatcaggatgctccttgatacaacatccaacggaaatttcctgaacaaaggcgttcttcctaagatcaggatgctccttgagaacttagcttagtctgatggcaactataatgaagcaccgcatggatatgaaagctagaaatgacaagctggataagctaatcattgtgcaatagaagcaagtccattttctcagtgaagatgagacatttcaagtccaggatggggagactctccaataagaagaagttagttatgtgcaaaatcagggaggctacaacaaaggtttcaacaacttcaagtagaacaatcctaatatgttttacagaagtagcaatgttgcaaactcgcaggaacaagtctaccctccatagcagcgaatcaacccaaaccatttgttccatacaactagggtcaagggtttattcctaaggaactataacagggaagctatcaaccgcaacttccaccacctgggctcacaaagcagcaacaacaacatgcttccacaattcgagactcagacttgaagaacatgctctagcagattttccaaggacaagcaacatgagcaatggatttggccaaaaagatggccaaaatacacaacaaggttgattgcactttgaatgatctcaacatcaagattgaagcactaacgtctaaggtcagatacatggaaggccaaactgggtcgacctgtgctcccaaagttacaggacttccaaggaagtcaatacaaaccctaaagagtatgcgatcgttcacgccatcactatctgccaagatcgagagctacccattcgtcatgcctctaactcaatcactgaggaaaacgaagctcaggaagggcaggtttctaatcggattgaagtcttagttattgaacttgaccattcagctggatctcgccatcaaattctgtctaccttagaagagaaagtagccatcattgagagaatggtaaaacgatccaagccaactccattacctccacttgttcttccaaggaagttcaggaaagcttggatagagaagtatgaatctcttgtataggaacaactcaatgggatcaaagcagtgatgtcattaatataagttttcgagctgattcaataccctcacaaagacgtgagaaatttaatactagaaaggatcaagaggtatcacgattcagatgatgaatatgatgccactctgtttcaagctgctcgtgaaaaaattgttcaagaaaagttggaagattctggatccttcactctgccatgctctatcatgcatttagctttcaacaattatctatgtgatcttggagtttcagtcagcttaatgccactctctatggtaaagaagcttggattccttcagtatatgccttgtgacataaccttgatttgctgataggagttcaaggagaccttgacacactaagtcaaattcaaggaggagattaacctcgactcaactttgatgtcccttcagtttggtttgaagtagactatctaccagatgaggaagcagcctacttagaggaaaaatgaattgaggactcagttgcgcagctatcaatggaggatactgagaatgatgataagctcgatgaagaaaaggacttcttaagtcctttctgtcacactttccctgcctaataagtgtgagtactcaagctagagatttaaaacaaactcacttgggaggaaatcctatgtctatcaatgtatatatcttttattttttccttgttgtctttgatgcattttgttagtattttcaggagataagtataaagagttaagtgaagtgggttttacctctgagtgtgcaacagaacactcgaccacatcctgcaaggagcaagtgtatctgtgtaatcgagtataaagagggtttcactctcaagattttgaagtttcaacatgtcactttatcacccgaagccacatgctaatgaggaaatgtggtcgagtatatgtgatgattttggacctaatgtttttaaaaatcatcactatacttgaccaacagaagccatatggtgactagaggatgaatttgagtatgatgttgttttgatccaaaaattcaacattatactcgaccaacaaaatctatagagacttacagaggcttaatcaagtttacaggggattgcggaatgttctgagacttttctagtcaacagggaaccgtgtttaaagacaagaaaacagacgtggggttcaccaccaaaacttaatgttccccatgcctcccaccaaaagataagaaatccatctcttttgcttctccaccagatgtcagacgggccgccctgcgcccaaacgggccggcctgcgcccaaacgggccatccgcaatgtgcccgattctcttctgattcgcgacggacctgccggccgacgaccgcggtcttgaaaaacgagccctaacccgccccgcaaagcccagcggttagacaggccggcccgcaggcatatatgaaaaagggagtcaaatatatgccaagagaattgtcaccttgacatctatggaaagaaaattgtcaaaacatatagttagggccatcacaattctctgcgtttacatgtccaacttcatttgaaccacgagcattttgatctatacttaaaaggcagcatgtgttaaaacattgtacagaccacaatagttaactagatgtcaactccaagacaaattcacgtttgtgttactggtaaaaataaaatgcctcgaatactgatgataaaaatatttcaacttcatcacttggttggtataaaactagccacataccaggttcatgtgagttctctgtgatttcttctatatgatagtaggtttttacggtcaattaatcctaaaatactatcctgtcgttgtagtattttaggtgtcaatccaaaagggtgtgatgcagacagatgagatatgatcagaagttgttaaatcaagccaagcagaatttgattggttatctaacagtcctagtgttgatgcaaaaaacagtaaaaagtcacagaaatgactgatatactcgattgcagggtcaactgccagaagggaccctgttagaggtgtcagacgggccggcccgcgcccatcttgcccgccccgcagtgggctttctttttccggccgcggcggtcggcccgtttaggaccgcgggcaaaaatatcagtgtccaagcccggcctgcaaagccagcggatatacgggtctgcccgcgggcatttctattcacttgtttaaaagatgaatcattgaatacaataatgtctaaagaattttgattcaaaccttttattcatgtataacaatgtacaaactaatatggtacaatgccttttatgagttaccttttacaagttctgaattgtgaatcattgattaaaacatctagttacatacttacatttgacatctcctttaactcaaacgatgacatttatttaaactgaaaccaaacataagtacttaaacatagctacagttaactgaaacactttttcatttacttaaactgaaaccaaacataagtacttaagtatataagactgaaacaaaacataactacataaccaactaaacaaaaatactgaagtgaaactaaactaatgctaaaaagagaacctgcaactcatattcaaatctgaaattcaaactcaatacgtagaacaaatatcaatcctcaaaccaaacataagtacataactagctaaactcaattcaaaactgaaactaaactcaagctaagaatagaacgtgcaactcatatttaaatcaaaactgaatgcaaactcaattaaagacataagtgaaacagaaccaaactgaaacataaattttaaacataagtctgaataaaagaacttaagtcgaagagaaaaacctacaacatctcaaagacaaacagaaatctgaagtaaagtttcaaactctaacagaaccttaacttaaactcaaatccaaatatcccaaaaggaacaatgtcgtgtctcatcttgcaactcatttgtaaaccttaatctgaatttaaactcatattcaaatcttaaaatcaatgtagacttaatgaaagatacgtagaacaaaggatcataaaaacagaaccaaactaaaacaaaagtcaagactgaaacataattgtaacaagttaaactcaaatgtgaaacagaaaatgaacttaacaaaataaataaaaagtatatagagggatagtcatgggacttcctcccaagtgagcttgtttagagtctctagcttgactcctcacactaatcaagtggagaaaatgtgacagagggaacttgagaagtcctcctcttcactgatatcatcatcatactcagcatcctcccttgacagttgcacagctgagtactcaattcttctttcctcatagtaggctgcttcctcctttggaggatagtctttctcttctgaccaatctcaggtgatctcctttcttgaaatcgtgtcatggttgagctggggctgaacctccttttgcattcgacttagtttgtctctaagcttttcaacagtgtagctcagcttctgaatagttctgttctgcagatcagtcttccttttgagttccagccaatcaagtgaggagggtatactcgatcaagtagtcgagttcgatggcggagtttgaaccaaaatttgctccttcgctcttttgatctcaaggccttcacttggaaccgctctctggacctctaaggtttttccttctattggtggccttgtcggaaatttgttgatgtcaaactgtaacttgacatgcctcccaaggttgagatcaatcttaccatatctaacatctattattgctcccactgaggctaagaaaggtcttcctaagatcagtggatccttagactcttcatccatttcaagcacgacaaaatcagtgggtacctcaactccatctatcattactggcacgttctctagaatgctgaaaggtctccttgaagttctatcagcaaggatcaaggtgatgtcacatggattgtactgaacgaatcccagcttccttgccacagagagtggaattaaactgactgaggctcctagatcacatagacaattgttgaaagtcaattgcctaatggaacatggcagagtgaaagatccaggatcttccagcttctcttgaataatcctctcaccagcggcttgatgcataatgacatcgtcttcgtcatctgaatcctgatatatgttgagcctttccagtatcaggtttctcacatctttgtgagggtctgaaatcaacttgaggacttctactaagggcatcacaacttccatctcatcaagttgtttttctgctagagattcatatctgcttttccaagctttcctcaacgtccatggaagagcaagtgagggtgatggagctggcttgaatcgttttaccatcctctcgattatagcagtcttctcctccaagtcagactgagcctgatagaaagattgagatgaatagtcgatctcagcaacagagacttcaatctaagtggaagcctccccttcttgaattacactgtcctcagtgtttgatgtagagacatgttgagttggcagctttcgctcatgtctgatagtgattgcgtgtgcagtggcgtactccttagggtttttgattgcttttcctggaagctggcctgggttgtttgtaacaggtggtgaagtagtgatgccgtccagataccgtacccttgtgttcaatgattccaacctgctactcagttcattgaactgtctgtcaactttgttgtttaagtcagctagcttcttagcagattccattacccctgcggcttgaccttgcatgatctgttggagcatattcttgatgtctgattcctggggtgtagagggctgatgttgttgtggtgtgaaaccaggtggtggctgttgctgttgataccctccttggaactgttgcttaggaacgaacccttgactttggttgtaagtaacaaacggtttgggttggttctgctgcagctgctgttgagggtaaacttggtcctgaggattggcgacatttgtgcttctgtatgacagatttgggttgggtctgtaattgttgtaccctttgttgtagccgccttggttctgaacataactgatttcagcgccctgatcattctccccctcttggatttggaattcttcgtcttcagaggcgaagtgaacatgcttctgctgcactttgaggagtttgtcaattttgtcatggagagctttaatctctcggcggtgcttgtcatcagattcagtactggtgcggatgcttctgtcataatcctcgttgtaattgcaatccgactgagccaagttttcaactagctcccatccgtcttcgacatccttgttcaggaaattcccattggaggcggtgtcaaggagcatgcgtatcttaggcaggacgcctctgtaaagtgtgctgagaagagatgcttccttaaatccgtgatgggggcatttggtttgataacccttaaaccgctcccaagcttcacagaagctttcattttgcttctgagtgaatccggatatctcgttccagagtcttgcagtcctgaagttggagaagaattttgccaagaaggtccttttgcagtcatcccaggtcgtgattgatccctggggtagcgtcttttcccacatatgggctttatctccaagtgaaaatggaaacaagcgaagcttgaaaccatcttcactaactccattgattttagtaaggccacagagcctttcaaactcgtcaagatgatctagcggatcctccattggcaggccatgaaacttgttcccctgaaccattgcaatgagaccgcttttgatctcaaagttgttgttctgtattggagatggaacaattccatgacgctggttgtggttgtgagggaagtcaccagcaccaatgttggtaggttgctcttgctcatctacaacgtcagccattgtgtcggtttctgtctgttctcttagttggcgagcaatacggtagatgttatcgttgaataggagattctgatttccttgtgaccgtgtatgcatgcaacagatagcagccgggctataacagacgaatcagagatgcgtctggaaagcgggttgcaaggtacctgaaacacaaagacagaaaaggcacaatgttagtaacttgtgtaacaaaaacgaacctgatcttaatgtttctaatgatctcaaatatagcaaacaaacatcaaactggcaacggcgcgaaattgatagtaggatttttgtcaattaatccctaaaacattatcttgtcgttgtagtattttaggatgtcaatctaatccggtgtgatgcaaaaagatgagatatgatcagaaagctctaagtcaagccaagcagatggttggttggttctaacagtcctagtatgcaataacagaaatgaaatgaaactaaaagcaggaatggcaatagcaggcaagtgaatgacaaagcagaaatgataacaggcaatcaaatggataaacgattcataaggatggggtaatcgaatagtatggtctaattaatctattcaggcggttgacaaaacttcacagaagctatccctagacaacaagttcaacaacagattaattcactcccgtgatagaaatcctcaagcaaagctaaacactgacctaaatccctttagcgatctctaactaagcaggcattatcgaatcaacatgttaaagtcaataccctctctaaagccaatcccttggggtagagtcagatatctctggaattaataggatccaacgcccattaaacgtcttctaagcgctggacgtctggactcatactccacattagccagtgaaataagcaataagcgcaactaatccagaagggattctagttttctaaactcaaccacctaaaacgaccaagtaaaccacaactattctatcccatcctcagaaatacagttcactactcagacataatcaaagacaataacaaagcaacaattgaaaacatgataacagaaatgacgaaagacttaaacgaaaactgaatatcaaatacttgaaaacgaaactacaaagtcgcagaaaaaacactgcagctatcaaagttgcgaaaatgtaaaagcgagataaaaacggataatagcggataatagccgacgccctagggaaaaccctaagaggcagtttatataagcgagaaataaaacaaataaggaaactaaatatatagcgaatcttcacgtcatgatcctgcgaccgaatatgtcattggcatctaacgggcagaaatgagcttcctagtgatcgaatatgtcattgatcaaactgggcttcaggggctccgtcttgcgaaatgtagtgaagtcgagattgaatggtccaacgaccttgtgatcgagtgcgatcgagtggatgtcatgagggtgtgatcgagtggtttcttcggcttctcttctcttctttgttctcagcttgtctggttgagtgcagaatgagcagataggcttcctggtgatagagtggtgatcgagtggttctgatggggtgattcctccggcttcgcgattgagtgaaactgagctgcttgcttctccggggttgcgatagagtgatttgccctggcagggctccgaggctgcggatagagtacttttttctgaaggcgtcattgggcattctgacttcatgttctgtataattaacttaattaatactaagtataattaactaacctcctaattaacttaattaatatgcggataaactcggacgatcttatccatacggaatagataggcatgaacgaacttatccatattcgttcctatctacttctcgtagaaccgtaaccatgacgggttcacccaacgcatcaacacattaatctcagtcacccaagtctccgttccactcgactcacccatccggttccccgaccacttgctcatgaatatctccaaaactgccagaccgttggtccgacaaacaatactcttcccataaggactttttccgaccgttccgattgtacggcttgctaaatcatcgagtaaaattcctcggcctagtcctagtcctggccaggggtattacaatatctatcccgacctttgaaatcatatagccgcttatagaatactttctcctcaggctatgacaaagaaaaaggtgcaggtggaagatagattattttacctcttttaataggatgtaaatcttttctaacgcaaaaaagttgtaaatctttgcgagtctttaacccattctttggtttcccacagtgcaacaatgcttgcacacacaattctcttaacatgtatgacattgaaactgtgtttaactgccagatcttgaaaaataaaataaaagtaaatatagataaatgctaaactttgtaagcatcccagttacaacaatactattcaaagagatcactatagaaacattcaataaggcaacttgaaaaagatagaccttttcttcaaccttgatggtcttcctcgtcgttttcttcctcttcctcttcctcttcatctcattcactttcttcactttcatcacatgaggctgtctcaattacagtttcagtcctagctctcttcttctctgtctctttcctattcccaaaatcaattttgaattttttttaagaggacatatatattatgactagttaatattttaaccttactctcatgttcaaattttcaatcaaaccatgttttcttcccctgataactgtgatttggtggtagaccattgcgatgacacatatcaacatgctttctacctttacataatcacatattgtcaatttttcctacgtaaaggacaacccatcttaccttttactttgcatactacaagatttccatatagagggaaatcattgatagtccataggagcattgctttagggttgaaagtactcttactgtaggcatcatatgttaactttccgttgctccacaactggataagatcctctttcaggggttataactaaatatcaatgatattaccaggttaatgcagccagaaatcaacaaggtaagcattagcagcattatgttttcttttttcatacacaggtctcgagtaatattataattaactagttatatgttcttttttaatgcagcaaaagtagggtatttggcatttacttgcttccgagtcacataatctacagggtgaaaaaaatttccgtcttattactaaaatggcaccttaggtcattggcttgttgctcagacctaaacattctctttagacgtggtataattggaaagtaccttagaatttttctgtgaaacatttttctttatttgaccagtgtgcatgtttatcttccatcttctatctagaagctatgcatttaggacatgcgtcaagcttcttcagccttttcatgaatagataatgattattaataaaagcatgaatatcttttaataacctatatcaaaagatttcaggaacttcttcacatcatacattgatgtatatagaacattatcttctagtaaaatgtttggtaaagtctcctgaagatcattgaagcttttgtctgaccacccattttgtgtctttattttatacagtgacacaattgtagaaagcttgctatggtttgcacaacttgggtataaaggagtttcacattgataagtctgcattttacttgtcttaggcatccatttcccatcactttagcatcctatcaccactgtttcataccatttcgcaacatttgtcatcacattgcatgttaaggatagttttgcatgcatattacatatttgtgttgttttcaggtgaattggagctgatggtgaactaattggaagaagtggacctgaaccgatcaacatactcgaccatgagctcgagtagtgtcatcatggactttttgaagtactcgccacaacctctacagctgatcactcgaccacgacactctatccaccactcgacccttaggtcgagtagaagactcaccacttctcacaaccactcgaccccgaggtcgagtagcagccatcaccatttctcaccatcactcgatccagtggccgagcatcaccatcatcaatcactcgatcgcacactcgacctcgtggtcgagtcccctcatcatcactcactcgatccatcactctgccaccaagttgagttccaccatcatccaccactcgacatcatactcgactgccagcttcagagtcttcttgattccgcaatcaacaagacactcgagcataaggaagagatgaagactttggctcgtcactcgacccactacttgatcacctgggtcgagtaccattcttaatctgttccaatactgtgtcgttttgagtattagggtttcagaatattttgctataagtagcatgtactttattttttcaaaaacaagtttttattccgcacacagtttgtgtgttatttgcttttgtaatccgaatttcttttaatctattcagtattcgctttttgtttattttactaagttgttcatcctgttatcatcatgttattactcttttgctatgatgttttcattcatgtcatcatttatggtctctataatgatgtctgagtagtgactaggtttctgaggatgggttatagtagtttagaatcctcggtctgttaggtggttgagtttgatttacagatcccttctggattagttgttcttaatgcatattgctttctgatcaactggaatttgagcccagatatttctgcacccaaaaggtattcgacgaaatgtttgaaccactaattccagagatttgtggctctgtaccaaggtattggttacagggagcgttttggctttaacttgatgattcctaatgcctcttaggttagctctcgtcaatggtgattgagtctcagactagtttaacttgagggagtctgttgcggtggcacttagatttggttatcgaacttattatctagggatagtttattgatcatctcaatcacttctagattgaggaaactaactactcgattaccccatcctcgggaatttcttatccaattgatttatttgcttacactgctattgttctcttgttcttattactcgttgcttagtttttgcatttcatacttgttatcactcatatacccgatcacacccagttgtctagtaagagattgtgcagtcgagtatctttgttacagtttctgcttgttactcgacctgtcactcaaccacacctagtgcttggcaacaagcagtgttggtcgagtgttttctttatcctactagattttctgtttcctgcatgttcacttaggagtactagaaactcaaaaacctgttattgcttggcttgactctgtgacctctgatggcatcttgattgttagcatcacacccatttggattgacaaccttcagtagtacaacaacatgatagtgttttaggattaattgatgttaaaaacctattatcaaacatcatctagctttgcaaggaactcatcttccatcttgtcctctacctcaccatcaaggtttatgagtttgtaatccattttcttgctattttgttacgaatttgagtttgattttttctgtagagttgtttatcttgcttagatctacatcatactcagtttacaatgatttctgggttttgtcctttttctaaattttgtatgatgatgttcttgagtgttcttgagtagtgttctctagagttcttgaatatgggttaggtttaggtggactcctctgtttatttagttagctaaggttataattgcatgattcccttcacgattaggagttcttagtgttatttcctttctgatcaactggagattgattttagacttttcacgcccaaaaggtgtttgatgaaatgtgtgaaccaacttattccagagatttgcatactctaccccaagagattggatgtttagaatgcttattgactttaatagattgttgcttaatgtttgctttgttatgtttcatcaatgagaattgtgattaggaagtggtaaagttatgaggatcattgtcacgagagtggattgatctgggttaatctattgtctagggatagcttgattgagtttgttagttagctgaaccaattactccattctaaagagctacgttttgattagattgatttaaacttcgtgctattactctttgcttgttgtgtttagttatcttgctcgacttatttacttgaccaaatttagtattatgctcggccgagtgccttactttctgtttaatatagtttcattttgaatctgatttgcatgataacatgttgcttggtttagtggaaataaaccaaacctattcacacttggcttgacttagtattctctcattgcatcatgattgttagcgagacactcatttggattgacaccttaaatactacaatgacatgatagtataaaggaattgatcttttggaaacacagtaaaaaccagactatcaatttgacgttattgccatatgggtgtttacttgttacatttaggatttctgagttattaagatcaagttctatttcatctttctcgaaactcacttctcttttcatttgcttgtttttatcttgtaagtactgtcatactccactagcacttcgagtgtaaggatcgaggaacttcacccaatgtatgcaaactccattcttaaggttttgacaatcttctgcggtatagagacaacatcgacatgattcagcgtaactgagagaacaacaagccacatcagatctggttgtgatggcgactgaagacaatactaatgagttgccaggcaacattggtgtaggagatgcacccataaaccatcatcgaagagctgatattgtcccacctcctattcagattaacgactttgaaattaagagtggtctgatgtccatgatacaaggtaacaagtttcatggtctgcctatagaggacccataagatcatcttgaaagctttgatatagtgtgtagtttaatcaagatcaatgggttcgtgaagacagcttcaagctcaagctattccctttctcacttggagataaagctcatgtttgggaaaagactttgcatgttgaatccatatgcacatgggatgactgttagaaagttttcctagctaagttcttctctaactcaaaaacagttagattgaggaatgagatctcgggtttcacacagaagcaatctgaatccttctctgaagtatgggaacactacaagggatacactactcaatgccctcatacttcacctattcgaaacatgacggctatgcttcaacaaaacctaaaaagtcaaactactagttctttggtcttggaaaaacatattattgagataaacactgattaggttcaaattaccctaagaactattatctcaaatatttaaggatcgaatttcacaaagtttttttgttcacacaatgaattaaatatcgagattaagctagtagggaatgattgaaaataaaggagaacaaagtaaaaagacagcagattaattggttgtaaacgattaaataaagagttaggaacatggtattctcaggaaactattggttagtagatctaatgaaagctaggttgttatcgaaccattcttaaactcaaactctaattatgcaataaccggtggtgttccgccaaactccctatgcttatagctaagaataaccggagaagccgagagatctttaacctaaacatgcattctaaacgagttcaattgttcaccttactagatagaccgattcttattacacacctataaaccaggttaatcaaataataaatccaattacagatacctatggtgggcatatctattgtctggcttcaagatctagttaatttctgtagatctaccattaagtataatcaaagatgaagaattctacagataacctagaaaaggaggcaatatactaaaccatatgaatccccaatgagaaaccctattcctaacaagcaaactactcagacatattgaatgaaacaaacaacataattgagtaacaaagtataaacacagcaaataagataagagtaagaaaggatctcttcactctattgaaaactgaataaatctctgaaatattgaaaactgaatgaatctctgaaaacaaatgatgaatagcttatgtctctgaagatagggattgcaaagaacttgataaaaggaacttaggtctaaacaacgacctctaaaactatatataaatcctataaaacgtccatggactaataatgcaaatagggaagtcttttggggcaaatttccacttttgtaaacttgaaagcataatggactttgctaggccgaaactggtgtcgatcgtcaccagaagtgtgttgatcgacactctgcctgaatctggaatccgaaatcgtcattagcttccttttccttaacttttgctccaaaatgtctcctcatctccattgtcgtcccactgcatagaatacctgaaaagacactaaaagactcgagaaataacataaacactaaaaatcctatacctaaaacgtagctaaaatcagtaaaaatagagttatatcaactcccccagacttaggttttgtttgccctcaagcaaaacacaaaagccgaacccgtggaagaggttttgaaaacaaaggaacttcaacattctctagcctattgccatgatcatccaaactaaatccacatgcctaacaagtctaatcaaatcttaaccaacatgtatttctctccaagcttacagaactttctagattccatacctaagttccacaactatatccaccaggctttcatcgatgggtctcatcaaacaagctaacattcaagatccttctagactcattcctgaactataccatgataaatcgaccattctcgcatactggatcaacaccttcgacagttttccaacctttgtaattgatcattccaaataatgtataataatggggtcataggaaacattcctaccccgatacactatccgaaaatcatgtcaatctctcattttctttttatttttataaggggagaggaacacattctttctatcacattggtctcaatatcaagtatgaacaaggagtcaagatctatcaatactaaccgtttgaagaggtaaaaggaagagcagttagattagctccggccttagtggttgtgttggaaactaggatatcctcaagtctgttggtatgccatctagattttccaatagtcgaattgagtcgaacctgcagcactcatcaatcaggcaatagttcataactaaactaaacaaaacgttttttttttttaagagtaagaaaatgagtcaataaactcaaaaacaaaaatgataagaataaaaaataaaagcaatattggtaagaacctcccccacacttaaacgacactgtccccagtggcattcaaatccgaagaaggcggaaaaaataaatcaaaaataaaagaaaagaaaagaaaagaaaagaataatcaaaccagtgggttacctcccactaagtgcttgttttgagtcaatagcttgacttggcagagttcaggatgtgggtagattggtggaggattgttgttgcctccgccccctccatggcggtgtgtaaactgaaccggtctaggcagctgcatgtgtcgatcgacactcaatggtgtgtcgatcgacactcttctcgtcacctgcaagaacaacaagagaaacaagcattcgagaaactctaggcttgttaacatgtgaagcagacttcatagaatctaaggaattaattgaaggtaaagcaggagaagagatagaagagaacttatcacagagggcctcaagtggtgtgggctgaagaggatgtgcagaatcctctgtctgtgaatctcgagggtgtcgatcgacaggagggatggtgtcgatcgacactgatgctctgcaactctcattggcgagctgagctgatgggagtgttatgtgtggctctgttttgggattctgagcagtcagaggaggtgtgtctgtgctctaaacgtagttagtaagtgcctcccccaaacttaaacgacattgtccccagtgcattcaaatctgaagtaagcaaggaaatataagaaaaatgtaaataaaaagaaaagaaaacaaaactcatactagtgggttgtctcccactaagcgcttctttatagtcaatagcttgactttgtcgaagtgcagatgtcaagtggattagatagtggcagtgattccagcttgaaacgtagctattgtagataattctgcttaaacaagtgatgggggtcgatctacactagtggtggtgtcgatcgacaccaccactagcagtctgaaatctgttcctagacaataacagtcttccttatgtctccctgattttgtggagccttgcagtgctcctcctaaatctggtgcatatactgttgaggcattggacaaggaattttatgcgtgtagacttgttcaacaacaggtggaaagtcaaggctgattggtgcagtctgcgtccaatgtcgatctttatacttttttgaggcatccgttagttaactggacgcatactgcaccaatcagccttgactttccaaaagtaaaagggggacttgcatccgttaggtaagcaatgcaatcgaatttatacttttttgggactctacgaaccattctccgtgggtcccacccgctacgtagggaaactccatctagtcgtaacgaggcttgatacatgataaaaatgcgaaaacaacgtctaaacaaataatttaattcccgtaatatcgtatggatcacaaaaaagcccaaaaaattatataaaggtctaaatttggagtaaaaaaatttaaaaatatacttaccattgccttgcttctttcgtcggagggctctcattgtgatttccgaaaagctatcacgtaccaaattttccctcacggtttaaaagttatagagtcaaaacgttttaactaaaaaaaaaacaaaaagggatgaaaaaaacacgaagacttttcaggacccacccgctacgtacggatactccatctagtttaaatgaggcttgatacattaaaaaaatgcgaaaacaacgtccgaacaaataattttgtttcttaatatagcacggatcacgaaaagacccggaaaagtatctaaaggtcaaaatttggagtaaaaaaaagaagggtacttaccattgtcttgcttctttcgtcggagggctctcattgtgctttccgaaaagctatcacatgccaactttggcctcacggtttaaaagttatgagtcaaaaagttttaacataaaaaaaaagggatgcaacacgaggacttctcaggaggtcacccatcctagtattactctcgccaaagcacgtttaactgtggagttctgatgggatccgttgcattcgttttggtatgatcacatccgttagtacatgctatgcaatcgtatttatacttttttggccactctaggaaccattcgctgtgggtcccacccgctacgtagcgatactccatctagttttaacgaggcttggtacatgataaaaatgcgaaaaaacgtccgaacaaataattttgtttcgtaatataacacagatcacgaaaagacccgaaatagtacctaaaggtcaaaatttggagtcaaaaacaaacaatggtacttatcattgccttgcttctttcgtcggatggctctcattgtgatttccgaaaagttatgacatgccaagtttggccttatggtttaaaagttataaagtcaaaaagttttaactaaaaaaaaaacaaaagggatgcaacacgaaaacttctcatgaggtcaccctctaatactactctcgtccaagcacgcttaactgcagtgttctgatgggatccggtgcattagtgctggtatgatcgcatctgttagtacatgcaatgcaatcgtatttatacttttttggccactctaggaagcattctccatgggtctcacccgctatatacggatactccatctagtttaacgaggcttgatacgtaataaaaatgcgaaaacaacgtccgaacaaataattttgtttcataatgtatggatcacgaaaaagctcgaaaacgtacctaaaggtcaaaatttggagtcgaaaaaaaaatggtacttaccattgctttgcttcttcggagggctctcattgtgattttcgaaaaggtatcatataccaatttttacctcacggtttaaaagttataaagtcaaaaggttttaactaaaaaaaaacaaaagggatgcaacacgagaacttctcggaaggtcacccttctagtactactctcgaccaatcacgcttaactacagtgttctgataggatccggtgcatcttgatgaaatttagttatttttatcatcacaaaaatattagaaaaagtataataatgttacatttacaaaatttcatcattaattcgtattattaataaaaatggattttatagttaatttttagtacaaaatgataattaaatctttgtttggtatctttttttactatttaaatatttttttgttattttataccttattttgcattgagctttgaaattttaacaaatactaaaatactttaaaaacatttagtaaacaaatagagttagttagcatttaatagtttttaaacaaataaaataacctaatacaatatttctaataataaaacatatgttacatttaaaaaaaaacgcggttttgttaaacaaatgtttttgtttgctattgtaatatatacttaaaaaatattgaaaaatgataatgtataatatatgttgtgtaggcagaattttaaaagtttatttaaatattataatcattttccctgtatattccataaatatcagatttttcatcatttaattaatttcttagttttggaaaaatttagattaatatcttaatgaattatttctattttcaattcaagattaaaacaaaatcaacggtcaagatttttgtctttttagaatatcaataaactgttgagattataaagtgaaaccgggtcaaaattcgcatcaaaaagatgtgtgtgttttgaaactgttttttccatgaaataagtttttttaacccacttgtatttttgtgattacttcaaactttttgcccatctcactaaacaaactgcacaaataatagtatatatatatatatatatatatatatatatgctttatacaaatctctgcttttctaatccaaatcaattcaagatgcataaatcgtttgatcaaatttaaatgataagacgctatatatgataatgaaaaaatgataaaaccaaactgtttatcatcgtatcaaaaaccaatgaatgagacattcaaaactttaataaccaaacctacctacatgtataaggctcaccttttgatcctcatcgggtttctgcaaattgacaaaacaaagactaaaatccaaaatcaaaaattttaaaaagaattactcatattctacaaatatagagaggtggaaaatcttaacatattactttgcataaaagattctactatattatttgggaagtacattttaaatgtaacctcaatttttgtaattaattacatgaaatgccattagaaaaaattaatcaaaaacaaaatcttttaatgacgtcattaaggttaccaaaatcatttaacgacaatattcatttcttaattatatggcttatcagatctaaagacgggtcatcaaagatttcctaaactgaagcaaaatataccgaatattcaaatatctatctgttaccaaattagaaacaaataagttaataagtcaataactatttggagggacgggtttttgaatcaacattaataaaaaagtaaaatataattaatccaccgtttcaatacgggtaaaatctttaatttattattttgtaagaccactaatattaaacatatcaaatcaatctaatttataaaaggttatataaaacaaaaaatgttatgtggtatgtataatgttactatatataaaattaaactataaaatataaatgtattagggaatgatacaatttgcaaaacttttatatataataaataattcttaaaatttttaaaaatactactttaaaaacaaatcacaagacgggtaaagaaattacagaacgggttttattttggaattgagttatatggtggatgtatttgaatcaatatttataaaattttaagatattattaatatgctgttttaataagggttaaaacttcagtttttaacaattgtctcaataaagaaattacataacaggttttattttggaattgggttatatggtggatgtatttgaatcaatatttataaaattttaaaatattattaatatactgttttaataagggttaaaacttcagttttttaacaattgtctcatggattcgtggtatagcgttacttaataacaattataaactgtaaaatagaaatattttataaaaataaaatttgtaagttttaatatatattacctttaaaaaataaatcgtttcgcgtgggggcagcctaagcctgatagaggcagaagaattccaacaatttctcccgctcctcaaaagtgagttgctcctcacgtacgcatgttctaatagtcgagttgctgttgctaaagcacctatggttccatccctggtaacttcaaccggtatactgcgggttaaaatctagtaaataattagaaaggaagacatactttaacaaaatcatttgtgaatctacatcatcatcttccacactacctgcatgaatattaacaaaaaagtatgtcagagaatatatgaaattaaaatttttataaaatataaacaatataaaaataaattacagatttaaaacgaaattaaggtttgtagtagaatgcgctatttcacctagtggaatgcatggtcttatatagtactgaagaaggaaggctcatttcagggttttgaaaaggaatattctgtttagtttgtagaaaaaaattttgatttaaattattataaatttttgaaacttgatgaattatagaaataattaatgagtttcttaaacataaagatttaaaatccctaaattgatgtgaagtaatttttcaaatgtgttgtaattatttttcaaaatatgcttaggatttttcaaatttaaacaatacataatattaggaatgttaactaatagaatcaataagttcaagatttgttaatgatttttttgatgggctgaggggagacaattgtcaaccccattttattaaaagaactacaaagaattacatcaaaactgctctagggaacgatgtcccgttagcatcctcaaccaaaaataaaagaacgtcctcaggacatatctcaaaacaatgaaatcctaggggtaagaagaaagcatagtttgctaacccgtcagctagacggttagcttccctatacacgtgtgacactcggactagccagtcccttgtgaaaaagccttggcacaaccgtaccaggaaggacagcggatgagccttgctgatccctgtgcttagaaaccccaccaccaattctgaatccaaatttaactccacccgtcgaaagcccttatcccaagcaatgagcaacccatagtaggcaccccataactcagctaacggcgcatcacaagacccgatattaagtgcaaacccaccgagccattccccctgcagattaaggattgccccacttgccgcagctaatccctggtgtcccctcgacgctccatctgtcgtcagtttgacccacctgtcgcttggtgccttccatcttatcatcctttctacccgagctctcttcacatggttatttaacgttcccacatgagctttccgaacctcctctgctatatccttgatgaacttcaatctatcccgacataacttgcgttccccaaatacatcgccacatcgccacttccaagcccaccatatccccatactaaagagcgtaggccaatctcccttcgccggatccagatttgtaaacaaccattcaaattgactgaaaaactcgttctgccttctttgtggcagcagcctttgccaaataggtgtcatcgccggacagtccctcaacacatgtaagatcgattcatcagctccattacaaaccgaacaagttgcaatgtcacttaagtgtctcctcacacgctccacattagtcataataaccatatgactcaccaaccagatgaaaactcgtaccctctccggcgctaccagcttccaaatttgctttaaaaaactccctatgagtggcctctcctcagcctcaggtttcagcagctcataagcggaccgaaccgtgaagtccccattttgcgttcccttccaagataactcatcacttgtccctgggaaatcatgcaccacaatagaaaataattttcgcaagatattctccagcaggtacagagttagagctcccatgtcccaccccgagcctgcaatctagtaatctgctgctaccttaggagcgcatccgccgatattgattctttggccaccgccgagagttgttcctgcaacagccaacgatccgaccaaaaacttatagttttcccatctccagggacccatctgactcccttagccaccacttctctaagtccaactgtaacacttcgccacgtggagctccagctacttttaggtttcagccagtttgaattttgcatttctcccaccttgtacttcttgctaaggactcttgcccaaagtgtctccttatcatggagaagacgccaccctactttagcaaccaacgcctacttcatctttgggttgacatatcttattccaggctaagaggtgcttcttcttcttctccaaagtactcccccaaagaaaattatgtgacaaacaatccaagctatctaaagtagcaacaggaagtattattgcactcattacatggaccggtatggttgacaaaaccgcttttgtaagcgttattctccatgccagactcaaagaccgactcttccatcccgccaagctagacgaaacgtgttccaagacttccccagaagtctctttgttcattctcttctgtaagataggcattcccaaatacttccccaactctctagtacagccaatcccactctctccacttatcaacctttccatatccctactcacattattggagaaaacgatctttgacttctccaggctgacgttttgccctgaagcctcacaaaactgttccaacactcgtcgtatgataagaatttgggctacagacgcttctgcacatagaatcaaagtcgtatgcaaaacaaatgtgtgatagtttctacccaccacacgagagtgccatcggtttccagtcccatgttcccactgatgcctctatcaagtgacaaagcctctcaaggcaaagaacgaacaaatatggtgacaaaggatccccttgtctcaaacccctagcaggaacaaaagaatcagttttccctccattccataacacactcatcgatgggtctgttaccccagccattattctgtgagtccagacctccgacagtccagtagccaccaaagtttcctgcagaaaattccatcgaattcggtcataggccttttcaagatccaattttaacaacatccaccctttccttcctttcttcctccgcatagagtgaaccgcttcttgcactaacacaatattatcaatgcttaatcgccctgggataaaattcgcttgagccggcccaatcagcttcaaaataaccttctttagccggttaactatcatcttagtaataatcttaaacaagacattacatagactcattggtctaaactgtgtaatccgctctggcttagccactttggctatcaacacaagcaaagcatcattagtagccgctgatagcaccccagtttcaaagaaatccagtacaaagcgtatcaccgacggtcccacagtctcctaacattgctgataaaaaacaggctgaaaaccatacgggcctgatgccttaaaacgtcccataccttttactgcaacgacgacttcctcagaagtaaaaggtttgagcaacgcagccttttccccgtccgttagtgttgcaaacccgcctattggcaacatgttccatactgcgctaacatcctccaaagagtatagcctcgtatagtagttcaacgccattgtttccaactccaccttatccgtcatccatctgttatcgccatctttcggcgattctattcgattcctttttctgcggataattgtggaagtgttgtatttttgtctcccaactcaatatacttttctcttgacttctgaaaccacagcgtctcctcttgttccagaaccaagtccaagtctttcaataatatctcttcttgagcaagcaactcatcggagtgcatcacatccaacaaatcctgtactgccttaatgtcagccaccaacttctcttttttgacatgaatgtctccaaagacctccctgttccatttctttaactttcgttgcagcccaagtaacgcctctgtcgtcgacaaagctgtatcccaagacgctgtcaacaactctttgaatcccccatgactcaaccaggttgcctcaaatctgaatgctcgtcatcgtggatctaacttctgatacggctccaactgaacatatagtggagcatgatccgaggacatgaaaggtaagtgagagaccacagcctcttgccacttttgcctagcatgggcacagcccaaaactctatctagccgtttagccaccatcgtgctctcttgtctacccctcctccatgtaaacttattacctctgaatccgaaatcaatcaaagacaactaattgatccagtctccaaaagctaaaaaatctggtgaaagcctcccatttccacccattctctcatccactctcaagatggtgataaagtctcctccaattatcaacagccctaccaaaccagatacaacttccttcaactctccccataaaccactccgccgactcatagatggcgccgcataaaccactattagattcatcggatccccattacagaccaccttagcgtggatatattagcttgttgacaccacaatatccacttcccccacactcgacttccatagcacccacaagcccccactctgacctgttgcatccaccctatatgcattctcaaaccccagcttctgacaaattctacctgctttttcacccccccccccccccccgcgtgagtctcaaaaagcgctagtacctccgtatcaaatttctttagcatataccgtatcgatcttctaaagatggatttattcgccccccaacaattccaaagcatacaattcatgatgacttcacataaactcataagaactaccggggagtaccattacttccctccgctactgatactatggctgcatgccccttctttcgggccaagatccatcgacgcacttccactagctggtgatctgacctcctctccatctctctgattcccaactggcagctgtgcatttcctaaattcctgctactcccattagaaaacgcacctccaggtctgcctacattctcatgctccacccgcagcctcttcctaggtgacacttctgtttgctctcctctgatcgttccaaacaccaaacctctggtagcgatcgtattccttccccctttacctttccgtccccctcctttcattggtttatagtgaccagctctcctatctgttattaccccaagccttccttttccttccactaacttcccatcaggcccacctaacctcacaacgctggttaacgcagccccatccccctcattctctttattttcttcccctgagctatctggcaccagcatcccttgttcctcttctctctttccacactctttcctgatctcttctccgccgatccccctgctggaaacgtcattccctttccttggactggcccccgcctggacagtatacgtacctccgtaaacccatcactgggttggtccccaccacttggactagcaccactctcagtactggtgacctgcaccaccggacccggactcctcttaggacaagctccagccaaatgcccaaaaactccacacaaagagcagataacattcaaaccctcataagaagcatagtagcattccccattcaccaccactgtgcctttcaaaggttgcttcaggttgaccttaacacagacccgcgcaaaatgtgctctctccttcctcagaatagttaaattcaccttaatcggtttccctaagccctctactatcgcggtcaaaattgtctcatggtagtaattgacaggcaggtttgagatgcgaacccacaccaaagtggtcacgatctcgtcacggattggattgaagtccggcgaccacgcccgaatcattaatatactgcctagtaccctccacggatccccaatagccgctgctaaataatcctcctccaaatcaaatttcaccatgaagaagcttctagggagattcaacactgacatccccccatttggcttccatagctctctcaatcgccgatttaggtctgcaatcgtgatgtggcgtcctaagactttgacaaccagacactgtaggtacaaatcgttcatcgcgtcgaggacttcctgtccaatcgtgatgatcgcttcaccttctgccccagtcagaaactcgacattcatcctcgaagccacaaactctgcactcaatctcgtctcaggaattggaattcctccacagtagcaactttgaaccttatcgacccactacggcgaccccgttaaaccccctcccggcggccggccgttctcctccatgtgctcatcgagatctcctggattcacgaccctagcggcgctagggttttctatcgacatcgccttttcaatcttttcgattgaattatggaaacagctttctaaaaaagattttaagatttgttaatgattgagttataactacagagctaattcggtagagtcttaaagaaaatactgttattttctttctttatttaatcaatttttacaccaactttcctaattaaaaccatttgtttctttttaaaatcaatttctttgaatgattgtttaacgatttgatttaaaaccaaagtttatgataattaattattttatgattgtaatatttaaaaatatttcctaaatatctcaaagaaatcataaatgctaaatcagttttgataatatttatctattttaattatacaaaaatatttaagaaatataataatattatattattactgtaatcatcgtttgttatctctttattactatttaaatattagttgttattttataatttatttactatttagttttgaaactttgacaaatactaaaaaactaaatgaaaacttcgtgaacaaattgaattagttagcatttaaggttttttgaaaaaacaataagaataatccggtacaatatttctaattaaaaacatatgttacatttaaaaaacaacatatctggtttttgttaagtaaagtttttgtttgatattttaatatctacataaaaaatatttattgaaaggtgataatgtgattggataagtaatattttaaaatataataagtattataaatccctatagtataggagtataattagttttctaatttgaaacccacgtaattatgaatggtattgaataagaaaataaattaattaaaaaaaaaagaaagctttttcttcccaaaatctggctgtataatttgatttttactgaaaaagtcaatggctactatgaaatgtaatggatgactaagattagaagttatgacccattattttaaaatccgggtcaaaaggatccgcgcgttttgaaacgagtttttttcattacagaaattttttaactcaatggcaaacttgttatttcttcttgatagtcttgttatttgtaactccaaattaagataatcaaattaaattcatcgattgaataataaattatgtactttattttgagaggagttaaaaaattaatatataaataatgtggacttttatgttcccatccattatccatttatatatgttttcttttgtgtgttttacacttatcacaaaaaagggtgtattgaacttagtattttgtaagattttgtggattttagatttggagagattttaaaagacggctagtgatttggtggatttttagaagaaataaaacaaaatttaagtggtcattgaaaaaaaagttagtgatcatttagtgatatttgatgtcaaattccataagattttgaagtattttgtgtgatagtccaaaattttttttgctaactatttaaaaactcataaacgtttctacgtgtgaatgaaaaattcaaaatttggagttgcacattggcgaattccattaattacaaaaaagtatcagaattataaagtttcattcactaatccattttttatttaacattccatttgctagtccatccatttcgaaattttgcaataatacgggggtatattcgtcattgtatgttagtattttttagagaattgataagtttataatttgcatgttttacacatccttttatcaccattttgagtctagtttcatccatctttcatagcattcaccatcatttttgtacattttgcatctttagtcgagtctaggactagtcttgcatacattctgcattttggagttgtttcaggtgttttggagctattggtgctcagaaagagggaaaacagaacagaaagtcacacttccaccaaacatactcgatcaccagtagcagagagggaagcagtcagctcagcagtccatctagacacttctactcgatcatagacgagaccaggcagtccattctgccagatatactcgaccgcagaggagaggaggcagtccattctgcaattctactctatcgcagaggcgaccaggcagtccactttgccagtccaccagttatactcgatcgcagaggagaagaaccagtccatcctgacagctgacacacttactcgatcacagagggcaagaagcagcccggaccattctgtcaaccaacctactcgaccaccagctcgaccctttgatcaatccgcactcaaccagacaacctgagcatcggaaagagaagagaagagaaggcccattcgaagcccattcgaagcccatcaggaagcccactttgagccgacactcttgatcacactgtccatgggccgtaagtgggctcgaagcccgctatcttatcttagtataaataagtctctaagggtttcgccctgagacatgcactttagagacacgaatttcgcaccattattcagcagccgcttttcattcctacaactttgtatttcgatttttcttctaagttattcagaatttgctttcattttgcttgttcatctttcgtttatatgttattgtctttaagcatgttgtctgagtagtgattaggatttctgaggatgggatagagtagttgtggaacccctggtcgaatctgttggttaagtgtagattttttgaatcccttgtggattagttgtgtttactgcttattcctttctgatcaactggaatccgatcccagacgttccagcgcccagaaggcgtttaatggaacgttggatctactagttccagtgataatcgtctctatcccaagggattggccgtttagagcggttattggctttaacagtcggttcttattgtctgcttagttagagatcgctaatgggaattaggcctgtgtctagctatgcttgaggatttctatcacgggagtaaattaatctgttgttgaacctgttgtctagggatagcttgattgagatttgttaaccaacggaattgatcagggagaccacactatccgattatcccatccttagggatttctctgtttacttacctgcttcattcacttgctattggattttagtattttttctattttcaaccattctactcgatcacaccagtctactaacagtgagactgcgtgatagagtaaactggtccatttctgcatattcactctctgtcatcgtgttgtactcgatcacagggtcccttctggcagtcgaccctgcgatcgagtatatcagtcatttctgtcattttttactgttttctgcatcaacactaggactgttagaaaaccaaccaaattctgcctggcttgacttagcaacttctgatcatatctcatctgtctgcatcacacccatttggattgacatctaaaatactacaacgacaggatagtgttttaggattaattgactaaaaaacctactatcaaaaatatatacaaactaaccatgataatgaaaagaatcaataaattaactatgatatacaatgttttgtcagagggtagatgaaacgaccattaaacctttcctttcaatttatatgttttatcgtcatcaacaacatcttatttctcaccgtcatcaacacaacatccaccaccatcctcaacatcaccaccaacagtcaagatttaattgcccaccaccctcactccaaccaaatcaatattccttctattgtcattaacataacctccaccaccagggacggcccaaaccatttttcatgcctaaagcaaacaatactttaagcctactaataaacaaaacttaaatgaaaaaatccaaaaaaaaaagaaaaaaggaactcgaaccagtcatctcatggacgttttagtacagttacacgactatgccacaagttaaatttgaaatgatgacctcaaaacttttacaatatatttgttatgcctaaagcaccagattcatgagctttagccttggaccgggcctatccaccatcatcctcgacaccaccgccaccatgctcttgaccactgccaccaccatcctcgacaccaccgccacaatgctttaataactaatatagagatatttatcaatatttcatgctattcaataaaatcgaataaattcttgcaattatgttctatatatttcatgctattcaacaatatcacatgaaatcttgtaattatgttctatataatttcatgagattcaacaaaattacgtgaattttcacaataatgtccaaatttctcaatataccatgctattcaataaaattgagtgaaatctttcacaacaatgttcatatttggcaatatatcatattattcaccataatcatattcatttttgcaataatgcctcctcaaccctcgtacattttctctgctacctattgttctctaattctgaaaaaatatagaaatgattatttggtaaatgtccctcttctaaaaaatcagtctatggttaatttctgatagaaaacaagtcaaacattattttcttaactattttacagttaaaaggttattcagtaatattaccctattttttattttcttaggtcatcttctcagtccttaagtaaattactcattttcgcatcaaatcgattttgtttgttctctgctttttggtttagggttttagcttttcaaagttaaaaccttttttccccccgaagaagaatcaatacgaccgatcaaatcaatccattgaatctatggcgatggctatgagacttccagcgatatctagagctgtgacggaagtagcttcgtctccggttggtttgagacgactgttctgttcaaatgcttcaaggttctcttttctgtctccaccggctcgtcgtcaggctgaacctagcaccaatctcttccactccggtaacaaacccttttcatctctcagttaatttctggttctttcgagggtttatcgttgttcgagtatatgtttgatgctttttaaagatccttcctttatgaattcagatttagattatcaggttcgtctaagatgaactatatgtgtttaagaatttgataagttcaattattcatttttggttctgatttccagaaaaatgtctgctttcgattgcttaactctagaaatgtattgtaagagttaaagagagtttctttgcactcaattacttcagaattcggtttgttcggttaaaatttggatgcttacgtgatgatatgtgtaccggatcaatgtcttgtttcaagggtctatgtgggctgtttctagcatcttcaaggcttctgtttttgtaaactacttcctagtatcaattagtttttgaaatactgcttaacattgggctttgatgcaagcaattttgattaggctcttacttttgttccttcatagcctctgtttctcacttttatcacatggccattatcacatacatacatctaaggaatgttatgtgttcgatactgtgtctcagtttcgtgaaagtgtctttttgtcatgttatctttatctttgtgtcactggatatttcagggcttagtaagcgcatcacttctgaaaggtccttatggaaccgaatattctctcggaacatgggtggtggtccgagaactttccctggaggactaaacaagtggcaatggaaacgtatgcacgagaagaaagcaagagagaaagagaacaagctcttggatcaagagaaacagctttacgaagctcgaattcggaccgagatccgagctaaaatgtggggtcatccagattccggtgagaaaacggcgaaattgaagcagagtcatggaccaatgagcccgaaagaacatatcaaaaccttggctgatcggtttatgaaagctggtgcagatgatttgtggaacgataacgatggtccggtgaagaaatttgatcaagggtcgagatcatgttcggattcaattgattctacacctattgatgtgaggagattagtttctgcgacatgtgattcaatgggtaaacatcgtgttttggatagtagtaggagaggtttttcgagtatgagtagatttaagagaaatgagagttcttgtgatgaaggagatgacgttgatgctaaaaagttagatactttgagtcctttttctcctaaattttctggtaccaaggagaaagtgaagagctcgacgagtgttgttggagttataaggaacaaaggtttgtttggaagaaggaagtttaggaagaacgatagttcaactgaagaggattcagatgaagaaggcaatgagggaaagatgataggttggatggatttgaggaaaacaggaagcagtgcgtcgttaggaaaccacgatatcaagctgacgaaaagagtgaatcgtaatgtcacagacgaagagctttatcctcctttggatattaatagagttagagaagatctcagtaaaaaacaatctgtggataatgtaatggaggagaagcaagagcctcatgactcgatttacagtgcaaaaaggtattttaaactcgctgtgtaaaggattttgatttgtcaagtttgaatcttgatgagctctgttaatggttgcagatttgatgagtcttgtatatctcctttgacgcttaaggcgctttctgcgtctggcattgttaagatgactagagtgcaggatgccactctctctgagtgcctagacggtctgtgttcttctagttcttttggctcaaatggtttgcatttgacaacgtattatcctatatgtaacgcaggtaaagatgcattagtcaaagccaaaaccgggacgggaaagagcatggcgtttttggtattttacaatcctttctcctgagattatgccttagcttttgttgtttcttaagataacgttgtaagactgaaaaaacagcttcctgcaattgaaacagttctgaaagctatgaacagcggtaagggcgttcacaaagttgctccgatttttgttcttatcctctgtcctacaagagaacttgcaagccagatcgctgcagagggcaaggctctgctcaaaaaccatgacgggatcggtgttcagactctaattggtggtacgcgcttcagacttgatcaacaacgcctagaatctgagccatgccaggtttgaccaaccgtgattccctgtttaacaggaattgtttatattttctagttgttgtggtgaatcttcttttgtttccgtaccttgttgcagatactaatagcaactccgggaagactcttggatcatatagagaataagtctggcttaacatcgcgtttgatggcccttaaattgtttatagttgacgaggctgatctattgctagacttaggattcaagagagatgttgaaaagatcatagattgtttgcctcgtcagagacaatctcttctcttttccgcaaccattccaaaagaggtacaattgctatatagctaacttcatatattcttacctttatcacaaaatccaatgcggacacaaacgtctaaaatgtagtttaaattcaggtccgtcgagtctcacaacttgttttaaaaagggatcactcttatatcgacacaatcgggctcggttgtgtagaaactcatgataaggtaaactcttaagctcttctttttgtctcaaaagcttgttacttgaatctggttattgagtttcttgctttggttttaggtgaagcaatcttgtattgttgctccacacgaatctcatttccacttagtacctcatcttctaaaagagcacatcaacaacatgcctgattataaggtaaaacaaatcctcttaaacgattgcttttttatttctgaccttggtaattctcgtaactatccaatttcattctcgcagataatagtcttttgctcaaccggtatggtaacatcactgatgtacactctgctccgggaaatgaaattgaacgttagggagattcatgctagaaaacctcagctccatagaacatgtgtatcagacgagtttaaggaatcaaatagacttattcttgtcacatctgatgtatctgctcgtggaatgaactatccagatgttactttggttattcaggtaaagcacaaagcgaacattttcatgccaaaaacaaccttttatggatatttaacggattagactttgttttacgtttttggtaggtcggtataccgagtgacagagaacagtatatacatcggttaggtagaactggaagagaaggaaaaggaggaaaaggattgcttttgattgcgccatgggagagatattttcttgatgagcttaaagatttacctcttgaaccaattccagctccagatcttgattcaagagttaaacatcaggtttgttcgccttcactgtcaatacccataagtggagttttattgccaagtgacattgaggacaattgatttttgactaggttgatcagtcaatggctaagattgatacaagtatcaaagaagcagcgtaccatgcatggctcggttattacaactcggttcgagaaaccggtagagacaaaaccacgttggccgagttagctaatcggttttgccattctatcggtttagagaaacctcctgctttgtttcgaagaaccgcggttaagatgggtcttaaaggtatttctggtattccaatccgaaaataaaccgacccgtgttggtacttagatgtatcgtcgtagagagaaatgtatgaacacatttatggtcaacatcatgtttaaataattttgttatttatttatgaatatatgattaactttttaattacaggaatttttgtttgtctaagtcatgtgtttatatatttgactactagtgtaatggcctaaatggagattaattaattttaatatgtacattacagatccttaagcaaagtaaaaacatacattattattttactaaaaaatgtcccacgcgatgcgtgggtgaaatgaatgtagtgaaatatatgtctataactaatatatattaatataatattaaattattttataatacattcaataaaaaatatcataaatattgtgattatgatattttagttttaaactaaacatttagtttatgaattataatctaaaattattttgggtatttataaattaaaaattatcgaattgataaaaaagaaaaattataatattgatatacaagataaggcttgtgttttatttaaatatatgaaaatgatatgcaatatttctctgagtaaaagatttcataattgtatatatcatattgattatagtatgtgtgtaaattgtaaagtagttaatagatttgaagttgtgagattgataaagtcttgattaatgagtaagattaacatatatgaatattgatatattaatactaattgatatcaaaagaactctaaatactttatacaattaatattcaaattatttactatttcttccatctttgaacaatatggtaagaaagtattgaatttatttactaatgatttagtatatacacatgatttttaataaagaagtttaaagttatttcgatgcacataatcaaatactaaagaaaatataccataattcggttgaaaactaaataaatttaaaatttaaagtacaatgtaacaagtaacaacatacaaaataatttaaattaacagaatttccaaccaatgatatcaatgaagattatatattttgtatagtttcatcattcatcaaatctcgtaggttctatattatctttatccatataatttctttctatattacctcatttgccaacaaatgcatcaaaagacgaattattatggtcactataaaacttaagaaacgaaatatagtgtaaatttagcatgataagtaaaagataaacattttttcaattactatgattagtaaaatgagttataagttactgtttagtacataagatcaataataaatcaaatgtgtacaaataggaataatgtttgtatattaaactataaactaaatgaaaaagacgaaaattaaagaagtagccacacattaaaataaaaagtgaatatattaagcaggaccaaccaggaaatatcatatggatccaataaacatttggctatatatgtttatcatttggttgagtattcactgttgttattttttattgaaaaactaaaataattttaaagattaatatgaattttagcaacttgacataaatattttataaacaacattggtcaacttcaaaacatgaagaataagtagaaaatgaaggtaaaagatactttgtttctcatgtaaaagtgagaaggtaccttagacatttttcatcaagtcatttctaaaggaaatccacctttcacatattcacttatgcatatactataaaatttgactcaacctctttatttcaaaacctacgaaagtcacataaaattttgttttaaaagatatttagttaaatatatatatatgtatatctattaatactatgtttatatcctctattaaaatatcggacatgttcataaaatagcaggttgaagacaccgggttcccatgtcgaaccactaaagtgaagctaaaggcctttgacaccatttactaaactttgaaactttgactatggttgtgactcgaatagttaaaacacaaatagctggagaaaaaattagaaccatgacattaataattaaataaaatatacatcacagatgagcatcgagcaacacatatatgatttgcctacctattaccttcatcatgaacagaaattctcagtgttatgattgctaagaaattcttagtgtaataatttttaagccactttgtatctaccattgcacctataaaaggatgtattagcaaaaacacatgaaacatgttataaagaagagaagtaacaaagtgtgaatcagtatcaccacatttggacgatacaaaggctacacaaaacaaatattaaaattataaaaatgagagagagaaacttgattttagttcatttctttggtgaaaatgagaaaaataaaaaacaacgtaatacagaggacgaagcaaacctttgagattaccattctttggtttctccaatccgtcatactcatatggttcgtgctttgtcttttttctctttactttcaatttaattatgtggaaagacttagcagaccacaaaatattatttcgatgtttaaacaatcccgaaagcaacacagaatgatagaagcttaaaaggagttgtaagaaacaaaccttgaggaaccgatgttgatgttgttcctatgaagaatcctaccaggagcagcgtcaccaccatcgatcaactctctaagcccccaattctccacctcctcttctttcacctccttcttcttctccttctccacatggcggttattaggaagcttcacaggcaacctctcgaagtaattcccgatacttacgatgcacgtttttattatcttcgtatagaaagaatgaagcttcaacctcaagcgttaacaaatgcagagaaaccaacttaaaaaaactgacatgcagcgtcttgcattttataaggtgaagggttacactaaaaatgatattaaatatgatactaaatattgaaatcatggtcataattacataaatgataattatgttagtgtaacgtaactgctttgatttatgaaatagaacagtttagttgactaaaaaaaaactgcaatagttagacataataaataaaagaaaacgtgatatcacatgtgtcattaaatagaatattaacctcacaacataactgaaacgtattatgagtaattcattgttttttcattcaatttattatattgtaaatgatatttatgacttaagttatatggtcagttatgttgtttattttgtttcaagatatacaaataaacatttaatcgattatgtgagaggccaaatttttttaaaacaaataaacaaatgatcatattgtcaacaaacacataccataatctactcatacattttttatattttgaaggtattttagagaaaaaatatttgatctttggtttgaaagataaaactaatattttattctttaattcttgagaaattattttgttgagaaattctaatgttatggtaattatataaaaatattgataaatgatacatttttaggaaaaataattatttagaaaaagtgcattgcaaaaatgttataagttttttttattataaaactgtaattaaactcaaagaatatggaaaatagtatatttaaatttgagaagaatgacacatgtcgaatgaatagagcgccacttgtcagatttttagagtacaagtttgaggaaaccttactttattatataagatgtggttggttacttgttcgtcttcttaatttttcgacaattattaaataaaattgtgatgattgaaaactatataataaagacaaagtttgggaaaataaaaataaaataaagaaacgtgcgagagagtataggtggtagattctttttcagcttgttcacttgagtataatttttttttttttttttttaaacattatattaataaccgatacaaatgttatgaccaaaagtcacacagttttttgaagttcgatacacaatatagccataaactaaaagtatatagagataataaccaaatcatccgcttcggttaccttttgagatcagcataatagaaccattagccacgtccacggttcccgcgtccacgatttccgcgtccacggttcccacgcccacggttacctcttcctcgagtagtagaggacgcttgtatctccttagctttgatggatggtttaaccggtctttcgcgcaaaagacgttgtcccgatggagtcataagttccatcaattctgacccactgtctgactcaactgaaacaattgagtcttcatctgaatgaagagaatccccatcaggaaacgaagaacccaaacgactaaacctgttttcagcaaggacgtgtcttatctcacaatcactaagaatcacttatcttttgtgcctgcaatttcgaaaactgattcaactgtgcaagtttcctcagttacaacttcagcttcaacatttgtaaagcaatctgccactccggtgcaattatctttgtcttggattgggccagcctcaatatcgaagactgtatcgatttggatttttgaatttgtgattgggacatcaattggggtcttggtttgaagagtgattggcgataccaaatttgtggcactagctaaacttacaatagcaggagtaatgatctcctctgagacaatttctgttactttttcatgtgccaaatggggtttcatacagcgcgaagccttatgccctaactgcccacattttccacatttagctgggatccaagcatattcaacattaaccatcgatatattgcctttcttatcaactgcggcaattcttggagggaaagctttactcaactccacttccaccaagatattggcctcactcattagggaagggtcaagtctaggtttgtaagtagccataggagcacctaaacctgatgcaatatggctaattcctagaattgagtacaaccggtttgggatatttttaagggttacccagacaggaatagttgatatttcaggaagatcaaatgtatttacagtagaccaaggcgctacaaacataagacaatcatcaacatgccataagcccctctgaagaacccaagctctagttgaagcatccgggatgtgaaaaagaaattttgagtcacctaatttacggataaagattctacactttctaccctaaattttattgactaccgcatgaatcaaaccaccaggaggaggactacatctatagaactggcctaagacatattccttttgattcacaagaccttgcaagaagacatgacttggaatcgttacctttggaattccgtcttccatgaattccggcgaggttgccctgtaaaggttccttgccgctggatccatttttgcagcccaagggaagcgaacattatcctccttagttgcttcaagatgagattgcatcggtgctccaccaacatcttgctgagaggccgatgacgaggtgaactttagctgctttgcccaagctccttttagagtaggggagaccaacttaacaggagcaatggactcgtcgagagtagcagacactattggcggtaaggcggaagtaggaagagacacttctgcggaataagacaatgatgtaatactcaccacatgttcaattggaggctcgacagtgaccggtaaggtcgaatccagcgaagaagtaagattcacgaagtcaagagaagaagagcgagcaattttcggcgaggatccaattgtcaagggtttcaccagtgagatagaaggagaaatcactgatggagatggagaaggagaattctgcgtccaccgagtcaagtacggccaccgtggatcagggacagagttgacattggaagagtctacgactacaacttttggtccgacctctgtttccttgccttgagttaaaactgagacagaattcatcgagtgggatactgtgaagtgattgattggaagtaggctctcctaagaagattaagagaacagccggcgacgtttcgcggtggttacagcgaaacaaattctcaggggctcctcttggctgaagagtaatctcatacactcttcttataaagagcattttctttttgattttttttattccgtaaaaaaagtactcagaaaactctaagaatattgattaattacgacccaaccagggcaaatggatcccaaaataacccaagcccactgttttcgggtcaaatccaaataaaaccctaattcccctaattctctgcggtaaaattgattcacatctctttcttccctttgttttttgtttcttccttatttcgtcactgtaaaatccagtaaaaccattctcaattctcgtcaacgacaacaacataactgttcgtcgatcttggtatatctacaggaaactaagaaattgggtaagtgatttaattgttcgtcgatccgagttgtttcagattgggttttgtgatcgaaattgactgaagagtagtgctaatccaaatgattttgtttgtaggtttggagaaatggctcgaacaaagaacgcaggtgtgccattggcggcagaggtggtggtttcacagacaatcaatgacgaagtagtagtagcatcggctgctgaagtggattctgaagcaacaaattcaatctctaacgacgatagagcgatatgaactttaaactttacacaattagaaaagtataactatgtatgaatttggtatatctttattgatattgtaacttagaaattttaaaaagtatatctatgtataaattagtatatctatgcataaattgagtatatcttttttgaatctaacttagaaattttcgaaactaaaaactaggtatatctatgttcgaatataacttagatattttagagactaaacaatatatctatgtataaattaggtatatctatgtggagaagttcttccttagggctgtggctgatctagagttgtgcaaaacatttccgtggggaagatttgcatttgaagaaaatgtgaaagacattttctatttgattaaaaagtgcaatgaagtagttggtccacaaaaggtgtttcctagttttgttatgcctttggaggtatgtcatttcattatgcatttatgaattgttttaagaaagttaaactatgtacaactgtgtttttattagcagttatacttattagtttttgaaaaatcttgtattgtttttttgtagtatctagcatttgaggcgatcccagttctcagaaaaattttttgcgaagatattgaatccgcagatcctcagtgttcccggatgtgtaaaaggaagtttaaatcaagcactatgaaagggtttccaatgtcagatgtgtatgacaaactcggtacaactaaggttagtgatgacatatttattagttatctatcatgtatcatgtatgttctatcatgtatgttatattaattggactttcttatcatgcacaggacattcagagtatcttggcttcaactcctgatgagaagctacttttggaaagaattatggataaggagtgtgaagtgaatgatgtcgatgatctaatagctgatggctggaagaaacgtctagttgatgaggagaggactatatgttttgaaccgttgctcaatgaagatgtagcacaccggagctttgtggctaataaagctttgtctactgtggtaaaagctccaagaaaagccgcagtggaaaagaaaggcaagggaaaggctgctgcagctctgactagtccaagtgatggaggtttgactgaggttgtaaacgaaatgaagaatttgatggagaatggatttaagtccatgaacaagaggatgaaagatttctgtaagaagtatgaagagcaagataaaagactgaaactgatggaagctgcaatcaaatcaattcaatcaggcattggaactgaagacgcttgtggttcaaaggagattgatgataaagaaaacgagctggaggaagggagtgatgcagagactgagatagacaaagaggtggctcaaggtgataaggagagagaggttggagaaacagagactcagatagacaaagaggtggctcaaggtgacagtgataaggaggtggctgaaagtgagaaggacaaagtggtggctgaaagtgagaaggagaaagaggtggctgaaagtgagattggggtggctgaaagtgagaaggacaaagaggtgcctcaagatgatgagatggatggaggtaaggtggctgagagtgatggagagatggatggagagaaggacaaagaggtgcctcaagatgatgagatggatggagagaaggagaaagaggtggctgagccaagtgagattggggtgcctgaaagtgagaaggacatagaggtggctgatagtgagaaggagaaagaggtgcctcaagatgctaaggtggctgagccaagtaagaagcgaggaaaggcacatgaggatggagatgatcctagtaaagagggagttaaaaagccaaaggtggtcaagaagctggcagagtcgaggacggatgctaagccggtgtatcggagtcctatacagacgaggtataggagaaaaaagacaaagaagaatgtttaaacaatttcaactcttggtttgttttaggtataactatgttggttgttgaaaacttggtacatctgttcgaacttggtacttggtttttttttgtatttctccttatgcttttgaaaacttggtacaactgttgaacatgtttattaggttttttgtatatctacttatgttaatttcaaaacttggtataactgtttcatgttctattgttttattttggtatatctacttatgttttgtaacactaggtacaattatatgtttttgtaattgataagaaaagaattttaaccgaaataactagattcaacacaacacttagtctttataattagattcatatccattcatcacatcaaattcaacacttagtctacataattaaacattacaacacttactcttcataattaaacattacaccacttaggcttgaatttctacgacaaacacaacatgccaacaattgccatggtgattaaacatccacaactaaaaacgattaccatcttaaagtcctttccctttttattcttttccatcggatctctttccatcgtctcttggttcctatccatcttcatcactcttacttcttcttcaagaacaccgagttgaaattccaactgttcaatctcatgtgtaaaagcctcatctacccacttaaacacatgtttgtcgttcataagctacattttgaaattgtaaaaattgttaaatcacatgtatatctatgtataaactaggtatatctattaagtatatctattaggtatatctattaggtatatctattaggtatatctaggtattttagtgactagtcaaattattgtcaattgcatatcagaaatctataagtgaaacgtgaattgaatgaaaaatgtacccagaaaaacgaaatgcttacccaaataattccactcttctctctttttctctcttcttctctcttttgagtcttctctcttcttgtctcttcttgttctttttcgatttgattttttttatttttgttaataatagggttttaaaaaatttctgcgaattggggagaaatgaaaatttaggggaaattttttttgatagtgtgaaaaggaattgatagtgtgaacacgtttcttatagtgtgaaaaggaattaaccgtgggacccgcgtacgagttgttcagaacaaaaagggtggggcccgcaaactctttgcacacagatattccaagttaacaggttgtacctgtgtatacacagtttgacttttgtttttttttaattttattagatatacttaaatttaaactaaacaaatttagttataccaaagagttttgatgttttataaacattccacatattttcatagaaaaatatgtctggaaaattcaattttgtgtgttttgcaatgttatgatgataataattataaagttatcttcaaagtgtaaggtgtttcttttataacaaatgaatttggtaaagactaattttttgaagtttcattaaattatgattttattaatcagtagttttaatactcaacataaggggtataatttgtataagaaataacatcacatcaaattttgttgcaaattaagcacatttgttacatttgtcatagttgtacctttacaaaaccaagtttaatcaagttttacaaaaccagagagtacaaaaaacacgaatttagagacatacatagttctaccatttaaaaattaagtttaaccgagttttacaaaatctgaaagtacttaaaaacatgaatttagagccatacatagttctaccattagagaataaagtttaaccgagttttacaaaatctgaaagtacttaaaaacacgagtacattaatttccgcttgtgtattggccactcccctggctatcactttcgtggtttggaaaaaaccggctctccaagtttctgcctttcacacgcttattcttggggcgacgttctccaactgatgggtgtctagtttcttgaactcttccctttttaacaacatgaaccggaggatatgcaaacaattcttggatttcacttggaataactcactctgacttatgcggcaccggataaatggttctatcatatgccataacccacatctcaacaaagtaatatttcgtgatcaaatcatataaactttttacctcctcggatctatctttttgtttcaagtgagtcatcacagccgctattgcatgtacacaaggatacttgtccaagtcaaaacaacgacaataacaacttttattcctcaagtccaccacataggtcttaccatcgcgaccaatgacactatattgaagctcgtaggtgttaagctctatcaccggtaatttttgtgcaacttcacatgtttcatgtatctcgttctccacaaaaggaacaagtctctgtaaatttgatccacttaaggcttccttcctattattgcagctccattccgcaaatttctcaataattgcatctatcataggtaatagcgcataccctctcacatccctaaacacaccattcatagactcaaccgcattactagtgtcaacgttgtactttactcccggaaaatgacatcttgcccatttttccaaatcagtgttttcatcaagataggtggctaccttagggtgccttcttctaaactctgcatattcatgttcaaactcagacactgaacaaatggatgcaattcttctgaacgttttagcaacctcttctttgttgtatgcaacttttgttctcacattctgtgacaaatgatacacacagtttccatggtgagagctcgggtacacctcagccactgccttgatgaggctagaatttctgtcagacataaagaccaattccgaactgtctggtataacggttttgagagttttgaaaaaccacttccaagtaacatctttttcgccatcagctacagcaaacgctaagggataatggtgatgattcgggtcttgagctgtggcaaaaatgagcacacctttatatacagtcttcaaaaatgttgcatccacaataatcacttttctcatgactttaaatccttcaatggcagcccccaaagcaacaaataggtacttgaaccttttttcttcatctaataccacactagtctttgtgccaggattcaccttctctaacaaatacaaatattgataaaccatcttgaaactctcctcgggactagcacgaatatcactaacagctagtttttccccctattagtagtcgagtatgacacagttgtaccatgttttccctgaacaaggccaatgagacttttaggagttggggtcttgtactgacatagataatcttcatgcaatacggttgcaactaaacgtggtgtacctctccttttaatgcctgtagcagtattcgaccgtacacatgtatggaacttcctatatgttcgaaccgagaagcgagttgaatccttagccttcgaaaatcgtatgtaccattcacacccttattcagtacattttaccacataccgcttcttatccgagttgagtaatgttagtccaaaacaattcctatttgctcctgtcacatcatcgctattttcaaattcttgacctattactagatcaagaccatcatcccatggacctttaaacttagaatgttggctgtcacgtggttcctcaacatattcacgaataccatcattctccttactcatactcatattactattaacaccattatccacatctctaagaggctccaaaggctctaaaggctccaatgtctccaaaggctcagcaagttgttctcctagtggctcatttgcgtaaagagttatagcaccaacattagctctatcatcattatctagaccaccaaaattctcctcttcataattcacaccaactgaactctttccttgtactctcgattgttgctcgtttaagtgaaccatttccaactcataccgacttctacatgcaagacacttctacttttctcttcatccaacgtggttagataaacatatacatcatcatcatccctaatatataaatatgtaggaggtttaacacccgttggaatgtaactcaatttcagcttcatcgtagattcatctatcttcatctttgtgcatatcttatccactaaccacgaataagtaatctcctccattgatgatgtactaaacaatataccatacaaaccaactacttttggattccattgatatgcttctccggtttttgaataatatccatcataatcaaaatatatgattatgcccattctcctggaaaaaacaaaaaaaaaaacgttagctatacttagattttcctgttctagcaaattgtacttcgaacagctataccacgctcattttcagaaataccagttatactattcaaacagctataccacgctcattttcaaaaataccagttataccatcaattgtacttcaaacagctataccacgctcattttcagaaataccagttataccataaatagtgcttcacacagctataccacgtttcttaggtatacctagattattctgttctagcaaagattttcggaccaaaaacagtaatctgcctaagattaactacgaatcaaccattacagtacattaaaatgtcttaatagacccagaatatatagttaccaacataatgtctattaatttccaacaccaatttcaaatctatcaaatctaattgaaatctacaaaattcaaacacaacaacacaagacttgatgaattaagatgtccaaagtataagaagagaatggtaaagctcactttgaataacagaagcaaaacgacggcgagcttggtcgattggattcaacgtcggaacaaatcgacgttggctgcagtcgtcgatttagattttgtgagggaggaaaagaaattctgggaatttctgataggttaatattttgtgacttaaatggtattggtttggagacttaaccgtaattggttggtttggttcgtccgtccggttccggtttgttgggtaaggtaaacaaggatttttaaaattcattaagagtataggagtatgttagattatatgagagtatttagactcattgtccgattacagctccgtcgatttgatctgaccggagactaggtttcgccttcgagagaaaaattaggggcgcgtgtcacacaccatctttcctttcctctcaaccgctatcaaagattgttcatcctgaaatttggttgctttctttcatcaacttctactttttttctaatcagcttctcgtccctcaattccaccgccaacaaatcatgttcttttttctctgagatagttgaatcatccacaaaaatttttgatttcttatctgatggttgagatttaatatcagagtggacatccatctactgcaagtttacccacaaggcagcatcaatgagtgaatccctgagtaaaaaaagaagtggaggaaatattagatcttataaactaatggttaaaacgaaaaaaatttacacatgaactaaaggtgaaaataaaaattacccaagatctttaaactaaagattaagcaatagtgatgatctccttaactttattcatcccaataatctctctaataatgtttgcaaattagaaaattgcataaagaaataacttacgtttgtatgaagagaaaaaactgtagataataaaacaaattatagcgatggcaatgatgtacccataatataatatcctacttatatcctactttttactttttacagaagcttgtatcctacttccatgtttcaaaataaaatataaaccttgtcactaacagtttacatcaagttataaaagaatacattgatttagacaaatatccaactaaaataaatttaattttataaaaaaaaaatatccacaaggtcgtttgattctaatccaagtcattagtagtttgtaacgacaaagattagagaggcggtttagtatatgtgatactgtttcatatagcaaagaatgaaatatagaaaattgaatcaaacgaacctcttataataccaaacttttaaagatggtaaaaactataatgtagtagtacaacagagctctacattagtctcatcagttctccttcttctaagtaaatcttaacataggtcatgatataatagattttagtgagacttcagaaaaatccacaaaattgtaccttatcatctacaagaagaagattcaatccagtgaattcccttatttatccttttttttggggaaatccccaagggcacttctcaccttgattttacatcgatccgttactagagttatatgagagataggtgtaatattgagtgacataattggagattggaatttggaatatgaacctacaaataaaaagttgtttttcttaaatagagaattttatgagcaagagaaacttatgcaatttagataaagagaatagaccatgtgggtcagtggttcgacacagtaatgccaaaaattctaaaatttgcagacacaataacaccaaatcacttgagagaagataattgaactataacaaaatttacaaacctgagaaatacgaaaacttgtaaacttgcatagaggaagagacatgtgattgatgataaaccctaaaagtaaatcatgtaacgacatcatacccaaagatgaattggaaaccaagaagggatgatgtgaagaggagaggcaaagtgagaggcggaagaaataatgatactttttcggttaaagaggaaaggttgaaagtgaggaataatagggccatgtttgtttgatcatttggaatttgcatccaaatgatccatccaaataatccatttgaatgattcatcttaatgatgtttgtttgattatttgctaatcatttgctaattcatctaaatgcatcatttagatggagctttgtttgtttgatcatttggatgaatcattcacattctcatatatatatatataaatgactaaaatgccctctgttaagtaacaaataatcaataactacattctcatattaatcaaagtagagtcttaaaaagagagttctctgtttccattttctaagttccttcttatgctctgcagttccctagcccgaatgagtactcagcatttatgggagacttctcaacctgcactggtgttgcaacattcacaatgatgctacaatatcaatgataaagaagacacagtaaatggttgttagtaatagtgattgatactattcaatgattgatagtactagtgattgatactattcaatgaaaggaatacatgagcttagagaccaaccaatattcacgtgattcaattatgacaaaccaagcttaaagacgtgatcatgtgaatactattatgaatcttttacagaaatacgtagatacagagacatgtgcaagtgaatgaaagatgcagaacttgtaggccctttgatgttctgagagaagttaaaaccataaacctgaagaaatttcaatagattcctagtgtctagattagttagggaataaattgggaatgagaaataaaactaaaacgtctaaaacctttttttcatgagaatctaacaaaagatgttgcagagacttgcccttatattcatcaagttattcattgtgttgtactatattagtagtgttactttgttgttcttatggttgcaaagaacattgtaaacgcatctagattgaaatatagtttcaacttacgtagaaagcgatggatcaaacgccctaactatctgaacatggcacattacatgatctaaagatttaggatctaaagaagtgggaaggctttgctaaaacgaaggttagctaactccttaaactcagacacttaacagttacatatcatcaccatttaaactccttaaaacaataacacactaaacagttcataaacgaaagaatatatgatgatgacttacagtgattcttccttcaatccttaaatccttcaagccaaatctggatcctagctttctgcatcaaaaacacaaaagacctataatcaaagtaacacaactaaagctaatagaataatcaaagcaacacaaagcaacataagcaaaacaaagccgtaaactaaagctaatcgaagaatcaaaagcaacacaaagcaagcaaagcaacacaaagcaacataagcaaaacaaagctgtaaactgtagctaatcgaagaatcaaaagcaacacaaagcaagcaaagcaacacaaagcaacataagcaaaacaaagctgtaaactgtagctaatcgaagaatcaaaagcaacacaaagcaagcaaagcaacacaaagcaatataaggaacacaaagccgtaaattaaagctaatcgaagaatcaaaagcaacacaaagcaaagtaaagcaaacccacaattaaacaatgtaaccatggtggatcaaacccaagaacaagtgattgcaacaaggatacaaagagaaacaacgagagagacatggagcgagagagaggaagcgagagagagagagagagcaacacaaacctgtacactccggcgatggatccgacgagtctccggtgaagagaatcggcgactgcgagaaaaatcggcgacagcgagatcacctcgacgacaatgaatctcgttttcagtgttttgtgtcgtggagatgctgaagaagagatgtggtttttgggtgtaattccatatattagattagggtattattgacattttacaattttggctgaaccagcttcagcagaatgaatagattaaactcagtcagattttctttattttttggatgagtttagacaaaagcattcaactgaatcattcaaatgatctcttaaaacatgaaaaacaaacatcagttttaatcttcattgagatggtttatccaaatggacaaacaaacaggacctagatcgtgtgactgaatgacccgagcagttgattttctttttgtcgtaattttttttttaacttaacaataaggtgtttccttttacaaattacaatcttgaaaggtgaaaaatgagacttatgacaggtgtgagaaggagaatgtgacagttttttgtaaattaacttgtgatttattagataaagatttgaggaagtttgtttattatttataatcgttacaattgaaatcatatatataaaagcttaccaactctctccataaaattgacacataatcaatttagcatttgccatgtgtctattaaataattaatgtaagctcttcaacttctaatttataggttaatgatatatttattatttaattttatatacgattttattttatatatttaattgtactattactaaatttgttttaatattacatgacctttcaataaaaccattttaatagttttctcatactcggagattttttttaatccaaactcaaagtatgagtgtataatagtcgtggattacttaatgatttaagttagttattctcttaaattgatatttagattctcttatattgatatttatgtaataaatcactgagggtgaagaatacgtaaggagctccatcatcaaattcttaggtttctggaatgcaacactaccctctgttaaattgatttaagagaagcgttgtttatgaattctgtatacgatgcattgttgagaatgttgttaagaaaatattttaatactaaaagtaattgcttattgcatgagtgaatgattagataaataaaaattatatttaaattaaacaatataaacaaaatccaaaaaaatgcggcgtagcgcgggtgaacacctagtgtaagtaagggaaaaattgctcaataataacatcattgatctcatttcaaagttattaactaataaattaagaatgaaaaatggagttaataatttactaactaaccgcattaatgaataaagataattatttattagtatatgatcttttatatactaaatacacatgcatctagttcaagctaagtgaaggaactattttcagagtgaagcaacctttccaaatttataacaagagagttccaagtaccaaatatcaattttttctcactcttaattgtcaccatgcaagtaacatcttcaactacacatacccaaaaatttgaaagatttcttattttttgttttatttataaaattaattggctcatacacgcacatatcgtcgaagatagagatagtttacggtgacataggctgtacgaagttacttttaagtccatcgtacatcaaattttgggtttaaatgttagatatgcaattttttatatgggatataggatatcgatgatttttttttttttttgaatagagttggtgttataatttcatgtgttggattattcatttaggagtagtagatttttcttctttttttgaacaaattaggagtagtagactagtagtcaaggtttgttcattatcgaaaataaaattcataataacagcaataaaacttataagttataactccaaatgacaaggtggttcgttgtattttgctagaaatataaacttgaaattttcaaataattagtaagttttagacattaggtattctcacaaggcaacattccgaaacagtaggagctaccacaaacagcaatttaatttgttgtccgtattttttctggtgacacggacatctccataagtgataatttaagtcgtcctcaataaatttagttttgtttacacataacatccaaacttttgttttataaccttaaattgaaagtaaaaatattttgaacagtaattgtattccaaagttttttttgtttttttttttgcttataaccaggagtttcagggccgatgtccttattccccctcaggatccgggtaagaccaggtgaaagcccctggttaagtggaaatgactagcaatttcgcgtttgcggggaatcgatacctggtttggaccaacagggcaaccaacagggcaacgcttcctcaaatgaaaccactagagcatgaccacttggtttcttttccacaattgataataaataatcaataatagactgattggtaccatttaaataggaattttatttgtcataatactcaatctatttacttttggaattttcataccccaactttttggttagaagaaaaatacttcatttaaaatatctttgtctaaaaatacttcatgttgaattattggtggattcaagtttacgacttaataattattaacaaatattacaaaatcatttaacgacgttaaatgttaaccatgtgtatataaatagatatatagactttttattcaaaatcttacaaatatattggtgtggtctagtagtaacaagtagtttatttaatgttactgcgttaatacgattgataagcaggttttttacacctacttatatgttgaatgtgtgtgttcagttcaattcctctaaaacacaaacatgtcgctgcagttatagagggtgtcaatccagtccactgtattactatcaatcaagatgtgtacaaaaacaactaagtcaagccaaattataaagatggtgggtttctagtaacaatcctagatcaggattcaaacaagtaaaaatgagaacttaacagctctactcgatcaataggtcgagtagaaccaacaggtgacaaaattaagaactaaaatgcaatcaacaggggatgcaaataaaggatacaaataacaggtaaataaaagtgcaatcaacaggggatacaaataaacctaatagaagttctaaggatggattcattgataagggtaactctagggttcatcaaatggctaataggcgaaaggtagatacccatgacgatagattcaaaaactgggtcaatccactctcgtgacagagacccccataactctaccacttcctaatctcaactctcgttgatgaaacatagcagagcagggtttaagaaacaatctaccaaagccaataggcagacaagtcaatcccttggtcgagtctacagatctctggaattcgtaggcagacatccatttgaacgtcttttggacgctggacgtctatgatcgaatctccacattagccaccgaaaaccgcataggggccaagcgaatccagaagggaataaacctaaacactaaccacctaactaacctagagattaccctaatctaatccatcctcaagaaccctaatcactactcatgcaacattctcaagaacacaaatccataaattactaaaatcataccaaaatgtagatctaaacaagctaaacaactttacttaaacaatcaaatgcaaaaacgaaatagattaagaataattaaggtttcaagattcataaaaacaaagaaaaactgaaagataaagcattgatattttggacaaaccccaaaatgatctatttatagtaaaatgttgaaaccctagattcactagaagacaagagacttgaagcgatttgggcaaatactcgatcttggggatcgagtaaagagggtgctgcaaagtctgcgcctttgtgtctatgctccgagtgatcaattggtcgagtagatgcttcatcctctcctatccgtatgcttagatgtctggttgagtggggaatgaggaggatccgaagacgctttgatagcccaacaagtcttgtagagatggtcaccctaggtcgagtaaatggatcgagtagtggatcgagttggaggggcgagtagatcaatctgctgcttcatctgaggttgccttgatcgagtaggagggtcgagtaaactgcagcctcctctgtggcatcctggatcgagtaaagaggtcaagtagaatgatgtctcttctgtagctgcctggatcgagtgaatggatctagtagagtccttttaagctccttttgcacctgaaaacacaccaaaacatgcaatgcggatgcaagatgatcctagatgcctaagtatgcaaaacaagctaaaatggtgcaaaatgatatgatacaatgagcaaatgcaaagctaaatgatgattaacatacacctaaaatgtgtaaaatacagtgttatcaacaatcaaaactccatctttctcgaaccatttcttttatctctccacctttaccttaattcttctccacttccgcaactaacctactccacgaccacaaaaataacatatccagcaccgtcgtcatctttgtctcaatctctcatgtgttaaatgtatttaaatttaaatttgtaggagtgaagaaaatgatgtatttaaatttgtatgacgtcattcattatagaaaataagacatcaaaagaagttctatgcaagttgaataacaaacgtgttaccaccagatcaagcaatatatttgtagaagtttgtaaaaatattgtatttatttattcttacatggaaagttaaaatttaatgtagtttactgattctaaaacgcctcgttaacggctgttaaggagagagatttgaatctactaacaatttaaaaataaagtttttaagacaaaaatatttaaatgaggtattttatcttctttggctttggctttggctttgtatcttctagcaaggaaacactactatagcttttgggatctggttgcggttctagttcttatactcattcatatacatgacatctagtcatatttgactccaaaacactatacgtgcttcttcttacttctcattgttttgatagtgtagccaaaatccgtatgaattttctgttttagatcttctaaaagggaaacactactttagcttttgggatccaattgcggttctagctctcatacttaatcatacacttgacatctactcatatttgactccaaaacactaaccaagcgttttcttgtttctccatgctgtgatggtgtagccgaagtccatatgagttttttgtttaagatcttctaacaaggaaacactatttaagctttttagatcccgttgttgttctagttcgtatactcaatcatacacgtgacatctagtcatatttgactccaaaacgctaacaaagcttcttattgtttttcaatgctttgatggtgtagccgaagtctgtatgagtttttagttttggatcttctaatatggaaacactactttaactttttggatctagttgcagttctagtcttatacttaatcatacacatgaaatctattcatatttgacgcctttagttctcaatgcttaatgagaagccctattcctaacaagcacactactcagacaaattgattgaagcaaacaacataattgagtatgaaagcttaaatacagcaataaagatgagggaaagaaaggatctcttcactgaattgaaactgaatgaatctctgaagaaaaggggatgaatagcttatgtctctcaaaatagggtttgtaaaaagcttgataaaaagaaaataggtctaaaacaatgtatataaacactataaatcgtccagggactaataatgcaaatagggaagttttctggagcaaatttcctcttctgtaaacttgaaagcgtcatggactttgtttggccgaagctagtgtcgatcgacaccaggagtgtgtcgattgacactcctcttgattcctgagtccaaaagcatcctcaacttccttttccttagcttttgctccaaaatgtctcctcatctccattgttgtcccattgcatggaatacctgaaaaaacactaaaaagactcgagaaataacataaagactcaaaaacctatatctaaaacatagataaaatcattgaaaatagggttctatcaaagatccaaaaccaaaaactctaacggacttttgctacaccatcatagcattgagaagcaaataagctttggtagtgttttggagtcaaatatgactagatctcatgtgtaagattgaatataagaactagaccgacaaacggatattgaatacttaagtaatgattgcttgttagaagatacaaacccaaagactcacacaaactctggctacaccctcaaagctttgagaagcaagaagaagcttggttagtgttttggagtcaaatataactagatgtcatgtgtatgattaagtataagaactagaagcgcaacgtgataccaaaagctaaagtagtgtttcattataagatgatccaaaaacaaaaaatcatacagacttcgactacaccatcaacgtattgataagcaagaataagcttggttagtgttttggagtcacatatgactagatctaatgtgtatgattgagtataagaactagaaccgcaaccagatcttgaaagattaaaagattaagtagtgattccttgttagaaaataaaaacccaaagactcatatggacttcggctacaccatcaaagctttgagaagcaagaagaagttgttgacgagctaattggaagaagcggacctgaaaatgttaaaccactcgaccccctggtcgagtagatgcttcactacttcaacagaccacttgaccccgtggtcgagtaaaagacctcagcactccacgtcaccactcgaccacgtggtcgagtaccaccaggacaaccactcgatcacatcactagaccccctggtcgagtatcatcatgcccaccacatcaccttcactcaatcactctaccaacaggtcgagtatcactattatcatacactcgaccaatcacactaccaacatggtcgagtatcaccatcatcattcacttgaccaatcactctaccaacaggtcgagtatcatcatcatcactcactcgaccaatcactctaccaacaggtcgagtatcaccatcatcattcactcgaccaatcactctaccaacatggccgagttccaccattatcattcactcgaccaatcactctaccaccaagtcgagtactaccaccaccatccactcgaccaatcactctaccacatggtcgagtcccttatcatcattcactcgacgtctttactcgactgccagcttcagagtcttctccattccgcactcaaccagacactcgagcacaaggaagaaaagaagactttagcttatcactcgaccactcactcgaccacctgggtcgagtactgttcttaatccgtcctaatactgcgtcgttttgagtattagggtttgagaaatatttcgctataagtagcatgcacttaacattttcgacaagaagttttttatctagttttatttccgcagacttagatttggttaatgaacttgttatctagggttaatttattgagcatgccaatcacctgtaaactgaggaaacgaaactactcaattaccccatccttgggaattctttatctgattgaattctttgtttactctactaatgtttactacatcttgtcatctgttgcttagtttctgcaattctttactgttactcgacctaatactcgaccacccagttgtctggcaacacactgtgcagtcgagtatccctgttatactttctgtctgttactcgacctatcactcgacctcacccagtcctctgcaaagagctgtgttggtcgagtgttttattgtttttgcttgaatttctgttttctgcatgttcacttagaacttctagaacacaccaagacctgttattgcttggcttgacttagtgacttctgatcacatcttgattgttagcctcacacccatttggattgacaaccttcagtactacaacgacatgatagtgttttaggattaattgattttaaaaacctattatcacttctaacaaggaaacactacttaggcttttaagatcgggttgcggtttaagtttttatactcaatcatacacatgacatcaagtcatattcgactccaaaacactaaccaagcttcttcttgcttctcaaagctttcatggtgtagccaaagtccgtatgagtctttggctttgtgtcttctaacaaggatacaattcttacggctttaagatccgattgcggtttaagttcttatactcaatcatacacatgacatcaagtcatattctactccaaaacactaaccaagcctcttctagcttctccaagctttcatggagtagccaaagtccgtacgagtctttggctttgtatcttctaacaaggaaacactacttaggcttttaagatcgggttgcggtttaagtttttatactcaatcatacacatgacataaagtcatattcgattccaaaacactaaccaagcttcttctagcttctcaaagctttcatggtgtagccaaagtccgtatgagtctttggctttgtatcttctaacaaggaaacactacttaggcttttaagatcgagttgcggtttaagttcttatactcaatcatacacattacatcaagtcatatttgactccaaaacactaactaagcctcttctagcttctccaagctttcatggtttagccaaattctgtatgagtttttggcattgtatcttctaacaaggaaacactacgtaggcttttaagattgggttgcggtttaagttcttatacttaatcatacacatgacatatagtcatatttgacttcaaaacactaaccaagcttcttctagcttctcaaagctttcatggtgtagccaaagtccgtatgagtctttggctttgtatcttctaacaaggaaacactactaaggcttttaagatcgggttgcgatttaagtttttatactcaatcatacacatgacatcaagtcatattcgactccaaaacactaaccaaccttcttcttgcttctcaaagctttcatggtgtagccaaagtccgtatgagtctttggctttgtgtcttctaacaaggatacaattcttaccgctttaagataccattatggtttaagttcttatactcaatcatacacatgacatctagtcatattctactccaaaacactaaccaagcttcttctagcttctcaaagctttcatggtgtagccaaagtccgtatgactctttggctttgtatcttctaacaaggaaacactacttaggcttttaagatcgagttgcggtgtaagttcttataatcaatcatacacatgacctcaagtcatattcgactccaaaacactaaccaagcctcttctagcttttccaagctttcatggtgtagccaaagtccgtatgagtctttggctttgtatcttctaacaaggaaacactacttaggcttttaagatcgggttgcggtttaagttcttatactcaatcatacacatgacataaagtcatattcgactccaaaacactaaccaagcttcttctagcttctcaaagctttcatggtgtagccaaagtccgtatgagtctttggctttgtatcttctaacaaggaaacactacttaggcttttaagatcgagttgcggtttaagttcttatactcaatcatacacattacatcaagtcatatttgactccaaaacactaactaagcctcttctagcttctccaagctttcatggtttagccaaattctgtatgagtttttggcattgtatcttctaacaaggaaacactacgtaggcttttaagattgggttgcggtttaagttcttatacttaatcatacacatgacatatagtcatatttgactccaaaacactaaccaagcttcttctagcttctcaaagctttcattgtgtagccaaagtccgtatgagtctttggctttgtatcttctaacaaggaaacactactaaggcttttaagatcgggttgcgatttaagtttttatactcaatcatacacatgacatcaagtcatattcgactccaaaacactaaccaaccttcttcttgcttctcaaagctttcatggtgtagccaaagtccgtatgagtctttggctttgtgtcttctaacaaggatacaattcttaccgctttaagataccattatggtttaagttcttatactcaatcatacacatgacatctagtcatattctactccaaaacactaaccaagcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcttcagatgaagttgaatcttgccaagtagacattctgagtcccatccggagagtttctcggttacttagcaacaaagagagaaaccgaagcaaacccaagacagattaacgctcttttcgaacatgctagccccaaggaacatcaaagatgtctaaagactctttggtaggattactgcgttaaaccggttaacatc

SEQ ID NO: 206 - DNA, 72600 bp, Arabidopsis thaliana
aagcttcagatgaagttgaatcttgccaagtagacattctgagtcccatccggagagtttctcggttacttagcaacaaagagagaaaccgaagcaaacccaagacagattaacgctcttttcgaacatgctagccccaaggaacatcaaagatgtctaaagactctttggtaggattactgcgttaaaccggttaacatctcagtcagccgataaatgcctttctttctatcaaatactaaaagggaacaaagagttgagttggatgaaagatgtgaagatgctttcggtcaactaaagacatacttaagtgttgctctaattctctgaagcctgaagccgatgaaaaattgtacttatacatctcattttcaaatcatgccgttaatggagtaataatttctgaagacagaagagagtgaaagccgatttgttacatgagcaagtcatcaaccagtccaaaattaagttacactataatggagaaacttgcgattgatgtagtcacttcaacttggaagctgcgactttatctatgtctcaccagatcatagttgaaactcttgggaatattggttaatttcggcggggttcaagtgtccaattcgctcttcacgaaactagatctcatcccaagaaggtttttccaagtttcaactcttggaaaaataagattattttggtggactataagtgttgagttcgctcttcactgaactatctcgtgaagggtttttccaagttccaactcttggaaaaataaatctctgtgaaatctaagtgttgagatcgctcttcacaaatttagataccacctcacatcaacaagcatttatgacgaagtctttgagtacaagctcggaagaagatcttcagtttctctctagattgctgctcaataacctgcctttgtattctataagcagaatacactttctaaactcaagcttatagcttcgattcgaaagtcgagttcacttcgcaacaacttaactcgaggtcagctcccatgcataactcgagtttaattctgataccaaaactccatggttgaactgacgagtttgagtcaataaaatggatttaatcctcttggacaaggggtcaactagcaaaacaaagatctttacggtgtttagtcgatctacctaatacttcttaggcggagcacaattctcgcaatcaaagaaagtccaaagattgagtttgggggtttgatcaacctatttctctcttagccacatggcccaaatttctcttagccacatggcccaaatttttgaaaaagtacggactttgcaaatccggcaacttcgaagcaaatactttaagcaagtgtcattccaaaacccctatggacaacgaaaaggaaaaaagttttaaaaacccctcttgggcacacaaccaacaaattttaaaaccccttgggcaaataaaaattccctttcgggaaagtcgtattcataaaataaattgggacaatccccagattttatggtaatagccataaaagagttaagatgagctgaagcctcatcaacactcggtgtaatctcgtcttggttcaaagcaggagtggccgtcccttgatcgtgagtttcagtttcataattaggagctgcacatgagctggatgaagcatgagcattagttaggatacacattttggcgagttgtcattcaagtgtatgaattgattgtgaaagttattttatgaattagttctataattaatggcacattggaagaaggaaagaggctataaaagagaggtgatgactccaagataaggggggctagagattctatattctgaccacaaatcttaaacttaaacattgttattttctcataaatacacaaaagattatttcttctctttttatgtaagatctttacataaggaatactataccattttctatgtacaattcttcatacatttctatatactctcttatacttttcttatgcatatatgtcgtgtacttttgtatttgagagctttagcccacaaataatataaatacttgagtgtgtgaatccgacatccataaaagtctgtatgagtatctggctatgtatcttctagcatggaaacacaactttagcttttaggatctggttgtgcttctacttcttatagtcaatcatagacatgacatctagtcatatttgactccaaaacactaaacaagcttcttcttgcttctcaaagctttgatagtgacgtcgaagtccgtatgagtctttggctttgtatcttctaacaaggaaacaataattaaggtttcaagatccggttgcggttctagttcttatactcaatcatacacatgacatatagtcatatttaactccaaaacactaactaagcttctttttgcttctcaaatctttgatggtgaagacaaagtccgtatgagtctttggctttctatcttcaaacaaggaaacactacttaggctttcaagatccggttgcgattctagttcttatactcaatcatacacatgacgtctagtcatatctgacccctaaacactaaccaagcttcttcgtgcttctcacagctttgatggtgtcgtcgaagtccgtatgagtctttggatttgtatcttctaacaaggaaacattacataggattttaagattagtttgcggttctagttcttatactggatcataaccatgacatctaaacaaatttgagtccaaaacactaaccaagcttcttcttacttcccaaagctttgatggtgtagcccaagtccgtatgagtctttggctttgtatctctactaataaggagactctacttaggcttctaagatctcgttgaggttctagttcttatactcaatcatacacatgacatctagtcatatttgactccaaaacactaatcaagcttcttcttgcttttcaaagatttgatactgaagctgaagtctatatgagtttttggctttgtatcttttaacaaggaaacagtacttaggctttcaagatccagttattgttctagttcttttgctcacccatacacatgaaatctagtcatatttgactccataacactaaccaaacttattcttgcttctcaaagctttgatggtgtagccaaagtccagataagtctttggctttgtatcttctaacaaggaaacaatacttaggctttcaagatctggttgcggttatagttcttatacttaatcatacacatgacatattgtcatatttcagtccgaaacactaactaagcttttttttgcttctcaacactttgatggtgaaaccgaagtccgtatgagtctttgggtttctatcttgtaataaggaaacattatttaggctttcaagatccggttgcgattctagttctgatactcaatcatacacatgacatctattcatacttgactccaaaacactaaccaagcttctttttacttctcaaagctttgatggtgtagctgaagtccgtatgattctttggctttgtatcttttaacaacgaaacattacttaggcttttaagatcctgttacggttctagttattatactgaatcatacacatgacctcttgtcatatttcactccaaatcactaagtaatcttcttattgcttctcaaagctttgatggtgtagccgaagtctttatgagtctttggatttgtatcttctaacaaggaaacactacttaggcttttaagatccagttgtggtgctagttcttatacacaatcatacacatgacatctagtcatatttcattccaaaacactaaacaagcttcttcttgcttctcaaagctttgatggtatagtcgaaatccgtatgagtctttggatttgtatcttctaacaaggaaacagctcttaggcttttaagattcggttgcggttctagttcttatactcaatcatacacatgatatctaatcatatttgactccaaaacactaaccaagcttcctcttgcttctgaaagttttgatggtgtaggtgaagtccgtatgagtgtttggttttgtatcttctaacaaggaaacacaacttaggcttttaagatctgattgcggttctagttcttatactcaatcatagacatgacatctagtcatatttgactgcaaaacaataaccaagctacttcttgcttctcatagttttgatggtgtagccatagtccgtatgagtgtttggttttgtatcttctagcatggaaacaaaaccttagcttttaggatctagttgtggttctagttcttataatcaatcatacacatgacatctagtcatatttgactctaaaagactaacaagcttcttcttgcttttcaaagctttgatggtgaagccaaagtccgtatgagtctttggctttgtatcttctaacaaggaaacaatatttaggctttcaagatccggttgcggttctagttcttagacttaatcatagacatgacatatagtcatatttatctccaaaacactaactaagctttattttgcttctcaaaactttgatggtgaagccgaagtccgtatgagtcttttgctttctatcttctaacaagaaaacactacttaggcttttaagatcgggttgtggtttaagttgttatactcaatcatacacatgacatcaagtcatatatgactccaaaacactaaccaagcttctttgtgcttctcaaacctttgatggggtagtcgaagtccttatgactctttggatttttatcttctaacatggaaacatcacataggattttaagattactttgtagttctagttcttatactcaatcatacacatgacatctagtcatatttgactccaaaacactaacccagcttcttcttatttctcaaagctttgatagtggagttgaagtccgtatgagtctttggctttgtatctttgacaaggaaacactacataggcttttaagatcctgttgcggttctagttcttatactcaatcatacacatgacctcttgtcatatttgactccaaaacactacccaagcttcttcttgcttctcaaagctttgatagtgtagctgaagtccgtatgagtatttggctttgtatattctaacaaggaaacattacttaggcttttaagatccagttattgttctagttcttttacttaatcatacacatgaaacctagtcatatttgactccaaaacactaacaaaagttcttcttgcttctcaaagctttgatggtgtaggcaaagtccgtatgagtctttggctttgtatcttctaacaaggaaacactacttaggctttcaagatcgggttgcggttctagttctcatactcattcatacacatgacatctactcatatttaactctaaaacactaaccaagcttcttcttgcttcccaaagcttcgatgatgtagccgaagtccgtatgagtctttggctttataccttctagcatggaaacacaactttagcttttgggatccagttgttgttctagttcttatacgcaatcaaatacatgatatctagtcatatttgactccaaaactctaaccaatattcttcttgcttctcaaatctttgatggtgtatccgaaatccgtatgagtctttggctttgtatcttctaacaaggaaacactacttagcttttaagatctggttgcggttctagttccgatactcaatcatacacatgatatcaagtcatattcaactccaaaacactaaccaagcttcttcttgcttctcaaagctttgatggtgtagccaaagtccgtatgagtctttggctttgtatcttctaacaaggtaacactacttaggcttttaagatcaggttgcagtttaagttcttatactcaatcatacacatgacatcatgacatcaagtcatattcgactccaaaacactaaccaagcctcttcttgcttctcaaagctttgatggtgaagccaaagttcgtataaatatttggctttgtatcttcgaacaaggaaacactctttaggctattaagatcagttgcggttctagttcttatactcaatcatacacatgacatctagtcatatttgactccaaatcactaaccaagcttcttcttgcttctcaaagctttgatggtgtagccgaaatccgtatgagtctttggctttgtatcttctaacaagaaaacactacttaggctttcaagatccggttgtggttctagttcttatactcaatcatacacatgacatctagtcatatttgactccaaatcactaaccaagcttcttcttgcttctcgaggctttgatggtgaagctgaagtccgtatgagtctttgcctttgtatctttgatgtaggtcaaattgccttaagcccactctttcaaataagagaacgattgtagcactgaagggtcgaattccacaaagctctcggatcacacaatagaccaaggttttgaatctacatatacatttttggtagggtttttggccaaaaatctttcacctatttactatttgcaatatgagtccttacaaatttaatctcaatcaaatactttataactaaaaacttacaattagtttaattgcattaattagttgaattaactctttcctaaatttttattctcaattaaatcatttttattgaactatattcgattaaggctaatttcctaaaatatatatatcgacattaaatttaaatatctaatttttttgtcactatatttgtttatatatatatataattttgcttttagtttatatataaaacacatatagttaataaaatattagattttttttgcatctgatgaaattcaaattttttcaaacaaacatataatactccatcgatgaaaaaaaaagttttaaagcgactaatagtgagttatgaataaaaagcgactaaatccggtaatcgtaaatcgatgctaaaataaatagtcgtaaaaatagtcgccaaatagcgaatattgtacgactaatattcatagtcgtaagagtagtcataaaatagtcgtcaaatttagtgactaattgactaatctgcgattaaatttcacgaacataaattgtttgtagtgttatagtagtagagtagtcattaaaaattcgttaaaatttagtgactaatttacaactatattgcgactatggtcgtatttatgtacaagaataccatattacaaaataaaattacaaacattataaaaaataagaatacatcatcctcctaaaaacataactaaaacaaagtagataacaatctttaagaaagaacttggttaaattaattcttttgatctcaatttttcctccttgtcttacatctttcatgttttcttcttctccaaaaactgcctcatggttatttctaccagaagaaaatgctgatatgctatcataggtctggtcaagatcatctccttgcaaacagaacacaccatgagaaggcaaggacataacatcttaagacgaacctatcaacatgattctggccaagcattaaatcatgatttgccattgcagaaacaatagcacactgcttaaaaaacaaacaccgttaaaaagacaagtagttctcacactatagcaataaaagaacagtacatgtaacaagagaacatatcaacaagttctatttatccaactatagaacacaaacccacataagaccaaagcatgagagactatatcaatgtgagcttaaattaaaaaaaaaagtaaagaacttggcgagataagccaaacagttcttaaggcacaatcatcattttcgcaacttaatatcttcggacctcacagttaagaacttgaatagctacactatcataagaaacatatgtaaatttcttggtcagacaatataggcaacttggtttttaaaagatcagttcaattgatctcagctgttaaatagtttatcactctatagctaatacattaagaatgtttagagaaagataaacacagatttgactttgtagtgatcactaacctgaattggtcccttttttttatgttttctctatgaaacaaggtttgacaaaaattaacaccccattacttttttagaaaaacaaacttcgacaatatccaatcacaatgatagctttgaaaccagaaattatagacatatcaagctaaaatgatcagctcttctaattatattcaaagagaagtggatcaacatgagaaaaagccattatcaaagttcagaaatcaaaactcgtaaaagacaagacaccattgattatcagatctttaaatttaaaagcaaaaaccatgacccgttactttgtccaaagtctaagtacattcaaactatgagagaaagtaaactcgtaccttaaacccaactgaaactgttgggacttttttaaaacatctcttaggctgcgctggaagaggtccatccctagtctacaagagaaatcgagacaaagtaagcaaatatcaaaacttaccaatccaagcagtagcaacagatgctaaagaagttccaactgcatacacgaccatgtgcctctcgaacaagtcctaagtgattaaatatattagcgagatatgcgggcagtttggaacaagaagttgttaagattgttccacaagtttttgatagttgtagatttgattttttcggatcctcttagagattcttttgtaatctatttaaagcattgtaaacacttctcttgaatatatcagaaaactgaacatattttcccagtcacaatctctgaattcgcatagtaacagagcctttctcttaaaatttttgattggaaaatagagaagtgattctctacgacgatggcagcgatgaacccatcaacgaacccgacgaccactgaagtccgacgaaccatatccccctacgacaaccccggtgctgtgatttcccacccgttgctgcaagcaacaaactacgatgagtgggtctgtagcatgaaaactgcattgtgctctcgaaagaaatttggatttctcgacggctcaattgcacgacctgcagaaaactctcccgatttggaggattggtggaccattcaagcgttacttgtctcttggataaagatgtctattgatccaagtctccgatctaacgtctcacaccgtgatgttgcgaaggatctgtgggaccatctaaagaaacgattctctgtcactaatggactgagaattcaacagatcaaagccgagctagcatgctgcaaacaaaggggtctagccattgagacctactttggaaagctaactcgcatttgggacagtatggcgaactatcgtcctttgagagtttgcaagtgtcgtaagtgtgagtgtgatcttggcacacttcaagagaaggacattgaagaagacaaggtacatcaattcctttttgggctggacgatacacatttccgaacagtgaggtcaagcttggttttgagagttccgatccaatctatggaggaagaatataatatggtacgacaagaggaagatatggtaagaaatggaatcaaaggcgttgaatagagctcagaagtaaacgcatttgctgtccacaccactacaccatttcaaagagatgagagagataagtcagtgttttgcaaactctgcaacagagcgggtcattctagcgacagctgctatggcgtgataggctatccagagtggtggggagatagaccgagatctcgctctacgtctagctgtggtcgtggacgtggaggctcaaacagaggggctggaaagagtcgtggcagcacctcgtacgtcaacgccgtcggagttaatgaaccaacaggttatgcagccgctaactacgtcatcaccgacaatgacagagatggagtgaccggtttctccgattcacagtggaaggtgattaagaatctgctcaatgctaacactagcaaagtctatgaatccgaaaaactgacgggtacgtactcttttccctcttggataatggatacaggggctacacatcacttgacgggtcagttagaaatcttaacggatgttaaagatattcaaccagttggaattgtgttagctgatgggagacaacgagtgtcagttaaagaaggatcagtgaggcttgggccgaattggacactaaaatcagtttattatgttgatgggtttcaatcaaatttgatttctctttgtcaattgatggatgaaaatcgttgcgtagtgcagttagctgatcatttccttgttgttcaggaccgcactacgaggacggtgattggagttagtaagcaaaagggagggaccttccttttttggagtttggagtctgtaacatctgttgaagttagagatgagaagtcattcgagttgtggcatcaacggatgggacatccttcagctaaagtagttggtcttcttcctttaatctcaaatgttatttcttctgaaattttgaataaagcatgcgatatatgtctccgcgctaagcaaacccggttgtcttttccaataagtgagaataaaacgaaaaggatttttgatcttattcactgtgatttatggggtccatatcgaactccaacacactctggtgctcgttatttcttaactatcgttgatgattactctcgaggagtgtggttatatttgcttaacgaaaaatctgaggcaccaaatgttttgaagaacttcatagccatgactgaacgacaattcgaaacccaagtttaagtcataagaagtgataacggctctgaatttgttagtttgaatgagttcttcaagaaacaagagattgttcatgagacatcatgcgtcggcactcctcagcagaatggacgggttgaaagaaagcacagacatattctaaacgtggccagagctctacagtttcaagctaacttgcccattgagttttgggggaatgtgttctcagagcggcatatttaatcaatcgaacaccgagtatggtctggaaaggaatgactccttatgaacggatatacaatgctaaaccggtgtatgatcacattcgaattcttgggaacacgtgctatgctcacgaccaatcacatggaggcgataagttcgcatcgcgaagccgtcgatgtgtattcatgggatatccgtacgggaaaaaggggtggcagttatatgatctagagaagtgtcaattctttgtctcaagagatgtggtgttctttgaacatgaatttccatttaaatcggatgttgcagaagaatttgtggaagaagctgaaaattttaacatagcttctttgtacgtcgaggaagaagaaacagagagaagattgggccagttgggccaacttaatgctgaaagcccacttgttacaactaattcagatgggctgcccataagcccaattcgaaataatgaagaagctattattagtgaaaatcaaaacgacgttgcagttgaaacttcacgtcacgttcctcttcgtaacttgccatcatcttcttcctcagagattccacgatcgacgacgtcacgacctccaccattaacatcaccgcaagtacaaacaaagaaatcgtttcctactgaacaattgggtcgaggaaagaggcagagaacacattcagtaaaattgaaggaattcgtgattgagactggaaatccaaaaacaaagaagaacaagtccacatctgagtatctgattgccaattacgttgactgtgagcgtttctctgagtcacataaagcatacatggttgcaattactcagggcgtagaggcaaaatcgtttaaaaaggcaatggaagacgatagattgaaaggggcaatgggttcataaattgattctcaggaaagaaatcattcgttgaccatagaggatttgcctaaagggaaaaaggcaataggatgtaaatgggtttacaagatcaaatacaagtctgatggcaccttggagagacataaagccaaactggttgctcttggaaacaaacaagttgaaggagtagactatggataaacttttgcgccggtagctaaaatgggaaccgtgagattgttcttagatacggcagttaagaacaagtgggatgttcaccagaaggacgtctacaatgtgtttcttcacggcgaccttgaagaagaaatttatatgaagctaccatcagggtttaaagcaaccgatccgaacaaggtatgcagacttcgaaagtctatttatggattgaagcagagtccgaggtcctggtttgccaaattgtctacggcgttaaaaaatttgaatttgagcaaaatctctctgattattcattgttcaccaaggatgcaaatggagagtcacttcacgttttagtgtatgtcgacgatctcacttaaggtcatgaatgattttaaagattacttgttgtcgtgctttcacatgaaggacttaggccaattaaaatacttcctgggaattgaagtagcaagaaactctaccggtatgtatctttgttaaagaaagtacgcattggacattatctcagatgttggactacttggtgcgaaacctgtagcgtttcctttggaaacaaacaatgacttgtcattgtcgaagtccgcgtttttaaacaaccctgaaccttatagaagattggtgggtagattgatatacttggctgtgactcgacccgatttagcgttctcttttcactttcttgctctgtttatgcaaaagccgagagaagatcattggggagcagccttgcgggtggttcgatatttgaaaaacaatcctggtcaggggatattgttacgagcagacacaccttttcaattgtccggatggtgtgatagtgactacgcaagctgcaggctatcaagaaaatccgtaactggatacttcatatagctgggagggtcacctatctcatggaagacgaaaaagcaaaagacagtgagtagatcctcggaagaagcagaataccgagcattggcatatttgactcaagaattgatttggttaaaaacaattctttcagcgctcggagtcaaacacaatcaaccgatgaatgttcgctgcgatagcaaagccgccattcatatcgcaacaaacccagtgtttcatgagcgcacaaaacatgtggaggtcgattgccactttgtccgagaagaggtgataactaaaaacatttgtctcctacatgtcaagagtgagtctcagcttgctgatatttttactaaaccattgggaagacaagagttttatcgtttttgtttcaagttgggcattacagacctccatgctccaacttgagggagggtattagcgagatatgcaggcagtttggaacaagaagttgttaaggttgttccacaagttttttatagttgtagatttgattttatcggatcctcttaaagattcttttgtaatctatttaaagcattgtaaacacttctcttgaatatatcagaaaactgaacatattttcccagtcacgatctctgaattcacaaaataaaactccatttaagcaactatacccaaaatttataacataactcctgattcgcaaaacattcccaatcccaattcttcaaaatacgatataaattggaaaatttgaagtaaaagacgcattcaatacatactcgtctccataccaaccaacacatgcgattcaaaactcccatttaaacccaatcactgagagaaaagttttaaaatttagagattacaaaagggtggccacttaagagaaaaaagttaagatttagagagcgtacccaatcaaacatccctcctctgatgttggtgatggccaaatcctttacattcccttttcaaaacggaagagggcgctaacaagaggattgacgaacaagcttgagatcgagaatctccttgacttgaaccaataagattgcaactccgcaggacgaatcgaacatcaacaacagagaaaaccgatctctgtccttaagaggctagatctgggaacacgaatcaagtgagataaactcagatcgacccaaaggggatcaataaattggagcgccatcatccttaaacatgagctaaggagatgtcttgagctgctgctaatcgagatctcaaatcaggaactctatatccctgctaatcaccgctaaaacaacagatgatggattaaataactccaaagacacaaacgaagaagctgctaggttcaaatccccaacaaagaacataacattgtttagaagtgaaagattgagaagagaagaagcgatagaaatagagagagatttgatagtgtatttcattgataagcaaccctaaatttgagaatccgcttaagtctctgagttgcaatagtaaacgacaacgtattcaatgtaaaagagaaaggacaaaccctctttctcaattagaggtttactaatacttcaaacgaattttcataagttcgttttcagtacaagaagaatctttttcattgcacaaaaaaaagaagaatcttcttcttgcttcatgtatatattctaaagtagccacaaagatttagaacattttattgtctattattgtttcgcccaaattttagttctgacaatttaatagggagatgaaaaaaaattagatgccaattaaaatttttatgatttaatttttaagttgagcacaaagttaaaactttagaatttataatatagggttttggatttaaaatcagaaatttggaattagaattctaattttaaatataataattgaattttttttagggatttcaatttataagtataaaacgaattaaaaaaacaatggtaaagtaaatatgtaaataaatataaatgtttcttttatgtatatataatgattatgttttggtttatgaattaatttctgtgattcagtgcttaatcaaacccgagccatgtttgtagtaggtgacggtcgttgccgtcttcttcgttccaaaatgttggacacactctttcgccggttgagtcgccattgttaggattttatgatttccgtgctttttctgcagccaaggagattatatgagtagagaaaaaaaacataatgcgttaagcttttataggtcaacgtgatgatggactgactttgaaggcccataaattagggtaactatgacctgttacaatgtttatgggtacataacttagattaaccgactacatcttctaataaaccaacgggtttcgtcaatttcgaagattcgcaaaaaacggatgtatgtggtcaaccactagatttagatttcaaagatgtgttttttttgtaccattttcgctaggaacttgtaagtatgcgagctaaacgacaacttatggttaaaatgatcggttatatctttcatgttttttgatcaaatgagtttctaattttgttaccaaaaattttggtttttgattgatattcggtttatatgcggttaaatcggattgattgctgacaaccaaaaataaatcagatcggttagatttaatataattaacaaacaaacaaaaaaacaaaataggccatttgtgaaacaaaacccaaataaaaattgggcattttttaatacaactcaaacaaagttgggcctttttgcttagagaaacaaaatcaaggcctcttaatttttatttatttatttatttcagatctacatatatgtgtgtaccttcttctttgcgagacatgttaataaagtgaggcttacagttccagggtaaaaagttttagaaatgttccgggcagcttcagcgattcgatttacatttgttgtggtatttaaaattgattttggtttggtttacattggtttagagaatgaaaacagaaaaacaaaaaacttgtgcgatgtgtttttgagagagaagtgcgtcgattgaaaaaggcatgatttcgaaaggggtacacccatagaattgctctaactcgctcaacgcgcacttggtgagagggggtgtgaaatagagccttctgattgggtgaaaaaatctaagaaattgaaatagtagacatgttgctagctcctcttctatgttatttaaaaagtcaattttaaagtttgcattcaaatggttctcataatataaatacatatatatatttatatatatgtatatgttttaaagagtttatctacactattaaaataagaaacatttaaagagttaatgatatttttcgttgcaaaattgataatataattttattaaaaacattattatttttattatgaatttagtttagttgctaataattttatatttacataatatataaaggaaaaaacaaataagatcttgtatctctaaacatatttcgatttgaaaaaaaaaaaatattggatagaatgtatgtcgcatatttgttttggctatgtacttaatctgttatagtttgtaaatgagaaaatatcggaatatatttataacataattattattacttagtttttattattaaaatattttgtatttttcaattaatggcatttgatttatgttgattgttttttgttttatctataataaattgaaaaatacaaaatagttcgatttatattcgaaataaatatattgatgctgaatatttagttatttaatatttgatgttttgtttagtagacaaatcatagtaaaaatagtgacgaagcaaatctcggaatatattggatcatttaatcaggttatttgtttttgcaaaaaattaataaaggatccaaatcaaaaatatttatttagttgtattagttgttaatttatcaggttatttatttatttgtcaaagatatcctcacagttgtagttcacaaaatgtttttcagttaatagtatagattttgtgataaagaatcattagagagataagcatggccctatcttcaatgatttttgttcatacatgtcttttcaatatgataaatatcttaagaatctcccttttaattatctaactaggtcacccgtgggcatctgttacatctcaattctgtgtatttcacaaagaatctactatattttctttatctgtaaacatgttgtatatttagtcttgtcaaaccatattttgtttagtaaatatagttttcttggtttgcagtataaaaaatatatgtctacagttggtatgtacgttttggaacgtaattgtatatttagtatatgtaggtgtacacatagtatttgtacagtttcgtgtatgtcattaacatgtaagctaattataaaatttgataatttaatacttggaaaatgtctttcttcaaacttcaaactcataattaaaaaaaaaaaagaatattaataaacttctccactagtattaaaaaaagcttgcattaagaaaatgggaaaacgaaaagctttttaataattattccaacctgcaaatttaaaaacgactaaattagcatgttatataattttgcaaaatgatatttattttataataatcaaactaaataaatcctgtagaaataatctactaaaggttttgaaatatttctttgaaaacaacatttgctgtttctttcttctgtattccttaccttctgtaataagaaccttcagccctgcctttgatttcactctagacatagcgacatacaactgtccatgtgagaaaacaggcttcgacaaatatatgccaacattggctaatgactggccttggctcttattgatcgtcactgcaaatgtaacagataaaggaaactgccttcgtcgcattttaatgggcaatctacgatccaaaggaattaggggcatcctgggaataaggaccggtttaccaactctagtaccttctaatatacgtccttgcaccggtttatctccaagtctgatgacatagctcaaattgccttaagcttactccctcaaataagagatcgtcgttagcacttaagggtcgaattccactgatctctcgatgttcaaacaatagacttatggtgttattaaataagctagacaaagtaattgaatgtaaaagacaaataagcaagtaaacgaagtgtagatttaagtgattaaagcgtcaggtctaaggaattatctcgggagatagataaagtgtagatctagctaatataaggattgttatcgcactgttctcgaactcaaactatgattctaaagtaaccggtggtgttccgcaaaactctctatacttagagctaagataactgaagaagccgagaaatcctatactcaaaacatacgaaaaagattagaaagactctaaaaaccattctgaaactatgttagaaatcaataaaaaaaccaggacatatcaacttccccagagtaagcctttgcttgccctcaagtgataacactgtattttactcatttttggtgtgtgtttatcatcatttagctttgcatttgctcattgtatcatatcattttgcaccattttagcttattttgcacacttaggcatttaggatcatcttgcatacatattgcatgttttggtgtgttttaaggtgcagaaggagcttaaaagcattctactcaatccattcactcgatccaggcagccatagaggaggcagcaattcactcgaccctcttactcgatcaaggcaacctcagaagaagcagcagatcaatctactcgccccttctactcgatcctctattcgactcatttactcgaccaagggttaccaactctacaagacttgttgatctatcaaagcgtcttcttatcatcctcattccctactcaaccagacatttgagcatacggataggagaggaagaagcatctactcgaccaattgatcactcggagcatagactcaaaggcgcaaactttgcagcaccctctttactcgatccccaagatcgagcactcgcccaaaccgcctcaagtctcttgtcttctagtgaatatagggttttcaacatttcactataaatagatcactttgggatttgtccaaaggatctagcttttatcctttagtttttctttgtgttcttgaatcttcaaaacttaattactcttaatctattttgtttttgcacttagttcttttagtaatgttgtgtagcttgtttagatcttccttttttatatgattttagtaatttctgggtttatgttcttagttatgttgcttgagtagtgattagggttcttgaggatggactagattagggcaatctctaggttagtcaggtggttaagattaggttagatcctttctggattcgcttggcccctatgcggtattcgctggctagtgtggagattcgatcatagacgtccaacgtccaaaagacgttcaaatggatatctgatttatgaattccagagatttgtaaacttgaccaagacattggcttgtcttcttattggctttggtagattgttgcttaaactctgctctattatgtttcataaacgatagttgagattaggaagtggtagagttatgggggtctctgtcacgacagtggattgacccggtttttgaatctattcgtctagggtatctacctttcacctgttagccacctgatgaatcctagagttgcccttatcaattaatccatccttaggacttctattcttcttagatttatttgtattcaccacctgattgcacttttatttacctgttatttgtatcccatgttgtttgcattttagttcttaatattgtcacctgttggttctactcgacccaatgattgagtagggctcttaagttctcatttttacctgtttgaaccctgacctaggattgttactagaaacccaccatcattataatctggcttgacttaattgcttctgtatacatcttgattgttaacaataatagtggactggattgacaccccctatagctgcatcgacatgtcagtgtttaagggaaattgaactgaacctcacattcaacacataagtaggcgtaaaaacctacttatcaacaagcaaaacaaaagattgaatctatgaaagaggtttgaaaaacatacaaaactcccaatctctctagcttatttccttgattatacaaaccaaacacatgcactaaacagttctaatcagatcctgaccaccatgtaattctttgctagcccacacaacatcctagattccataccaaagcactcaactatatccactaggctatcatcgctgggtctcatcaatcaagttaatgtttaagaaccttctagactcattcctgtattataccatgacaaatcgaccattcattttcttcttctttttttggtattctttctctcccctacacttattcttttaagagaggaaacaaagggtaactcgcatactggattgacaccctcggcatttttccaacctttgtaattgatcattccaaataatgtataataatggggtcataaaaaacattcctaaccttatacactattcgaaaattctatcaatctctcatatttttattatatatttttttataaggggagaggaatactttcttttatcacattagccgacttatcaggtatgaacaagcagtcaagtcctatgaacactaaccgttttgatgaggtaaaaggaagagcagtgagattagctccagcctctatggattatgttgggaatggatgtccttaagtttgttgattggctttctggattttccattagtcgaattgatttgaatctacagtacttaaacaatccaggcaataaactcgagagatagatcataatttcagacaaaagttttaactcaataaacgactatctaagttagaatgacacaactgactcataagaagagaaaagatgaagttagtaactgactcccctagacatagataacactgtccccaaagttattaagctagaggaatcgaaagaaaaataatcaaaagttaaaagttagagaaacgtgagttgccacctgagagtggtgtcgatcgattctaggttggtgtcgatcgacactcaggtcatttttgcatcgctttgcgaattcagctaatcgttgtagagctttggttagtgttttcacatggatcctccagttagactgttaaatcactaaaacacacatcaatagttccaatacaaataacaaatagtctgaaaataaagcaaaaacaaaatcagaaaacaaagcaagatagggaggatggctagtcctcatgctccgagccggaggtgggtgcgggagagcgacgacagtgacgagtggaagcaacacaaccgcgacgagagagtgtagctatggcgttccagacgctcttgaagctgtcgacgatgtactgatgaaagacctattgctctatcgggataggaggaggagaaggcagctcatatggtagacctaaagaagaagatccaactctcggacccctagtagggtcaatgaactcatcctcagtctgagtcggtgcggatcttgaagctgaacctctctgtctcctggagcatggcgcggaatgcagacgggaaggatcatgatgaaaaccaatctcctcatgctctcctgtaatctctgtaagtgcagggcaaggtaactgaatcatatggtgttgtgtctcgtctctgaaacaccaaaggaagttgcctttcagccagtgaaagttcttaagattactctcatccattgtgaatctcgtggtgttgacctcttctccttcaaagctgatgcaaaaatgctcaaatataggagtgagaagactgccaactctcttagatttcttccctttacgtgtaaagggcttggtcttgagtgagaccaagtgatgagcaaacacagcgccaaagttgacatcgtggtcaacctcctcaactccaaagctgtcatgaaagaaatcatgaacagcatcgtttctttgttattgtttttaagcatgttgtgtgagtagtgattaggatttctgaggatgggatagagtagttgtggaacccctagtcgaatatgttggttaagtgtagatatcttgaatcccttctcgattagttgtgtttactgcttattcgtttctgatcaactggaatccgatcccaaacgttccagcgcccagaaggcgtttaatgaaacgttggatctactaattccagtgataatcgtctctatcccaagggattggccgtttagagcggttattagctttaacagtcggttcttattgcctgtttagttagagattgctaatgggaattaggtcagtgtctagctatgcttgaggatttctatcacgagagtaaattaatctgttgttgaacctcttgtctagggatagcttaattgagatttgttaaccaactgagttgattagggagaccacactattcgattaccccatccttaggagtttctcatccatttgatttctctgtttacttacctgcttcattcacttgctattgaattttagtatttttctggtttcaaccattctactcgatcacactagtctactaacagtgagactgcgtgatagagtaaaatggtcaatttctgaattttcactctctgtcatcctgttgtacacaatcacagggtcccttctggcagttgaccctgcgatcgagtatatcggtcatttctgtgactttttactgttttctgcaacaacactaggactgttagaaaaccaaccaaattctgcttggcttgacttagcaacttctgatcatatctcatctgtttgcatcacacccatttggattgacacctaaaatactacaacgacaggatagtgttttaggattaattgatctgaaaaaacctactatcagttgttgtggaggatacaccttatcctcaggattggcaacgttggtgctgcggtaggagaggttggagttgttggttttgaagttgttgtatcctttgtagccaccttgattgttgatgtagctgacttcgtctaactggttcccctccccatcttggaattgagactgctcgtcatcaacaaggaagtgcacatgcttcttctaactaaggagaattctgtccagattgtcattcagtgctttgatctccttcctgtgtttgtcatcggagtcagctgtgcctctaacggtcctgtcgcagtcctcattgtaattaccatctgattgagccaggttctcaaccaattcctagccttcttcaacatccttgttctggaaattcccattgctggcggtatccagaagcatcctaatgcgtggtagaactcctctataaagagtgctgagcagagaggctttcgcgaagccatgatgagggcatcgattggtgtaacccttgaaaccttcccatgcttcacagaagctttcgccagtcttctgtgaaaaaccagaaatctgatttctgagtcttgcagttctggcgttggagaagaactttgatagaaaagccttcttgcaatcatcccaagtggtgattgattcatggggtagatgcttctcccagatgtgtgttttgtcgcccaaggagaatggaaacaaacagagcttcaatccgtcttcacagacaccattgatttttgttaggttgcagagcctatcgaattcatcaaggtggtcgagtggatcctccattggcagaccatggaatttggtccccttaatcatcgagatgagaccactcttaatctcgaagttgttgttctggatagcaggaggtgcaattcctttcctttgacgatggttccgtggtgcatctctaataccaatgttggcagggccattttgttgattctgttcgtcggccatttcgaatggttgttgaggtaaaaggttgactgtgtttctcctttctttgatttcgctagctatgcggtcgatgttgtcgttgaaaaggaggttctaattgcctgttgatcgagtttgcatacagcaaaggtgtacctggataaagaaaacaacaagaaaaacacacagttagtaatcgaaaagaaaatggaaaaagaactagatctaagcaagtctgaaatctcaaatgtaacaaacaaacacccaattggcaacggcaccaaattgataataggttttttagtcaattatcctaaaacactaatcatgtcgttgtagtattttaggttgtcaatccaaatgggtgtgatgctaacaatcaagatgtgatcagaagtcactaaatcaagccaagcaataacaggttttggtgtgttctagcagtcctaagtgaacatgcagaaaacagaaaatcaagtagaaacagtaaaacactcgaccaacacagctcgttgcagagcactgggtaaggtcgagtgacaggtcgagtaacaggcagtaaacgaaacaaagacactcgactacacagtctgttgccagacaactgggtggtcgagtatcaggtcgagtaacaggaaagaattgtagaaactaagcaacatatgacaagatgcagtaaacaacagtagagtaaacaataaaatcaatcagataaagaattcccaagatggggtaattgagtagtttcgtttcctcagtttacaagtgattgacatgctcagtaaattatccctagacaataagtttattaagtaaatctaagtgccaccgcaaaagagacccttaagttaccctagtcccagactcaatcaccattgacgagagctaacctgacaagtattacgaatcaacaagttaaagccaaaacgctccctgcaaccaataccttggtacagggccacgaatctctggaattagtggttcagacatttcatcgaacaccttttgggcgcagaaatgtctgggctcaaattcctgttgattagaaagcaataggcattaagaacaactaatccagaagggatctatcaatcaaactcaaccacttagcatactgagaattctaaactactctaacccatcctcagaaacctattcactactcagacaacattatagagaacataaacgttgaattgaatgaaaacatgataaacaacagtgtaatagcaaaatgataacaggattaacaacaataaacgaaatcaagaacaaatattgaatactaaatagattagagaaatccagattacaaaacatcaagaacacagtgtctccggaataaaacttaggttaacgaaaatgtaaagtacatgctccttatagcgaaatatttctgaaaccccaatactcaaaacgacgcagtattgggagggattaagaacggtactcgacccaggtggtcgagtgagtagtggagtgataagctggagtcttcttttcttccttgtgctcgagtgtctagttgagtgtggaatggagaagactctgaagctggccatcgagtatgtagtcgagtgatggtgatggtgatactcgacttcctggtagagtggtgtgatcgagtgatggtcaggtgtggaggtgatgatactcgaccaggtggtcgagtgaagtgatcgagtgactctcatggtggtactcggccaggaggtcgagtggtgaggtgaattgatgaagtcttctactcgaccaaggggtcgagtggtctgttgaggtcgtgaagcttctactcgaccagggggtcgagtggtttgacatgatcatgtccgcttcttccaattagctcgccaacagctccaaatcacctgaaaaacacaaatatgcaacatgcatgcaaaactatcctaaacatgcaaagtgatgagaaatgatatataacagtgatgatatgatgctaaagtgatgacaaatggatgctcaaaacatgcaaaatacacacttatcaggtcggcccaggaggcaggcgtatcctttggtgggtatcctttggtggcttatcttatagcggaatccagcatccatgttgaaccgtctacaaaatccactaggaaatcatactcctccttttcttctattaaagctatctccaggggatcctccagaatgatttcccctacacattctaccagacgcctcttctatctcatcgagatagataatctgatcatgagatgaagcttgcttgaaagtctcattcatatcaaacttcattatgaaatcgccaaggtgaaggtcgatttttcagttcgggacatcgataatggcgctggcggtagacaggaatggtcggccaaggatcagtggtccttatgctctttgtgaacttccaggataacaaaattaatagggatttgagatcccccaatcattatcggaatatcagccaaaatcccaacaggatggcggatagaacgatctgccagtattagggagattttagtttgtttgaaggtgtagtatccaagacggttagtaactgtgagcggcatcatgttgatgcttgatcctcaatcacataggcatcactcaaaaagttcatcatcaatagcacaagacaacacaaaactctcaggatcacctttctttcatgtcgtctggtcttgcaggatggcgctacactcttgggtcatcatcattacctcgtcttctaggctgatgttgttggttaagatactcttcatttatttcctaagagtggggatcatggcacaagcctcaacaaaaggtagccttaccgttaactacccgataagctctcgttgcttagctttctccttcttggtgctcttcccagcattcgggtatggtaccttaggtcagtagatacggtccgagggagagataagattggtcgcagtagtgctttcgcggcttggcggtacttcttcctcggcttcttggctaggaatgtgtatgggaggttctgggtctcttccactattcggatcgtgacaggtctcacaggcttgcttggattggtttttcttcctcctcctgatctttcggatactctggtgtctgtaagccatcccactcctcagtgttatggcttgcaatggtgcaccgatcagtgggtgcccttcttctgttctgaaggatttctcgtatgactcaatcaggcaggtagtctcattttcctattaagacaagtattcgaacttcctctaaagggaattaattttgctttttaagtcctcatgcatgatctggattgaggcgtcgacacttttttggcattcttgaaaactagcttcgagtctcttgatcaaaacctctagggtcgagttctcatttgccggtgttggaataggcaattctcactgaggttcctgaaactcgctaagaatagacctttgttgaatattaccttggtttgagattttccctcggttcctaaagctccggttttgggagactctcgggtggctcctcattggccccatgtaatttgcggtttcttctcgtccgtagaaatcatcaagttcctcggaggaagagctgaaaatcccttgagagttccgtacggcgatactcacaagactagatttcatccttggaggatttttccaagttccacatattttaaaaatatattcatttcgttaaaatctaagtgttgagttcgctcttcacaagactagatttcatccctcaaagattttttcaagtttcatctcttggaaaaatatattcattttggtgaaatctaagtgttgagtttgctattcacaagacaagatttcatccctcaaaaagttttccaagttccacctcttggaaaaatatattcatttcagtcaaatctaagtgttgagcttgctattcacaagacaagatttcatccttcaaggatttttccgagttccacctctttgaaaaatatattcatttcggtgaactctattttttgagctcgctcttcacaagactagatttcatccctcaaggatttttccaagttccacctcttggaaaaatatattcatttcggtgaaatctaagtgttgagttcgctcttcacaagactagatttcatccctcgaagatttttccaagttccagctcttggaaaaatatattcatttcgatgaaatttaagtgttgagttcgctcttcacaagactagatttcatgcctcaaggatttttccaagttccacctctcggaaaaatatatattatttcggtgaaatctatgtgttgaactcgctcatcacaagactagatttcaccccttaaggatttttccaagttccacctcttggaaaaatataatcatttcggtgaaatccaagtgttgagttcgctcttcacaagattagatttcatccctcaagtagttttccaagttccttctcttagaaaaatgtattcattttggtgaaatctaagtgttcagttcgctcttcacaagactagatttcatccctcaaggatttttccaagttccacctcttggaaaaatatatttactgtggtgaaatctaagtgttgagctcgctcttcacatgactagatttcatccttcaaggatttttccaagttatccttcaaggatttttcgaagttacactttttggaaaaatatattcatttctgtgaaatctaagtgttgagttcgcttttcacaagagtagatttcatccctcaaggattttttcaagttccacttcttggaaaaatattttcattacgatgaaatctaagtgttgagttcgctcttcacaagactagatttcatccctcaaagattttttcaagttccacctcttggaaaatatattcatttcggtgaaatctaagtgttgagctcgctctccacaatactagatttcatccctcaaaatgttttccaacttccaccttttggaaaattatatttaattcggtgaaatctaagtgttgagctcgctcttcacaagtgtacgattcaagatgaatcgtcttcaagtttagctcactaaacactctagactctcgtgtgtttgtttaagaatgaagaaacgacaccaagctttaactagttcaactaactgatgtggttagtttacgtctcgccggagattctccggaatccactagatcgctgataacgttctctctctacaaaggatctctctctctctcttatcttgttacaacaactcaatgaacgatgaaacagaatgagctaaagatataacgctaatactccttcgttgacttctcacctgttaaccacacgtgtgataattaaccccaagacttgaaccttcagtttctttgagagactctctgatacttagagaataaaggcatttgggtcacaactctcagttctccaccttgaccccaatgcagcgacctagcagccgaacttggactccaactccgtatacctgactaaactcactcagccttctaagcctttttgattaaacccactaagcttcagatcacgtgagtaaacccactcagcttgttgaggagccttatggctccattatgcttctgtaatcctgagtcgctctaacgcttcttgaagcttacccactggtactgtcttagtaaagatatctgcaggattacactctgttgcaatcttaaccagatttataaccccatcacttaccaaatctcttatgaaatgatacttggtatctatgtgtttagtcctttcatggaacactgtgttccttgccaaagcaatcgcactcttagagtcacagtgaatatttactgaatcctgcttaaacccaagttcattcatcagtcctagtaaccaaactgtttccttagctgcctctgttagagccatgtattcagcctcagtagacgataatgccacatccttttgcagacttgatttccagctgataacgttgcctcctaagtaaaaactatacctgatgtagatcttctcctgtcatgcagtatagtctgaatcacaaaacccttcaatcacaaaatctcctttgtttttatagcaaagcttcttcttgatagacccactgatataccttagaatccacttaactgcttgccaatgttgcttgagtggtttactcatgtacctgcataccaatcccacaggatatgcgagatctggtctggtacctatcattgcatacattaagcttccaactgcactttgatatggcacacccctcatagattcagactgaatccttaattcttcatctgtggcagcacgcaacttgaagtgtattcccattggtgttcctattggtttggattggtccatcccataagttccaaggacctttaggagatatccatcttgagatacagtgagagtacctttctgtctatctcttgatatttccattccaaggatcttcttagcttctcctagatctttcatttcaaattctgagttgagaagtgtttttaactcatctatatgattcttatcctttgaagctattaaaatatcgtcgacatatagcagcatatagacatagtctccactctgtaatctcttagagtaaacgcaactatcatattgactcctttcatatccatgtgactacacaaactcgttgaatcgattattccattgccttggtgactgcttgagaccatatagcgacctttgtagcagacacaccttcattggatatttttcatctacataaccttctggctgatccatgtaaatggtctcttataagtatccatgcaagttagcagtcttgacatccatctgttggagttccatatccaaatgagcaataatactgagcagaaaacgaattgacacatgtttcaccacaggtgaaaaaatctcctgatagtcaaccccttctttctgtgagtaacctttagctactactcttgctttaaatcgaggaccttccacacccactattccaggttttctcttgaagacccacttgcagcctataggcttctgtttttcatctctgtctactagtgaccaagttttgttcttcatgagagactctatctcttcatctgcagctgtgaaccacttgtcactattagcatctcttaatgcttcctgaaaactggagggctcagacttgccaccgtcttctgttacgaagtatgcgtatccggctatctcatctaattctgcttcttcagtgtattagtcttctagtctggttggtctcatgatctgtcttcttggcctgtgtttagctatctgatagctccctgacatttgattctcaactcttgttgacatttccactgaactttgtcctgaatttatcacagtatcttgctttaaagctccaccttaagaaatatcctcttcagacctgttatttcctgcaatatcacaagtagctttatcagataacattggtaaagggttagagatcatacatgactgtttctgagccatgatatccttgtacaacacatcctctttgaacaccacatttctgctaatggtgcacttcctgtcttctaacaaccaaaccctgaagcccttaactccttctggatatccggtaaagattcttttcttagccctcaaatttagcttaccatcatttgagtgaatgtaagcgagacatctaaatcttcgcaaacctgataagtctggcacagttgaagtccacatctcttctggaatgtgaaaatcaatagcagatgatggtgttctatttattaggtacactaatgtggaagctgcctcaacccaaaactgttgtcctaatccgctctcactgagcatgcttctgactttgttcataatcgttctatttaatctctctacaattccattttgttgaggtgtataggcacaggttctgtgtctcaccattccttccttcttgcagaaagtatcaaatctattattgcagaactcaagaccattatccgtacgaagcttctttactttcctttcactttgtgtttcaaccatcttcttccattgaacaaacatgtcaaatgcttcatcctttgtcctcaagaaatagatccagaccttcctggaccaatcatcagtgaaggagatgaagtattgacaccttccaagactcaatgggacgtttggagagccccataaatttgaatgaacatagtctagtttctctttagtgacgtgttgtgctgagctgaagctaactttgtgtgtttttccaaacacacaatcctcacagaacttaatacttgatactttgtcttttccaaaacaccctttctctgctaggccatccatccctttctgtcccacatgcctaagacgattgtgccaaagttttgttagatcttcttctgcaggtttctcttcaagtgccagacactctgacttcttagctcctgcttgtaaaatgtattaagactctcttcttgtgcctttcatgtacgtgatatcccctttcataacctttaacacaccgtttttgccttcgaactcacatcctttagagtccagagttcccatggagatcagattccttgacatccctggcatatatctgacatcgtgaagcataaaggtggtaccatccgagttcacaaacctcactttgccaataccattgacctctgtgaataagttgtttgccattctaaccatccctgttccaatttcctgaaactcaatgagcacatctcttcttggagtcatgtgaaacgagcaattgtgtccattatccactcatcttgatctgcattctcagtgagattcacttcagatgcgactagtccaatcagatcttgtgcatcatctttaaccagagctgattctccttgttgagaattagccttgttcctctcaatccacttatagcactgtcttttaaaatgtccctctttaccgcagatccaacagattttcttgccctctttcccaaacatttgatcattaccctttgcatgtggtcttcctcacacatacaagccttcaccaaccggtcttgaatcacctaagctatccctcagctccagctcctttgacttagcaacacttattacatcatccagccttataccttctctaccatatttcgatgtttttttcaacatatcatacttctctggaagagcactcaggatcaagattgcttgaacttcatttgggacttgaatctgaagattattcagatctaaaatcatctttaagaactcatcaaagttttcctcaagagtcttcgattcttgcatcatgtagttgtaaacctttagttgaagatatacacgatttggtaaaatctttaccaaatacaatctctcaagcgttccccaagcttccgctgcagattttgaatgttttcttgatcttagaaccttatctgcgacattgatgaatataatgtccatcgccttctcatctcgctctattctagcctcttcctcctcgatccacttcttcttctttgcaggatctccttcttcttcttccgtgagaggtttatgtggtggttgctccaccagagcagtctttagccccaacactctgaggtgagcgaacatccgagttctccagagggagaagtcaccctatccatcgaattgagcaatctttactttcgaatccgtcattcttataaccgatcttcagattattgatgaaccagagctctgataccaatttgtatgattcaagatgaatcgtcttcaagtttagctcactaaacactctcgactctcgtgtttttgtttaagaatgaagaaacgacaccaagctttaacgagttcaactaaccgatgtggttagtctacgtctcgtcggagattctccggaatccattagatcgccgataacgttctctctctacaaaggatctctctctctctctctctctcttatcttattacaacaactctatgaacgatgaaacagaatgagctaaagatataacgctaatactcctgtgttgacttctcacgtgttaaccacacatgtgacaattaacacgaagacttgaaccttctgtttcttcgagagactctctgatacttagagaataaaggcatttgggtcacaacactcaacaagactagatttcatcattcaaggatttttccaaattctaaatcttttaaaaatatattcatttcggtgaaatctaagtgttgagtttgctcttcacaagactagatttcatacctcaagatttttttcaagttccacctcttggaaaaatatatccattttggtgaaatctaactgttgagtttgctattcagaagacaagaattcttccccaaaaagttttccaagttccacctcttggaaaaatatattcacttcatttcggtgaaatctaagcgttgagcttgctattcacaagacaagatttcatccttcaaggatttttccgagttccacctctttgaaaaatatattcatttcggtgaactctaagcgttgagctcgctcttcacaagactaaatttcatcacttaaggatttttccaagttccacctctcgaaaaatatatttatttcggtgaaatctaagtgttgagttcgctgttcacaagactatatttcatccctcaaggatttttccaagttccacctcttggaaaaatataatcatttcggtgaaatccaattattgagttcgctcttcacaagattagatttcatccctcaaagatttttccaagttccacctttttgaaaaatgtattattttggtgaaatctaagtgttgagcttgcacttcacaagactagatttcatccctcaaagatttttccaagttccacctctcgaaaaaatatattcattacggtgaaatataagtgttgagctcactcttcacaagacaagatttcatccctcaagaatttttccgagtcccacctcttggaaaaatatattcattttggtaaaatctaagtgttgagttcgctattcacaaaattatatttcatccctcaaggattttttcaagttccatctcttagaaaaatgtattcatttcggtgaaatctaagtgttgagctcgctcatcaaaagactagatttcacccctcaaggatttttccaagttccacctgttggaaaaatatatttatttcggtaaaatccaagtgttgagttccgtcttcacaagattagatttcatacctcaaggatgtttccaagttccacctcttggaaaaatgtattcattttggtgaaatctaagtgttgagctcgctcttcacaagactagatttcatccctcaaggattttttcaagttacaccttttggaaaaatatattcatttcggtgaaatctaagtattgagttggcttttcacaagactagattgcatccctcaaggattttttcaagttccatttcttggaaaaatatattaatttcggagaaatctaaatgttgagttcgcgcagtcacaagactagatttcttccgacaaggatttttccaagttccacctcttggaaaagtatattcattttggtgaaatctaagcgttgagttccttcttcaccacaccatatttcatccctcaaggattttccaagttccacctcttggaaaaatatattcattttgttgaaatctaagtgttgtgtttgctcttcacaaaactagatttcatccctcaaggatttttccaagttccacctctgggaaaaatatatccatttcagtaaaatctaagtgttgagttccctctttacaagactatatttcatccctcaaagatttttccaagttccacctcttggaaaaatatattcatttcggtgaaatctaagggttgagctcgctcttcacaagactagatttcatccctgaaagatttttccaagttccaccttttgagaaaatatattcatttcggtgaaatctaattgttgagttagctcttcacaaaactagatttcatccctcaaggtttttccaagttccacctcttggagaaatatattcatgtcggtgaaaaataagtgttgagctcgctcttaacaagactagatttcatccttcaaggattttttcaagttccacatcttttaaaagtatattcatttcagtgaaatctaagtgttgagctcggtcttcacaagactagattttttccctcaaggatttttttaagttccacctcttgaaaaaatatattcattttggtgaaatctaagtgttgagttccctcttcacaagattagatttcatacatcaaggatttttccaagttctacctcttggaaaaatatatttattttggtgaaatctaagttttgagtttgctcttcacaagaatatatttcatccctcaaagattttttcaagttccacctcttggaaaaatttattcagttcggtgaaatctaagtgttgagttcgctcttcacaagattagatttcatccctcaaggatttttcaaagttccagctctcggaaaaatatattgtttttgatcaaatctaagtgttgaactcgcttataacaagactagatttcacccctcaatgatttttcctagttccacctcttagaaaaatataatcgtttcggtgaaatccaagtattgagtgcgcacttcacaagattagatttcatccctcaaggatttttccaagttccacctttttgaaaaatgtatttattttggtgaaatctaagttttgagcttgctcttcaccagactagatttcatccctcaaggatttttccaagttccacctctcgaaaaaatatattcattacggtgaaatataagtgttgagctcgctcttcacaagacaagatttcatccctcaagaatttttccgagtcccacctcttggaaaaatatattcattttggtaaaatctaagtgttgagttcgctattcacaaaattatatttcatccctcaaggatttttccaaattctatctctcagaaaaatgtattcatttcggtgaaatctaagtgttgagctcgctcatcacaagactacatttcacccctcaaggatttttccaagttccacctcttggaaaaatctattcatttcggtgaaatccaagtgttgagttccctcttcacaagattagatttcatacctcaaggatttttccaagttccacctcttggaaaaatatattcattttggtgaaatctaagtgttcagctcgcacttcacaagactagatttcatccttcaaggatttttccaagttccacatcttttaaaaatatattcattttggtgaaatctaagtgttgagttggcttttcacaagactagatttcatcctttaaggattttttcaagttccacctcttggaaaaatatattcatttttgtgaaatctaagtgttgagtttgctattcacaagacaagatttcatccctcaaaaagtttttcaagttccacctctcggaaaaatatattcatttcggtgaaatctaagcgttgagttcgctcttcacaagactacatttcatccctcaacgatttttccaatttcacctcttaaaaaaatatattcatttcagcgaaatctaagtgttgagttcgctcttcacaagactatatttcatccctcaaagatttttccaagttccacctcttggaaaaatatattcatttcggtgaaatctaactgttaagttcgcttttcagaagactagatttcatccctcaagaatttttccaagttccacctcttggaaaatatatttatttcggtgaaatctaagtgttgaactcgcttatcacaagactagattttaccgcttcaggatttttccaagttccacctcttggaaaaatataatcatttcggtgaaatccaagtattgagtgcgcacttcacaagattagatttcatccctcaaagatttttccaagttccacctttttgaaaaatgtatttattttggtgaaatctaagtgttgagcttgctcttcacaagactagatttcatccctcaaggatttttccaacttccacctctcgaaaaaatatattcattacggtgaaatataagtgttgagctcgctcttcacaagacaagatttcatccctcaagaattttttcgagtcccacctcttggaaaaatatattcattttggtaaaatctaagtgttgagttcgctattcacaaaattatatttcatccctcaaggatttttccaaattctatctctcagaaaaatgtattcatttcggtgaaatctaagtgttgagctcgctcatcacaagactacatttcacccctcaaggatttttccaagttccacctcttggaaaaatctattcatttcggtgaaatccaagtgttgagttccctcttcacaagattagatttcatacctcaaggatttttccaagttccacctcttggaaaaatatattcattttggtgaaatctaagtgttcagctcgcacttcacaagactagatttcatccttcaaggattttccaagttccacatctttttaaaatatattcattttggtgaaatctaagtgttgagttggcttttcacaagactagatttcatcctttaaggattttttcaagttccacctcttggaaaaatatattcatttttgtgaaatctaagtgttgagtttgctattcacaagacaagatttcatccctcaaaaagtttttcaagttccacctctcggaaaaatatattcatttcggtgaaatctaagcgttgagttcgctcttcacaagactacatttcatccctcaacgatttttccaatttcacctcttaaaaaaatatattcatttcagcgaaatctaagtgttgagttcgctcttcacaagactatatttcatccctcaaagatttttccaagttccacctcttggaaaaatatattcatttcggtgaaatctaactgttaagttcgcttttcagaagactagatttcatccctcaagaatttttccaagttccacctcttggaaaatatatttatttcggtgaaatctaaatgttgaactcgcttatcacaagactagattttaccgcttcaggatttttccaagttccacctcttggaaaaatataatcatttcggtgaaatccaagtattgagtgcgcacttcacaagattagatttcatccctcaaagatttttccaagttccacctttttgaaaaatgtatttattttggtgaaatctaagtgttgagcttgctcttcacatgactagatttcatccctcaaagatttttccaagttccacctctcgaaaaaatatattcattatggtgaaatataagtgttgagctcgctcttcacaagacaagatttcatacctcaagaatttttccgagtcccacctcttggaaaaatatattcattttggtgaaatctaagtgttgagttcgctattcacaaaattatatttcatccctcaaggatttttccaagttccatctgtcagaaaaatgtattcatttaggtgaaatctaagtgttgagctcgctcatcaaaagactagatttcacccctcaaggatttttccaagttccacctcttggaaaaatatattcatttcggtgaaatccaagtgttgagttccctcttcacaagattagatttcatacctcaaggattttttcaagttccacctcttggaaaaatgtattcgttttggtgaaatctaagtgttgagctcgctcttcacaagactagatttcatccctcaaggatttttccaagttacaccttttggaaaaatatattcatttaggtgaaatctaagtgttgagttggcttttcacaagactagattgcatccctcaaggatttttccaagtttcatttcttggaaaaatatattaatttcggagaaatctaaatgttgagttcgcgcttcacaagactagatttcatccgtcaaggatttttccaagttccacttcttggaaacattttggtgaaatctaagcgttgagttccttcttcaccagaccatatttcatccctcaaggattttccaagttccatctattggaaaaatatattcattttgttgaaatctaagtgttgtgtttgctcttcacaaaactagattccatccctcaaggatttttccaagttccacctctcggaaaaatatatccatttcggtaaaatctaagtgttgagttcgctcttcacaagactatatttcatccctcaaagatttttccaagttcaacctcttggaaaaatatattcatttcggtgaaatttaagtgttgagctcgctcttcacaagactagatttcatccctcaaagatttttccaagttccaccttttggaaaaatatattcatttcggtgaaatctaattgttgagttagctcttcacaaaactagattttatccctcaaggatatttccaagttccacctcttggagaaatatattcatgtcggtgaaatctaagtgttgagctcgctcttaacaagagtagatttcatccttcaaggattttttcaatttccacatctttttaaagtatattcatttcggtgaaatctaagtgttgagttcggtcttcacaagactagatttcatccctcaaggatttttttaagttccacctcttgaaaaaatatattcattttggtgaaatctaagtgttgagtttgctattcacaagacaagatttgatccctcgaaaagttttccaagttccacctttcggaaatatatattcatttcggtgaaatctaagtgttgagttcgctcttcacaagactagatttcatccctcaagaatttttccaagtttcacctcttgaaaaaatatattcatttcagcgatatctaagtgttgagtttgctcttcacaagaatatatttcgtccctcaaagattttttcaagttccacctcttggaaatgttttttcatttcggtgaaatctaagtgttgagttcgctattcacaagattagatttcatgcctcaaggatttttccaagttccagctctcggaaaaaatatattcatttcgatcaaatctaagtgttgaactcgcttatcacaagactagatttcacccctcaatgatttatcctagttccacctcttagaaaaatataatcatttcggtgaaatccaagtattgagttcgctcttcacaagattagatttcatccctcaaagatttttccaagttccacctttttgaaaaatgtattattttggtgaaatctaagtgttgagcttgctcttcacaagactagatttcatccctcaaggatttttccaagttccacctcttgaaaaattatattcattatggtgaaatatatgtgttgagctcgctcttcacaagacaagatttctatccctcaagaatttttccgagtcccacctcttggaaaaatatattcattttggtgaaatctaagtgttgagtttgttattcacaaaattatatttcatccctcaagaatttttccaagttccatctctcagaaaaatgaattcatttcggtgaaatctaagtgttgagctcgctcatcaaaagactagatttcacccctcaaggatttttccaagttccacctcttggaaaaatatattaatttcggtgaaatccaagtgttgagttccctcttcacaagattagatttcatacctcaaggatttttccaagttccacctcttggaaaagtgtattcattttggtgaaatctaagtgttgagctcgctcttcacaagactagatttcatccctcaaggatttttccaagttacaccttttggaaaaatatatttatttcggtgaaatctaagtgttgagttggcttttcacaagactagattgcatcccttaaggatttttccaagttccattgcttggaaaaatatattaatttcggagaaatctaaatgttgagttcgcgcttcacaaaactagatttcatccctcaaggatttttccaagttccacctcttgaaaaagtatattcattttggtgaaatctaagcgttgagttccttcttcaccagaccatatttcatccctcaaggattttccaagttccacctcttagaaaaatatattcattttattaaaatctaagtgttgtgtttgctcttcacaaaactagatttcatccctcaaggatttttccaagttccacctctcggaaaaatatatctatttcggtaaaatctaagtgttgagttcgctcttcacaagactatatttcatccctcaaagattttcccaagttccagctcttggaaaaatatattcatttcggtgaaatctaagtgttgagctcgctcttcacaagactagatttcatccctcaaagatttttccaagttccacctcttggaaaaacatattcatttcggtgaaatctaattgttgagttacctcttcacaaaaatagatttcatccctcaaggatttttccaagttccacctcttgaaaaatatattcattttggtgaaatctaattgttgagtttgctattcacaagataagatttcatccctcaaaaggttttccaagttccacctcttggaaaaatagattcatttcggtgatatttaagtgttgagcttgctcttcacaagacaagatttcaaccttcaaggatttttccgagttccacctttttgaaaaatatattcatttcggtgaactctaagtgttgagctcactcttcacaagactaaatttcatctctcaaggatttttccaagttccacctcttagaaaaatataatcatttcggtgaaatccaagttttgagttcgcttttcacaagattagatttcatccctcaaggatttttccaagttccacctcttgaaaaaatgtattcattttggtgaaatgtaagtgttgagttcgctcttcacaagactagattttatccctcaaggatttttccaagttccacctcttgcaaaaatatattgatttcggtaaaatctaagtgttgagctcgctcttcacaagactagatttcatctttcaagtatttttccaagttacacctttttggaaaaatatattcatttcggtgaaatcgaagtgttgagttcgctcttcacaagactagatttcatccctcaaggatttttccaagttgcacttcttggaaaaatatattcatttcggtgaaatctaagtgttgagttcgcgcttcacaagactagatttcatccgtcaaggatttttccaagttccacctcttgaaaattatattcattttggtgaaatctaagtgttgagtttgctcttcacatggctagatttcatccctcaaagatgcttttgatgtccgaccatcggaaaaatgtgctcatgtcgatgaaatttatgtatcgatttaactcgtcatggactcaaattccaggtaaagcggtggcgattcacttttttcggaagcaagaaactcgtaaaagcaaaaaaaaaaaaaaaaaaaagaggacatcaacgtctcatgatgttctgagatttcccattagctacacaaacttcaccaaagaactcctggacctcaacaagactacagctcgtggtggcgaaacaacaaccttatcacctccaaagtaggagcacaagtctaggtagaagcaaggttgagtctactaaggtcaactcaatcgatcaagccatgacacaatgatacagagaagttttcttggcgtttcttcagaaatcattagctgatgacttcaacaattacagccatgacaagacaagatcatattggctcgaaacatttggatcacatcatgtatgaagcatcaaagataagttcaactatggtgtacacgtttactccttaacaggaatgtctccatcttaagttatgcaaaatgttatgacgaaaagcatagatgtctaagaccaaacaggtgggggcgtgttccaaataatataaagcaaagtcaagcctcttcggaggagaattatacagtattatcacttaacgtgattgacgaatcattgctacaagtttggagtccatatttatatcatcactcaaaattcaaggagtcaaaatgcgagatttgtcaacaagaagagattcaagtttgaaaaagacaacttcgatgctataccacaaccttccaatgctattcaccttcatggagatgtgaattccaattggtggaatctaagtgttgagtttgctcttcacaaaattagattccatcgagaagagatttctccaagttctagctcttggaaaaatgtgttcattcgatggaatttaaaagtttttccatagtttacctgctttattccgagcaatcaatcggatagaagtggaagacgagaagattagcttcacttcgcaaaaaaaagaaagccggctatgccaattgttattgtcccttccaggaaaccaaagttaaagggcaacaaagagatcaaaccacttggattaaacccgtttaacaataatatggagacatcatctgtaacacccctatcccgctataaaaacataaacgaaataggagtgtcacgttgaacgcccgtagtcggccaacccaggtttccgaaacgaattcgttcgcccgagtcgtccaaccgcaagagtccagcctcccgcccgtggcctaaggcttttcaacccgtaccgcggacgcgagtggtgatagtccggaaaagacaaatatcagtcagtatacccatataaattttagaaatccgagtcttatatatatatatatatatatatatcatacgagaaatggttagcaaaacgtatatagttttcagatcctctttgaaaaccatatataatatacttagtaagaatttacaaaaagccgtaaaacctacattggttcgtcctaagtcacgagcaccctctacaaggttggtcaactaagttttcctgaaaaagataagtagcgtcataagtaatctagcattacttagtgaaccccggatctatatagtgttatcgtaatacccttccttaccccctaagcagcaacaacacgtaacaataatactacctaacaagcaagacataaacaaagataacacgcaacatacaacacaagcaaaatataatgcaccatgcagaatgcatgcagactcgaatttcctaatatgcagcggacaactaatgcaagcatgcttctatcaacctaggtaaggccttctacgaatccatgatctcccaaggacatgcctccatactcttagacacaaagtctataagagacataacattcctttagactatatggtccaaggttggtgattaggtcggccaaggcaagcacgaggtggcccagaccaatcaaaacgttaaaattgtcgaccaacagccgctccgggacactaatcggcctccgattggttccttccctttttcgaataaacatcatccaaaaatggataagcacgaccctaaaagaataaggatgaccggaatatggataaggtttagccttaacggataaacatgagccaccgttaaatcctggccatccgtttcctcattctaaccaaacatacgatctgtcactggaccgcaagaacattaatacggcacactctgttccaatgtctcatgagggtccatgatgcaaatcaaggcttccttaggactataacacgttccatgccagaattaaccgagtaagccagctatcgtcacttatccgcattctccaatcaaccctcgaccattcacgacccatacatatcctattgtccaaatggattcccctcgactttctaatgtttcctagaccgaaactaggtttccttaagctatcctagttcttagggctaacctaatggtttcggggtttaccggtagtcgcatcgtaactaagcttggttcgtctgatggagagtgatccctttaccatggacttgatcctattcaatgctccttacccatgacttgccacactaaatggccgaactgatcttgccttttttttgcttgatctcgcattctactcgacagactgtacgtccggccgcatagtcaaggttatgggcattacatccttcccccccttaaaagaatttgtcctccaattctaaggactaaggaagtaactagccttcaaggcaaaccgattcctttgttggttccatgaagctttgtgtagaaaggataggtttggtctcctccatttttttattgcaatattttcctccattcctaggaagttgatgcatgcctaacggactccgccactttcttttcttgtatgtgatttttgtcgtcaccacatacggtttagctaacgatttaatttatcggcttcctagtactactaggcttggtccacaaatcctaaggttccatcctaatttttatggttctctcctaactcttttgaatgggcttcagacttcctatactttctagttcctatggtttggtacttggttaagtacgaaaccaaacacacacataaatacattaataacttgaaagtaaatcaagcaatcacacaaaaggatattagtataaacataatgtaacataacattagttaacagccctaaggggaaaggaggtgattttgactatcgtacacacctgcttattcaagcctatagatatcatcaaaaagatatcacaatgtaaccgaaggttactattggctcccttgtagtcgtcgctatacatcaaaaaatggggttagtttcctaatatttactaaggtttatgactcctaagggaatcagagtaaccctaagctacacctcgaacatgtacagcctagaaaaagatcctcctccgtgtcgggaatcggtggggatgatggtcctgctacgtgagatggggaagtactagtcggtgcaggaatctgaccgtcatctctcattatcatacaagttgccgtgtaatgcccatactctccactgtaaagacaagcaatggccatgggcatatactgcgtgtataactaacagtcctcgggtaataaacatcctcaccaaagatgaagcagaacggtatctggatacccgatgtggagcccccgtcaaatgtcagaatagcgtcagccctcatttcagccgtgaaacaaagtatgggggacatgccctcccataacagtgcaaaagggctatcgggagagtgatcgatagcctccggaacgtatggagaaaccggtggatcctcatcctcatccggatctgactcataggatatcgatgaatacgggttaagtgcaaaggatggtgtggcagaactgctcgtgggaacactcacatagacatggaccatcacgatctcatgtcccttcagagccagctcctgctccaccgtcctcactcccgtgatcacacattcatcctcacaatccgaatcgatcatcatcccatcccctatatgcacatcctcctgctctgacagagcaactatccctgcaagaccaaaatcagcaaccgtatcactcgatctagtctccgatataacccgggaacactcggccacatcccttctcacacacctacccatgactctctcacgaaggtcatatcgcctggacgacagacccaaggaccgtccctcctcctccacagactcccaccacgtgatctctttagcgggatactataatacaaacaaagaggttaagacacgaaaatacaagcaaaagggtaagccacctataatactaacaacaagggtaagccaacctaaacaaaaagggtttgttctataggtcaatctacctaaactctagcaagtgactgaacaaatttcctaatagctttttacgacacatttactcgataaaacattgaaaaccatggtttctcgtagcgtcacaaaccatgctctgataccaccttgtaacacctctatcccgctataaaaatataaataaaataggagtgtcacgttgaacgcccgcagtcagccaacccaggttttcgaaacgaattcgttcgcccgagtcgtccaaccgcatgagtccagcctcccgcccgtggcctaaggcttttcaacccgtaccacggacgcgagtggtgatagtccggaaaagacaaatatcagtcactataaccatataaattttagaaatccgagtcttatatatatatatataacaaaacgtatatatatatatatatatatcatacgagaaatggttagcaaaacgtatatagttttcagatcctctttgaaaaccatacataatacacttagtaagaatttacaaaaagccgttagacctacattggttcgtcctaagtcacgagcaccctctacaaggttggtcaactaagttttcctgaaaaagataagtagcgtcataagtaatctagcattacttagtgaaccccggatctatatagtgttatcgtaatacccttccttaccccctaagcagcaacaacacgtaacaataatactacctaacaagcaagacataaacaaagataacacgcaacatacaacacaagcaaaatataatgcaccatgcagaatgcatgcagactcgaatttcctaatatgcagcggacaactaatgcaagcatgcttctatcaacctaggtaaggccttctaggaatccatgatctcccaaggacatgcctccatacttttagacacaaagtctataagagacataacattcctttagactacatcgtcatgtagcgcccagtcggtagcgatccagccctaaggccttcgtatgccataacggaacggagttacacgtgatgcacaacatacagacgggattctcatgattcgactaatgctagacatctaattaaagactaactaacatgaaaacagactcacatactatcatgcattcatcatatatatatgcaaaactctactaatcaaacaactaatcacacttaattattactaatcacggttagtccccctaatcatggtttaactaaccctaatcatgcttaagaaatacttaccctaattaatgaacactaatcctaattaacaattactaaacctaattaactatcctaatcaaggattaagcgaataattaagctaagtaatcataattaacctcctaagctatattaaggaaataaatgaataaactatcctattcacgtgctacttcacgtaactcaagactcacttggatttccgagtggtttggcttctgaatgttttctcccgcgaactaagctgttctaagcgatttttgggtctgaggaatcaaatgggcggagggggtatttatatggtccaaggtcggtgattaggtcggccaaggcaagcacgaggtgtttggaccaatcaaaatgtgaaaaatgtcgaccaacggccgctccaagacactaatcggcctccgattggttccttccattttttcggataaacatcatccaaaaatggataagcacgaccctaaaaggataaggatgaccggaatatgtataagcttgagccttaaaggataaacatgaggcacgattcaatcttggccgtccatttcctcattccggcgaaacctacgatctgtcaccagaccgcaagaacattaatacggcacactccgttccaatgtctcctgagggtccatgacgcaaatcaaggcttccttaggactataacacgttccatgccagaattaaccgagtaagccagctatcgtcacttatccgcactctccgatcaatcccgtgaccattcacgacccatacacatatctcactgtccaaatggatttccctcgaccttctaaggtttcctagaccgaaactaaggtttcttgaagctatcctagttcttagggctagcctaatggttttggggtttaccgatagtcgcatcgtagctaaacttggtccgtctcatggtgtgtcattcctttacccatggacttgatccaattcaatgctccttacccatgacttgccacactaaaaggccgaactgatcttgcctttttttggctagatctcgcattctactcgacagactgtacgtccggccacatagtcaaggtcaggggcattacaccatctcttgggaaagagaagatcgagacaaccatctctaacaacatggttgcgatgaaaaggcatacgacaacatccatagagtaaattattatactacaaaagactgtaccgatttcaagaggcatcttcctgagctacggacaattggtgacctcgcaaaaccttgacatcggagagttcgtgaaaacttaccacgaagaaaaggcggaagtcaaaaattcatcactagctaagaaaatacctaaaacatcaaatcccggagtttcttttggttctaagaagaagattgaagtaatcatgaataggtctaagttttgtagagattcgaccactacaatcaaaaagtttaagggaatgttctattaaaggcgagcacaagcgacaaactcgaactcgctagagcaatcacaatgttcaaggaagaagaaattcgtcaccttgcagaacctgatgacgttgattttgtcctcaccttagacgtggctgacgtcggggtttcaaggattgtgattgatgttggaagtttgatagatctactattcttgaatacgcttagagagaatggaaagtagcgaggctgacatagttggagccccatgaatttatcggatcaaggttatcccatcaatctatcgtcaatacgttaaatatttaatcccgaatggtgtgaaaattttacaaggagatcaagaatcttcaaaatcttgttatttaacgactcatcggatggttatccaattaacaaatctcgtgaagaaagaagtgattttaggaatatcaagtgggcaagtagtggatgacgtcataatcaaagtgaccatcgattagaaagatcatgaacgaacaatttggaagaaagtagcatctagttacaaccaaataacgatgaatgatataattcaaattaatcctaagaccactctctctaataaagagttcagttgcagcacttagggaacgaattcacaaagttctcggatcacgtagtagactaatggctaatcgaattaagctaagtaaaacagtaaagaaaataaaagaaagaaaaagtaagcaataccaatcaattgggagttgtgaaaacaagataataaaggcgtcaggcttagagtattctcacgaaatagatgatactagatctagaaatagctaggttattatcgaaccgttctcgaattcaaactatgattttagagtaaccggtggtgttccgtaaaactctctatactcagagctaagattaccagagaagccgagaaatcctatactaaagcatgcattattatcaagtttgattagttcacctagtatctaaaccagagcccttctatgagcctacctgttctttcttaaatgcttaggctcatctatgataggtcaaataacaagtacctatggtggcatacctattatctaatatcaagttctagttagctactctagaactagcattaagaacaatgaagatgaagaatcctacaaataacgtagcaagggggctatctactaaatcatctaaatccctaatgagaaaccctaaacctaacaagaagattactcaaaaatgatcatagaagaacaaaacatgattgaataagaaatcaatgaataaaacaagaggagaataaggtttagaaggatcttctctacagggagcctccacagggttttgctcccaaagtacagaattgaaaaagggaatagcctcccaaagcttagggtctaaacattgaccttaaagctatataaatatgtcttaagaacgtgctgggccttcattaaatataggagaaagttttgggccgaattcaaaaatcttcaaaacaacaataagttgcgtctttcaattgtcgtcaggtattggtgtcgctcgacaccaagggtggtgtcgttcgacacctacgtgcattttcgtctctggattgcttctgcagcttaagttgtatgttttgctccagaaagctccataatcttcaaatgcatctcaaaaatgtaaagacctgaaaaagactagaaaaacctctagaaataacaattagactctaaagcctatacctaaaacatagttaaaaacggtaaaaatagggatatatcaatgaatcctaacgattaagaaaaatacttcgttcagcaccaaccgaggtatatactattttacgatcatgccgtttgaactaaaaatgtacgtgtgacataccaacgatttgcaaacaagacgatcaagaatcatctcgaaaaacagtggaagtctatatagatgacatgctcgtgaaatcgtcaaaagagagcggtcacatttaagacttgggagaatgctttaatatcttgaacaagcttcagatgaaattgaatcttgccaagtagacattctgaatcccatccggagagtttctcggttacttagtaacaaagagaggaaccgaagcaaacccaagacagattaacgctcttttcgaacatgctagccccgaggaacatcaaagatttctaaagactctttggtaggattaccgcgttaaaccagttaacatctcaatcagtcgataaatgcctttctttctatcaaatactaaaagggaacaaagagttgagttggatgaaagatgtgaagatgctttcggtcaactaaagacatatttaaatgttgctctaattctctgaagcctgaagccgatgaaaagttgtacttatacatctcatttttgaatcatgccgttaatggagtaataatttctgaagacagaagagagtgaaagccgatttgttacatgagcaagtcatcaaccagtccaaaattaagttacactataatggagaaacttgcgcttgatgtagtcacttcaacatggaagctgcgactttatctatgtctcatccgatcatagttgaaactcttgggaaaattggttaatttctgcggagttcaagtgtccaattcgctcttcacgaaactagatctcatcccaagaaggtttttccaagtttcaactattggaaaaataagattaatttggtggactataagtgttgagttcgctcttcactgaactatctcgtgaagggtttttccaagttccaactcttggaaaaataaaattatctctatgaaatcgaagtgttgaaatcgctcttcagaacttaagataccacctcacatcaacaagcatttatgacgaagtctttgagtacaagctcggaagaagatcttcagtttctctctagattgctgctcaataacctgcctttgtattctataagcagaatacactttgtaaactcaagcttatagctccgattcgaaagtcgaggtcacttcgcaacaacttaactcgaggtcagctcccatgcataactcgagtttaattctgataccaaaactccatgattgaactgacgagtttgagtcaataaaatggatttaatcctcttggacaaggtgtcaactaacaaaacaaagatctttacggtgtttagtcgatcaacctaatacttcttaggcggagcacagttctcgcaatcaaagaaagtccaaagattgagtttgggggtttgatcaacctatttctctcttagccacatggcccaaatttcttttagccacatggcccaaatttttgaaaaagtacggactttgcaaatccggaaacttagaagcaaatactttaagcaagtgtcattccaaaacccctatggacaacgaaaaggaaaaagttttaaaaaaccctcttgggtacacaaccaacaaattttaaaaccccttgggcaaataaaaattccctttcgggaaagtcgtattcataaaataaattgggacaatccccaaattttatggtaatagccataaaagagttaagatgagctgaagcctcatcaacactcggtgtaatctcgtcttggttcaaagtagcagtggccgttccttgatcgtgagtttcagtttcataattaggagctgaacatgagctggatgaagcatcgacattagttaggatacacattttggcgagttgtcattcaagtttatgaattgattgtggaagttattttatgaattagttctataattaatggtacattggaagaaggaaagaggctataaaagagaggtgaagactccaagaaaaggggggctagagattctatattttgaccccaaatcttaaacttaagcattgttattttctcataaatacacaaaagattatttcttctccttttatgtaagatctttacataaggaatactataccattttctatgttcaattcttcatacatttttatatactctcttaaacttttattatgcatatttgtcgtgtacttttgtacttgagagttttagcccacaaataatataaatacttgagtgtgtgaatccgacatccataaaagtctgtatgagtctctggctatgtatcttctagcatggaaacacaactttagcttttaggatctggttgtggttctagttcttatagtcaatcatagacatgacatctagtcatatttgactccaaaacactaaacaagcttcttcttgcttctcaaagctttgatggtgacatcgaagtccgtatgagtctttggctttgtatcttctaacaaggaaacattacttaggcttttaagatccggttgcagttcttgttcttatactcaaccatacaaatgacatctagtcatatttgactccaaaatactaaccaagcttcttcttgcttcccaaagctttgatcgtgaagccgaagtccgtatgagtctttggctttttatcttctaacaagaaactaatacttaagcttccaagatccggttgcggttatagttcttatactcaatcatacacatgacatatagtcatatttcactccaaaacactaactaagattctttttgcttctcaaaactttgatggtgaagccgaagtctgtatgagtctttgcctttctatcttctaacaaggaaacactacttacgctttcaagattcgcttaaggttctagttcttatactcaatcatacacatgacatctagtcatatttgactccaaagcactaaccaagcttcttcttgcttttcaaagattagatacggaagccgaagtttgtattagtctttggctttgtatcttctgaaaaggaaacactacttacgcttttaagatccagttactgttctagttcttttactcaatcagacacatgaagtctagtcatatttgactccaaaacactaaccaaacttcttcttgattctcaaagctttgatggtgtagtcaaagtccgtaggagtctttggctttgtatcttctaacaaggaaacactacttaggcttttaagagccggttgcggttctagatcttatactcaatcatacaactgacatctagttatatttgactccaaaatactaaccaagcttcttcttgcttctcaaagctttgatggtgaagccgttggctttgtatcttctaacaaggaaacaatacttaggctttcaagatctggttgcggttctagttcttataattaatcatacacatgacatattgtcatatttcactccaaaacactaactaagcttctttttgcttctcaaaactttgatggtgacaccaaagtccgtatgagtctttggctttctatcttgtaataaggaaacattatttaggctttcaagatctggttgcgattctagttctgatactcaatcatacagatgacatctattcatatctgactccaaaacactaaccaagcttcttttgaattctcaaagctttgatggtgtagccgaagtctgtatgattctttggctttgtatcttttaacaacgaaatattacttaggcttttaagatccttttacggttctagttcttatactcaatcacacacatgacctcttgtcatatttgactccaaaacactacccaagcttcttcttgcttctcaaagctttgatggtgtagctgaagtccgtatgagtacttggctttgtatcttctaaccaggaaacactacttaggcttttaaaatccgtttgcggtgctagttgtcatactcaatcatacatataacatctagtcatatttgactccaaaacactaagtaatctttttattgcttctcaaagctttgatggtgtagccgaagtctgtatgagtctttggctttgtatcttctaacaaggaaacactacttaggcttttaagatccagttgtggtgctagttcttatacaaaatcatacacatgacatctagtcatatttcattccaaaacactaaacaagcttcttcttgcttcccaaagctttgatggtatagtcgaaatccgtatgagtctttggatttgtatcttctaacaaggaaacagttcttaggcttttaagattcggctgcgttctagttcttacactcaatcatacacatgatatctagtcacatttgactccaaaacactaaccaagcttcctcttgcttctcaaagttttgatggtgtaggtgaagtccgtatgagtgtttggttttgtatcttctaacaagaaaacactacttaggctttttaagatctgattgcggttctagttcttatactcaatcatagacatgacatctagtcatatttgactgcaaaacaataaccaagctacttcttgcttctcatagctttgatggtgtagccaaagtccgtatgagtctttggttttgtatcttctagcatggaaacaaaactttagcttttaggatctggttgtgcttctagttcttataatcaatcatacacatgacatctagtcatatttgactctaaaacactaacaagcttcttcttgcttttcaaagctttgatggtgaagccgaagtccgtatgagtctttggctttgtatcttctaagaaggaaacaatatttaggctttcaagatccggttgcgtatttcttagacttaatcatatacatgacatatagtcatatttatctccaaaacactaactaagctttattttgcttctcaaaactttgatggtgaagctgaagtccgtatgagccttttgctttctatcttctaacaaggaaacactacttaggctttcaagatccgattgtgattctagatcttatactcaatcatacacatgacatctagtcatatatgactccaaaacactaaccaagcttctttgtgcttctcaaacctttgatggtgtagtcgaagtccttatgactctttggatttgtatcttctaacaagaaaacattacataggattttaagattagtttgcagttctagttcttatactcaatcatacacatgacatctagtcatatttgactccaaaacactaaccaagcttcttcttacttctcaaagctttgatggtggagctgaagtccgtaggagtctgtggctgtgtatcttcgacaaggaaacactacttaggcttttaagatcctgttagggttctagttcttatactcaatcatacacatgaccttttgtcatatttgactccaaaacactacccaaccttcttcttgcttctcaaagctttgatggtgtagctgaagtccgtatgagtatttggctttgtatattctaacaaggaaacattacttaggctttcaagattcagttattgttctagttctttacttaatcataaacatgaaacctagtcatatttgactccaaaacagtaacaaaacttcttcttgcttctcaaagctttgatggtgtaggcaaagtccgtatgagtctttggctttgtatcttctaacaaggaaacactacttaggctttaaagatccggttgcggttctagttcttatactcaatcataaaaatgacatctagtcatatttgactcgaaaatactaaccaggcttcttctcgcttctcaaagctttgatagtgaagctgaagtccgtatgagtctttggctttgtatcttctaacaaggaaactcaagatccggttgcggttctagttcttatactcaatcatacacatgacatatactcatatttcactctaaaacactaactaggcttctttttgcttctcaaaaatttgatggtgatggcgaaggccgtatgagtctttggctttctatcttctaacaaggaaacaatacttaggctttcaagatccagttgcaattctagtttttatactcaatcatacacatgacatctagtcatatctgactccaaaatactaaccaagcttcttcgtgcttctcaaagctttgatggtgttgtcgaagtccgtaggagtctttggattggtatcttctaacaaggaaacattacataggattttaagattaatttgcgattctagttcttatagtcaattatacacatgacatctagtcatatttgactccaaaacactaaccaagcttcttcttacttctcaaagctttgatggtgtagcccaagtccgtatgagtctttggctttgtatcttctaacaaggaaacactacttaggcttttaagattcggttgcggttctagttcttatactcaatcatacaaatgacatctagtcatatttgactccaaaatactaaccaagcttcttcttgcctcttatagctttgatggtgtagtcgaagtccgtatgagtctttggatgtgtaacttctagcatggcaacacaactttagcgttttggttccggttgcagttctagctcttatactcaatcattccgatgtattcctatttttactgtttttagttatgttttagatataggattttaagtctttttgttatgtttagaatgtttttagagtcttttcgggtattttatggagagggacaacattggagatgaggagacattttggagcaaaagctaaggaaaagaagctaaaggacgaattcactttcagaatcagtcgagagtgtcgatcaacacacgcttggttttgatcgacaccaattgcggcccagagaagtccatcacgcttttaagtttgaaaaattggaaaattgcccctgaagactttcctattttcattattggtcttgaaggttttataggtcatatatatagttttagaggtcattgtttagacctaagaactttttattatcttgtttcacaacctctaatcttctatttgcttactttgttttctttttactttcttatattctcttctagcttaatcatgacacttagctcaatgtgtgaacaaaaggactatggaatccgacccttaaatactgcaattgatttcttatttgagagagaggttttaagacaatttaaaccatatcacatacacatgacatctagtcatatttgactccaaaacactaacgaagcttcttcttgcttctcaaagctttgaagacgtagccaaaatctatatgagtctttggcattgtatcttctaacaacgaaacactacttagcttttaagatcccgttgcagttctagttcttatactcaataatacacatgacatctagtaatatttaactccaaaacactaaccaagcttcttctttgttcttaaagcattgatggtgaagccaaagtccgtatgagtctttggttttgtatcttctaactaggaaacactacttaggctttcaagatcggattgcggttctagttctcatactcattcatacacatcacatctactcatatttgacaataaaacactaaccaaccttcttcttgcttccaaaagcttcgatggtgtagccgaagtccgtatgagtctttggctttgtatcttctagcatggaaacacaactttagctttagggattcggttgcggttctagttcttatacgcaatcaaatacatgacatctagtcatatttgactccaaaacactaaccaatattcttcttgcttctcaaatatttgaaggtgtagccgaaatccgtatgagtctttggctttgtatcttctaacaaggaaacactacttagcttttaagatccggttgctgttctagtttttatactcaatcatacacatgatatcaagtcatattcgactccaaaacactaaccaagcttcttcttgcttctcaaagctttgatggtgtagccaaagtccatatgagtctttggctttgtatcttataacaaggtaacactacttaggcttttaagatcaggttgcagtttaagttcttatactcaatcatacacatgacatcaagtcatattcgactccaaaacactaaccaaccttcttcttgcttctcaaagctttgatggtgaagccaaagttcgcatgaatatttggctttgtatcttctaacaaggaaacactacttaggctttcaagatccggttgcggttcttgttatcatactgagtcatacacatgatatctactcatatttgactccaaaacacttaccaaacttcttcttccttttcaaagcttcgatggtgtagccgaagttcatatgagtctttggctctgtatcttctagcatcgaaacacaacttttcctcttaagatctgattgcggttctagttcttatacttaatcataaacatgaaatctagtcagatttgtctccaaacactattatggcagatcatgttcaccaggcaatgacccaaaataagatcttggtctatttgagattgttccttttaatcgtaatcaaagatgttttcttgtttcttgtttcttttctgaacaaattgaagaacctaatggaccgaacacatcctacgaaagatatcggaacaccaaaaccagaaagaatgaaagtagagctaattgcgagagttcctcgttaaaagtgcaagctgtaattctacgtttcagaatcccacttaataatttcctcaaaaaatgaaatctgcttttcgtaagacgtgtctttagaatactgttcaaaacaagtaaaaaatttcaaggagtaaaggatttgatgggaattccgggtcgaagaagaggcagatcaaaatatggtgcaaaaaaacccaaatcgatatgaatggaagatgcctctggaactagtattggtcagtcggtggaacaatcacaacgttacgccctaaaatatcaactatctcaatccccaagtaattgtttaatataaagagattcgtcgccccgtctgagaaggtcacgctctattttgcctagaaataagatctctaggcggtccatttcggtcgggctagatcgggggttcgaaatgtccagcgcgtcccgcctctcgttcaagaagtcgaaaaagccttttgaggagagtaggcgaagcttcttcttgcctcacaaagatttcatggtctaaccgaaataagtattagtctttggctttgtatcttctaacaaggaaacactactttgcttttaagatttggatgtggttctagttcttatactcaatcatacacatgacatatactcatatttgacttcaaaacactaaccaagcttcttcttgcttctcaaagctttgatggtgtagcggaaatccgtatgagtctttggctttgtatcttctaacaaggaaacactacttatcttttaagatccagttgtggttctaattcttatactcaatcatacacatgaaatctagtcatatttgactccaaaacactaaccaagcttcttcttacttttcaaagctttgctggtttagccgaattccgtatgagtctttggctttgtatcttcgaacaaggaaacactccttaggctattaagatcagttgcggttctagttcttatactcaatcatacacatgacatctagtcatatttgactccaaatcactaatcaagcttcttcttacttctcaaaactttgatggtgttgtcaaaatctgtatgagactttagatttgtttcttctaacaaggaaacactacataggctttcaaatccggttgtggttctagttcttatactgaatcatacacatgacatctagtcatatttgactccaaataactaaccaagcttcttcttgcttctcgaggctttgatggtgaagctgaagtccgtatgagtctttgcctttgtatctttgatataggtcaaattgccttaagcccactctctcaaataagagaacgattgcagcacttaagggtcgaattccacaaagctctcggatcacataatagaccaaggttttgaatctacatatacatttttggtagggtttttggcaaaaaatccctcacatatttactattttcaatatgagtccttactaatttaatctcaatcaaatactttataactaaaaacttacaattagtttaattgcattaattagttgaattaactctttcctaaatttttattctcaatgaaatcattttttattgaactatattcgattgaggctaatttcctaaaatctatatatcgacattaaatataaatatctaatttttctgtcactatatttttttatatatctaattttgcttttagtttatatataaaacacatatagttaataaaatattaaattttttcgcatctgatgaaatttaaattttttaaaacaaacatataatactccatcgatgaaaaaaaaagttttaaaggtcccacattgctcaaaaaaaaaagaggaaatcgttaagagtcatacgaattagcaagaactttaattttacttcggtcctttattttaaataactaaaagtttaaaagttttcaaaaatattttatatatttaaacttttaaaaagtgaaactctataacaaatatttaaatattaatgattttaaaattttattaagatttaatttcaccagacgaggttaaaatgatgtttaatttcacgagacaaggttatatggtgggatgggtttggatcgatattgatacgggatgatatactatggacgaaatcctaaaattaacaatcaaaatacaattatactattttaaacgctaatttttttttaattagttataaaaatcatatagaggtgtatcatagtatcatacataaaaaacaatagcatgtatctatagatcatctttaatacaaaaatattattttttatttaataaaaatatagggtctttgatgtacctcttgcatatgttatatatataaataatattaattaaaataaaaatatctaattttctaacaaaattatcgacccctgtgtgctgcgggtcaatatctaaattatacaagttctagatctttattaactctaaaaaacccaaaccaaaaaaataaatactgaattttaatattaaactaacaaatatgagaaaacaaaacatgaattgtccaagatttacaaagataaaaattatgtgtgaagaatatataatttatatagaattaataattcctataaaaaatatctataacttcttaatgaacatatccacccgcggtgtaccgcgggtcaatatctagttaagctaagtaaaatagtgatgaaaataaaaagaaacagaagaaagcaatagcagattgtgaggttgtaagacaagaaagtaaaaacgtcaggcttagggtattgtcagaaaactattggttagtagatctaataatagctaggttgttatcgaaccattcttaaactcaaactctaatttttgaataaccagtggcgtttcgcgaaactcccaatgcctatagctaagaataaccggagaagccgagagatcttatacttatacatgcattctaaacgagttcaattgttcaccttagtagataggccgattcttattacacacctataaccgaggctcatcaaataattaaatccaactacagatacttatggcgggtatatctattgtttggattcaagttctaggtgatcaagctaaaactagcattaagaacaattaaagatgaagaattctaaaatactccattatctccaaatgaatcccaaacatgttaagaccttaagtggattagaaaagactctagaaataacaaatagactataaaacatatacctaaaacatagttaaaacatgtaaaaatagggatatatcaatcttctaacaagtaaacactatagtggtggatctagaacatttttttatataggacaccataaattatttataaataacgatataaatgaaatatgtaatataagatttctaaagtgttgcatgtacaacttttcataaattttgtattgattttgaagtatatttatgaaatcataagaatatttaattattttgtgaaaacaattacttgcacacatatagccattaagaaaagaaaagtaaactaaatttaggaaaataaacatacaattagtatcgatgatgataggatactgagattatagaaaaggaaaaaaaaagttttgtgtgtatccacttgtgtgttccatgatctcattcttgcacccgttgttagtctatcatgaattgcaagccaagtgatgaaagagaacttcggtgtagcttccgagaaccaaatccctttcgcccatctgcagattggtttttcaactctcagcattttccaagtttcatttgaggagaagttgtgtttaaaacctgtcttccatttccatagaatcaaatcttcctcttcaaccttcctcctcacccttgtttccctgatgacctcttccactctatttaaagtctccactctatgccgtctacctctgtgagaggccaaaacgtcacccactgtggcttcttttgtaatacccaaatcaatgcaccctcgatctccaaaagtatcaaataagttccccaaagaggaccatgtatcataccaaaaggatgtccctttgccactttttatttcaacctgatagaaatcctttgccaagtctctaagctttaagagtttcctccacatccaagaaccttgagatgaatttcccttgactgtccaaaacgtttttttccgaattaaataggcatgaatccacttactccacagagacgttggtgctgcaaataaacgccaaattagcttcagaccacaaactttgtttgtctctttgagaggtcgaagacctagtcctccttctctaatcggcaaacaaactacatcccacgatatcttagctttagaaggatttaaatcaggcccactccagagaaaagcagaacaaagttgttgaatctctttaatacaagcgccgggtaagctgaatgttgaagaccaaaagtttgtgatgctcatcaagaccgctcttatcaactgcaatctccctgcataagatagaaatctacgcgtccaagagcttattctggttctgattttctctactagaggaagataatcatgagctgacatagctttagtcatcaaaggtaaccccaaataccgtactggcagcttacctgttgcaaatggaaaactccattgaatggcagcttgagtagtagggtcaatccctgccatatagagagtagatttctcaatactaattctcaaacccgagcattttgcataaccatcaaaaacagagataatttcctcgatcgacttctttgtcccttctgcaaaaaccattaagtcatctgcaaaacacaagtgcgtgagaagaacattgcgacattgtgggtgataaccaacctttccctccattgccgccttattgatcatttgggttaacacattcatgcagatcacaaacaagtaaggtgataaagcacaaccctgtcttaaccctctcttactcccaaaaaaccccggaagctcaccattgatttgaactgagaacgtagctgttgatatgcagagatggatccagtgaatgtatttggtcgggaagtgcatagccttaaaagtgttcagcagaaaagtccattgtaccgaatcgaaagcttttgaaatatcaatcttcatggcacacctaggggagatgtcgtctttgtgatagtttttaacaatctcggacgccaacaaaacattctctagtaagagtctgttttttatgaacgcagactgatttggcgagataagctccggcaagtagaagcttcaacctattggccaatatcttagatataaccttgtagagaacgttacaacaagatatcgatcgataatctttcattattttggcatcttctttttttggaatcagagcaaggatcgttgtgtttataccttttggaaggaaacccttaatgaagaaagattgaatcgcagtcgtgaaatcatcgccaatgactaaccatgccgatttaaaaaattcactcgtatagccgtctggaccgggagctttgttcgctggcattgcaaagagaacctgcctaacttctgcagcagtgacttccttttcaagcattatctgttgagcctcagtacatttgaaaggtagacaatgttccaaagtctcagcagtcatttcttcataatccaaaggtacatggcctaagaaatccgagaaaaaatgctctgcttccttctttatttcatcttgactagatgcaattgttccatcctcacattgtatttcccagattgtgtttattgactcccgtaacttagctgcattgaaaaacgttttgttgtttttatcccccacgtcaagccaatgcagctttgacttttgctttagaaatgactcttccagctctgacaaatgagaccactttctataagcttctgtttcgtcctgtgatgctgcatcagtcggacaagacaaagtttcactctgtttcttacatagatcttcaaaagctgcttttactctcttgtgcaaatcaccaagtttctccctacttaactgtctgatatgaggtttcagatttttgagcttcttggcaaaccggaatattgcagaagtagagtgaaacagggttggtgtatcttgccaataagattgcaaaaggggttgaaactctggcatcgtagcgtttgaatttgtgaacttaaacggtttcctttttaccactttctctctttggatttgaattctgcagcggagatggtctgaacaaccgcctggttcaaaaacgcaatacccttgtgagtagtggttgagccattcactattgataagaaccctgtcaagcttcttacagattaccccctcatctctcttgttactccaagtgaataacggaccatgagatcctaaatccattagtgaacaatctctgataacctcttgaaaatctctcatacctactggaatagtaggcatggtttcgaaatttgaatgttctactccatccaatatctcgttaaaatcacccataagcagccatcttttatttctaaacaatggcgaatcctggtgattcctcaagtcttcccataacactttcctctcttctgctaaattctttgcataaatgaaagaacagaaaaattcatcttcttctccctccattagtatagaacatgtgattagctggtcacttttgaatattggagttaaacgcacggtagatctccaaagaacccaaatgcgaccatgctgattgaactcatagtttgccataaaagaccaattgttgaaaactgtagacacaatactcgttgccttcttttccttgactctcgtctctaataagcatccaaattgcatctcattattgtttgtccagtgacggaccacagaatgtttagaagttttattaaatccgcgcacattccatgaaaaacacgacatttagtatgctttacggtgtgacttcttgcctgcaacttttggaactgagttctttgttgcctgattcgaagtcaccgtaacatccttcttctttcttgagtgagtacgtgttgcatttggcttatcatttgtctctgtctcctcgacaaactttgtttctacatcatttgcctcttccgtagcgctattctttacattgtttcccacattttcaaatatttcgccttcctcctcttcatccatactcaagactgcatatttggaagctgacaccaatgttgattcctctacttctgctcctttgctcgggctacgacttactttagaaggagaaacctgtaaccattcaccctgttccttcatgtgaacatcctgttccttcactattactatttctgatgctggagcagagacagtttcatgagtggtgatttgattagtagataaaatagcgttttatacttttatgctatagtaaacaaccctcattttttctataacgttttaaaatttgtaaacgctatgtttgggtgattaaaattttattctgagtcacgcttctaggttaaacatataatatagcagttatcatttattaaacgctgtgtaatgtttagaaagaaaccaattttgcccgctagtacttagcaaaattttggccacaaaaaattgagtaccctctcaatattccacactactctctccagctctctccattgtttcacgcatgaaccttttcttaacaattgctttaatcttcagctctcttccattaattctaaagagataatcgatactaatttggggttttcagcagatctaggtttggatacacatctctctcttcttccacctcataatttctttcgactgttattcatctaatttaggtttttgactgcaggttgctttgctgagagattggtgtgctcgagttaaggagaaatttgtgtgagcaattggtatgattttgttttggtcgattttgatttagggttaaaatttccctatttgattttttcaatttgctttgacagggaggagatttcgacagaagtaaagctatataataaggtaacatgttctttatgttcgattgagacaagtaatgtttcgatttttggagttggagtcaagttaatggcttcttctgtcttctgttttctagctttttttgttttgacaagaatgtgtgatggtttcaaatttggattttgttttcagtttgtgcattgatagagttttacagaggaagctttcggtcattgatagagtttcaaatcaaaggtatctcaaattttaaagtatttgttcagtttgaagcgaagggatttgttctagagaatctcaaattgcttccttgtttccttgaagtatcatatccatcaatcaacattcttgttacttagaggtatatatatccttcatatttcattgaattttcttaaaatatgtttcatattgttatgtgattgcgtctagttattatagtgtctaactctagaaacttttatcacaaatgtatgtatcttttggtcgtggagctgtgatcttattgtaacatggacaagtcttgggtttggctttcaaggtatggagttgtatcttaatcttagttatgttagttatgttctccaggactagccttgagtatgagcaaggagccacagattttgtgaaagcatcagcgaggaagctgggtaatcctcccaacatgttttgtccatgtgtagattgccgcaatgtgtgtcatcaaccaggagacacggtacttgatcatctggtaattagaggtatggatcacaagtataagaggaattcatgctggagtattcatggggatttaagaaatgagacaaatgagattccgggttcttcatttgaagcttatgagttgtttagaacagcttttcatgaggaagaggaaaatttacagtctcgggaaagactatggagatcaaacagaggacagtaaagaagattcagagtttaagaagaaagtaaaacaaaggaataagaagaaagaagataggaagtgcacgagagataatttgtctgattttctcatgtaacaatcgaataattataactatagcataaaacaattaatagtagtgtggggcacgtgcctatgtatgtagtcttgcaccttgatccgcctttgaaacattatatacgcttttaagattcggttgcgattctagtttttatactcaattatacatatgacatttagtcatatctcactcctaaaatactaaccaaacatttttttgcttctcaaagttttgatgctgaagccgaagtacgtatgagtgttttgtattgtatattctaacaacgaaacactacttaggctttcaagatccggttgcgattctagttcttatactgaatcatacacatgacatctagtcatatctgactccaaaacactaaacaaacttcttcttgcttcttaacgttttgatggtatagttgaagtccgtataagttttaataatgatacattacttaggctttcaagatccggttgcggttctaattcttatgtgctacaagaaaactgggttttaacgactacacgataagttgccaaatagtcgtcaaatagtgagttatgactaataagcgactaaatctggtaatcgtaaatcgatggtaaaataaatagtcgtaaaaatagtcgccaaatagcaaatattgtacgactaatattcatagtcgtaagagtagtcataaaatagtcgtcaaatttagtgactaattaacgactaatctgcgattaaatttcacgaacataaattgtttgtagtgttatagtagtagagtagtcgttaaaattcgttaaaatttagtgactaatttacaactatattgcgactatggtcgtatttatgtatttatacagtattgtatttatttgtacagtatttatatatttgtacagtatttatgtatttatttcagtattaatattaatatttattattaattatttccaaacatatttttattaattatatttaaaagaataccatattacaaaataaaattacaaacattataaaacataagaatacatcatcctcctaaaaacataattaaaacaaagtagataacaatctttaagaaagaactaggtctgaacaagcagtcaagtcctatgaacactaaccgttttgatgaggtaaaaggaagagcagtgagattagctccagcctctgtggattatgttgggaatggatgtccttaagtttgttgattggctttctggattttccattagtcggattgatttgaatctgtagtacttaaaccatccatgcaataaagtcgagagatagatcataatttcagacaaaagtttgaactcaataaaacgactatctaagttagaatgacacaactaactcatgagaacagaaaagatgaagttagtaactgactcccccagacttagataacactgtccccagagttattaagctagaggaatcgaaagaaaaataatcaaaagttaaaagttagagaaacgtgagttgccacctgagagtggtgtcgatcgattataggttggtgtcgatcgacactcaggtcatttttgcatcgctttgcgaattcagctcatcgttgtagagctttggttagtgttttcacatggatcctccagttagactgttaaatcactaaaacacacatcaatagttccaacaaagcataggaaaataagtgcaacaagttccaatacaaataacaaatagtctgaaataaagcaaaaacaaaatcagaaaacaaagcaagatagggaggatggctagtcctcatgctccgaacgggaggtgggtgcgggagaacgatgacgacgacgagtggaagcaacacaaccgcagcgagagagtgtagctatggcgttccaaacgctcttgaagctgtcgacgatgtattgctgaaagacatatggctctatcgggataggagtaggagaaggcagctcatatggtagagctaaagaagaagatccaactctcggacccccaacagggtcaatgaactcatcctcagtcttagtcggtgcggatccttaagctgaacctctctgtctcctggagcatggcgcggaatgcagacgggaaggatcatgatgaaaaccaatctcctcatgctctcctgtaatctctgtaagtgcagggcaaggtaactgaatcatatggtgtcgtgtttgtctctgaaacaccagaggaagttgccttccagccagtgaaagttcttaagatatctttcatccattgtgaatctcgtggtgttgacctcttctccttcaaagctgatgcaaaaatgctcaaatataggagtgagaagactgccaactctcttagatttcttccttttacgtgtaaagggcttggtcttgagtgagaccaagtgatgagcaaacacaacgccaaagttgacatcgcggacaacctcctcaactccaaagctgtcaggaaagaaatcatgaacagcatgatagagcaacaacaacatagaaagtctcatcttgccaggcttcatcttgcacaacagtgtgctagtaatcagcctaaccaaatatcgcagaaaccgggtgacgaatctctgagtgaacttcgtccttggaatcataaattccattaccaaacctgcactagataacctgagcatccttaaactgttcaagcagggaaactccagtgagatcattgtcaaaaccatagatgtcacacaaatctcttggtggtagactctatctgacaccgcgaatgaagtagataagagctccttcctgagcattgcgtttcctgtcattcacatagtagaccctaacagaaaccatgaattgtctaactagctcaggatacaaatcgtactacctacaacagatggttcccaaacctatatcatctagcagtcctaaaacagatttctctatctgcaaacgctgcattaaaccaaaatccgcaaaccaagtaggcaaaatttctacactcatctaggcattatagaaaaaagtatcataataatcccaatctggagaaaaagggcgattgatatagtcacctttagtgaattctttgttgacatccttctcccaaactctttgagaaagaattctttctgttagtagctttggccatggaaatcaatagataagaggttgaggcgctgcagcaggtagtggcggttgggaagggcggagaccggcggcggtggagaaggtccggcggtggtgagcagcggcggaggaggaaggtggaggaacactcttccttgccttctttttctgcccagtcatgttgcagatcgatg

SEQ ID NO: 207 - DNA, 82596 bp, Arabidopsis thaliana
gaattccatatgattctttggctttgaatcttctaacaaggaaacactactttagcttttgggaagcagttgcggttctagttcttatattcaatcatccacatgacatctagtcatatttgactccaaaacactaacaaagcttcttattgcttctcatagctttgatggtgtagctgaagtccatatgattctttggctttgaatcttctaacaaggaaacactactttagcttttgggaagcagttgcggttctagttcttatactcaaacatacacatgacatcttgtcatacttgactctaaaacattaacctagcttcttcatgcttctaaaagcttttatggtgtagcaaaagtccgtatgagtctttggctttgtatctcctaacaaggaaacacaactttaacttttgggaaccgtttgtggttctaggtcttatactcaatcatataaatgacatctagtcatatttgactctaaaacactaaccaagcttcttattgtttctcaaaacttttatggtgaagccaaagtccgtatgagtatttggctttctatcttctaacaaggaaacactaccttaccttttgggaaccgattgcggttctagttcttatactcaatactatacatgacatatagtcttatttgactccaaaacactaaccaaactgcttgttgcttcttaaagctttgatggtgtagccgaagtccgtatgacgttttggctttgtatcttctagaagggaaacattactttagcttttgggaagatgttgcggttctagttcttatactcaatcaaacacataacatcttatcttatttgactccaaaatactaaccaagcttcttattgcttctcaaagctttgatggtgtagccgaagtccgaatgaatctttggctttttatcttctaacaaggaatcactacgtcagcttttgggaagcaattgcggttctagttcttatactcaatcatccacatgacatctagtcatatttgactcccaaacactaacaaagcttcttattgcttctcatagctttgatggtgtagctgaagtccatatgattctttggctttgaatcttctaataaggaaacacaactttaacttttgggaaccggttgtggttctaggtcttatagtcaatcatataaaagacatctagtcatatttgactcgaaaacactaaccaagcttcttattgtttctcaaaacttttatggtgaagccaaagtccgtatgagtatttgtctttctatcttctaataaggaaacactactttacgttttgggaacaggttgcggttctagttcttatactcaatcatacacatgacatcttgtcatacttgactccaaaacattaacctagcttcttcatgcttctcaaagcttatatgctgtagccaaagtccgtatgagtctttggctttgtatctcctaacaaggaaacacaactttaacttttcggaaccggttgtggttctaggtcttatactcaatcatataaatgacatccagttatatttgactggaaaacactaaccaagcttcttattgtttctcaaaacttttatggtgaagccaaagtccgtatgagtatttggctttctatcttctaacaaggcaacactactttggcttttgggaaccggttgcgattctagttcttatattcaatactacacatgacatatagtcttatttgactccaaaacactaaccaaacttcttggtgcttcttaaagctttgatggtgtagccgaagtccttatgactttttggctttgtatcttctagaagggaaatattactttagcttttgggaagatgttgcggttctagttcttatactcaatcaaacacataacatcttgtcttatttgactccaaaatactaaccaagcttcttattgcttctcaaagcattgatggtgtagccgaagtacgtatgagtcttcggctttgtattttctaacaaggaaacactactttagattttgggaaccggttgtagttctagttcttatactcaatcatacacatgacatctagtcatatttgactccaaaacactaaccaagcttcttattgcttctcaaaactttaatagtgtagctgaagtccgtataagtctttggctttgtatcttctaacacagaaacattactttagcttttgggaattggttgcggttctagtcatatttgactctgaaaaacttaccaagcttcttattgcttctcaaacctttgatggtgtagaggaagtccgtatgagtcgttggcttagtatcttcaaacaaggaaatattactttaacttttgggaatcggttgcggttatagttcttatactcaatcatacacatgacacctagtaatatttgaatccaaagcactaaccaagcttgttattgcttctcaaaattttgatggtgtagccggagtccgtatgagtctttggctttgtatcttctaacaaggaaacattactttagctagtgggaatcggttgcggttctagttcttatactcaatcatacacatgacaactagtcatatttgactccaaaaaactaaaaaagcttcttattgcttctcaaaattttgatggtgtagctgaagtccgtttgagactttggctttgtatcttctaacaaggaaacactactttagcttttaggaaccagttgcggttatagttcttataatcaatcatacacatgacatctagtcatacttgactccaaaacattaacctagcttcttcatgcttctcaaagcttttatggtgtagccaaagtccgtatgagtctttggatttgggggagttgatatgtctataatttgcatgatttcggcattcattcttcaccactttgtcattgtttcgtccacatttcatctcattaagagtcgttttagtgtgttttgcatacttaggacgattttgcattaggattgcatgtgcattgcatatttggttgttttcaggtactttggatgcttttggatttcaaacagaggagaaacagaacagaaagttagaatgcctaatgacaccttcagcaaaagtactctatcgcagccttggagccctgccagggcaaatcactctatcgcaaccccggagaagctagcagctcagtttcactcaatcgcgaagccggaggaatcaccccatcagaaccactcaataaccaccttatgatattcactcgatcgcactctatcagagggtcgctggaccattcaatcttgacttcactgcatctcacttgatcgcaagcggagcccctgcagcccagtttgatcaatgacatactcgatcacaggaaagctcattttagtccatcagatgccaatgacacattcggtcgcagggtcatgacgtgaagattcgctatatatctagtttccttatttgtttcatttctcgcttatataaactgcctcttagggttttcccgagggcattcgttattatctcgtcttttttgcaactttcatagctgaagtgtttctcctgcgactttgtattttgtctttcattatttctgttatcatgttttcaatcgttgttttgctattgtttttgattatgtctgagtagtgaactgtatttctgaggatgagatagattagttgtagtttacttggtcgttttaggtggttgagtttagaatactagaatcccttctggattagttgcgcttattgcttgtttcactgactaatgtggaatatgagtccagacgtccagcgctcagaaggcgtttaataggcgttggatccaattaattccagaggtatctgactctaccccaacggattgactgtagagagggtattggctttaacatgttgattcgataatgccttcttagttagagatcgctaatgagaattagttcagtgtctagttatgcttgaggatttctatcacgggagtgaattaatctgttgttgaacttgttgtctagggatagcttctatgaagttttgtcaaccacttgaatagattaaggagaccatactattcgattaccccatccttaagaatcgtttatccatttgattgcctgttatcatttctgctttgttatttacctgcctactattgccatttctgcttttagtttcatttcatttctgttattgcatactaggactgttagaaccaaccgactctctgcttggcttgacttagagctttctaatcatatctcatctgtttgcatcacaccggattggattgacatcctaaaatactacaacgacaagatagtgttttaggattaattgagaaaaatcctactatcaatttggcgccgttgccagtttcgtgtttgtttgttatatttgagatcattagaaacgttaagatcaagttcggttttgttacacaagttactaacattgtgccttttctgtctttgtgtttcaggtaccttgcaacccgctttacagacgcatctttgattcatctgttatagcacggctgctatatgttgcatgcatacacggtcacaaggaaatcagaacctcctattcaacaataacatcgaccgtattgctcgccaactgatagaacagacagaaaccgacacaatggctgacgttgtagatgagcaagagcaacctaccaacgttggtgctggtgacttccctcataaccacgaccagcgtcatggaattgttccacctctagtacagaacaagaactttgagatcaaaagcggtctcattgcaatagttcaggggaacaagtttcatggccaaccaatggaggatccgctagatcatcttgacaagtttgaaaggctccgtggccttactaaaatcaatggagttagtgaagatggtttcaagcttcgcttgtttccattctcacttggagttgaagcccatctgtgggaaaagacgctaccccagaattcaatcacgacctgggatgactgcaaaaaggccttcttggcaaaatacttttccaactccggaatgagatatccggattcactcagaagcaaaatgaaagattctttgaagcttgggagcgctttaagggttatcaaaccaaatgccctcatcatggatttaagaaagcttctcttctcagcccactttatagaggtgtcctgcctaagatacgaatgctctttgacaccgcttcaaatgggaatttcctgaagaaggatgttgaagaaggatgggagctagttgaaaactttgctcagacggatggcaattacaatgaagattatgaaagaagcatccacaccagtactgaatctgatgacaagcaccaccgagagattaaagctctcaatgaaaaaatcagcaaactcctccaagtgcagcagaagcatgttcacttcgtctctgaagacgaagtattccaaatccaagtgggggagactaatgagtgtgccgaaatcagctatgttcagaatcaaggtggctacaacatagggtacaacaattacagacccaatccaaatctgtcatacagaagcaccaatgtcgccaaccctcaaaaccaagtttatccccagcagcaacaacagcagaaccaaccaaaaccgtttgttccttataaccaaagccaagggttcgttccaaagcagcagtttcaaggaggatatcaacaacagcagccacaacctggtttcacaccacatcaacaacaagcacctgcgcctcagaattcagacataatgactatgctccagcagctcattcaaggacaagccacatgagcaatggaaatcgctaagaagctggctgaattaaacaacaaagtcgacggacaaggtgtcgaacttaacagcaagttcgaatcaatgagcactaggatgagatatgtggaaggcatcctcgcttcaccatctgttaacaacaacccatgccagctttcaggcaaagcaatcatgaatccaaaggagtatgccactgcccatgccatcactatcagacatgatcgagagctgccaactcgacatgtccctacctcaaacactgaggacagtgttattctagagggggaggatttttatcaagatgatgttttggctgacaaaacaatcaaagagcccatccttgacagtcatcgcactcgaccacaagctccgctagctactaccttcgttgcaaaaccgacagctgcaaagaccaaagatacagtcttcgtgccaccgccttaaaaacctccacttccattccctggtcgatttaagaaagttctggttgcgaaatattgagccctattggaaaaacagataaaggatatgcctttagtggattgtctcgcgctaatacctgacgagcacaagtacgtgaaagacctaattatagaaaggatcaaagaagtccaaggaatggtggtattaagtcatgagtgcagtgcaagaagattgttcaagaaaagttggaagatccaggatcttttactctaccatgctccattaggcaattgcctttcagcaattatctttgtgatctaggagcctcagtcagcataatgccactctctgtggcaaggaagctgggtttcgttcactacaagccttgtgacctaaccttgattcttgctgataggagttcaaggagaccttttggcaagttagaggatgtgtcagtaatgattaatggagtagaggtccctactgattttgttgtgcttgagatggatgaagaatctaaggatcctctgatcttaggaagacctttcttggcttcaactggagcagtcatagatgttaagcaaggaaaaattaatcttaatatgggggaggatttcaaaatgaactatgaaatcagggacactatgaagaagccaacaatagaaggacaaaccttcttagttgaagaaatgggtcagctagctaatgaactgctagaggagcttactaacaaagatcaccttcaaactcctgtgatcaaaagtagtgaagctggatttctctccagtgagaccttgagctatgagatgtcattagactcacacaacaaagtaccaggatcagagatctttaaaggtgtcattgcgttagaaagagaggatgttgcattgaacgaggaaggctcaattgatattcgactagagtgctcaaccaaacagctaaagtcaagcatgagggcatcaaatgattggctagaactcaaggagaggtctaaatggcacgacagagctataagagagctaacacacactgtgaaagagctgaaggatcaagtcaaggagctccatgggaaagccaaccaagcaccactcgacatcaaggacgtcccaaatgatgaagttattcctatggttagaaaagaaggatgtgaattcacattagaacagtctagaaaagacgactatccagatgatgaaaaaggagcttacgaagaaagggccattgagtactcaattatagacctgtcacgggagcatgctgaatttgatgttgtatctactaaggaaggagaggagacgtcaattctactctatcatcctccttgagcctaatgagtgtgaggagtcaagctagagacttaaaacaagctcacttgggaggaagttccatgcttatccctgtatatagtttttattttatttagttacttttgatttgttttggttttggttttgattctcaggaaatgaataacagctggagcaacatcagggatgcaaccgagtgttcaaataaaaaaattcaatttttttttgatgaatcactcgatcgcaagatgagagtaaaagctcgagagtgcgatctagtggttttgggacaacatctttctcaacgacaatgtcaatctactcgatcgcaacatggaagtggtgtgattgagtggtcttctagtggaattgcccaaaccactcaatcgcaaggagaagtgaaaacgcccgtcaggacttcaatgataacccgcctgaagacatgccatccagctgccataatattgccctacaaaggcaatccacctatcaacagagggaccacaccgttctgcaagttcccgtaaggcacgagtctcatgagccaatggagcacaagaggcggaagagcgctaggatggtccgatcatcaagcaagggttggataatgtcgggtcggagaacacatgagcgacgtgctgcacaacctgctcgggttgcgatcgagcacaatgacgaggagatggcggagccacaccaagaaccggtcatgcctactgaggtaacacactaaaaccctttgtaaataccgcttttgtttttgtttttctgtgtttatcttgaattctttcacaaattttgattacacaagggactgtgtaatttaagtttgggggagggttcaagacgtatttgacttgtttttgtgaatatcatttgactctgcatatcatctaagtcatagagaaaaaacaaaaaaaaaattgaatttttttgaaaatgaattccacataaacagagtgatcatttagttgcattacatttaggatagagtttagagtgtttcatataggattgttgcatatgcataggggataatgaggaattagccttgaagcatgatgattcactaaaatgagttattagttctctaaggcatttgaatgactttgaagtaaaaccgcaccatgttctatagacaccactcgatgcatgtcatgacaccttttccctgtcaatttgaacttgaatctgacttataattatcatgtttgcatcgtttttgaactcgtggatagaatacatatttggattttctttcacttattcaccactcttgttaatccaagtagctgcttctattattggagtagttcacccttaaccaatccttctttcaagccatgttattttatgagagcatgtgaggcctattttcaggattgagcttggtagaacgtgttaggtttgagccgacaagagtagtatctcatgtagttccaatccgtatatttggacttagtaggactaggtgggaacttatttggggatagggattgagtgtgaaaagaaaaagaaagaaaaaatgggttagagtctttaggagaaggaagctaaaaatcatattgaggtctagtaaatgtttgggaagcataaaattgttaagatatgctctaaaaaaaagagatggcagcaaaaacagaaaagaaaaaaataaaaataaatgataagagccataagagtttaagaaaaatccaattcattagactagactcatagagtttaagaaaagcttctccttaagaacaagagctaaagaaaagaaaaggaaacattgatccaagaaaaaaatcgaaatatgcctttggtgcaaaagggtagacttaggatcatcattgggtttagagataggaccatcttcttgttattcacggtttatgtcattgggtagatgggatgctattcttgtatgcataggttggcacttacctttagcattcttctaaagctcggtcctttttcattgagagtcccctgctataaaaatctgaaccacttaaaagggactatctttgtctcataacctgtcactagccaaatgcgttcactagcgatgcatatcttgattcatgtttttgacgcattgtgcatttgagtgtaggtttggatcataacagagaatggctaaagtttttatgtaaaagtcgatcacctcgcatcttagaactgttagctggtacattgatcttaattgtcatatctcatgctttggttctgaatccccaacttcaaacctctccttccgcttatgtcttcttgtttgcttgagggcaagcaaagactaagtttgggggagttgatatgtctatactttgcatgatttaggcattcattcttcaccactttgtcattgtttcgtccacatttaatctcattaggagtagttttagtgtgttctgcatactaaggacgattttgcattaggattgcatgtgcattgcatatttggttgttttcaggtactttggatgcgttttgagttcaaacagaggagaaacataacagaaagtcagaaagcccaatgacaccttcggcaaaagtactctatcgcagcctcggagccgtgccagggcaaatcactctatcgcaaccccggagaagctagcagctcagtttcactcaatcgcgaagccggaggaatcaccccatcagaaccactcgatcaccacctcatgacattcactcgatcgcactcgatcacagggtcgttggaccattcaatctcgacttcactgcatctcactcgatcgcaaggcgaagcccctgaagcccagtttgatcaatgacatactcgatcacatggaagctcatttcagcccatcagatgccaatgacacattcggtcgcagggtcatgacgtgaagattcgctatatatctagtttccttatttgtttcatttctcgcttacataaactgcctcttagggttttcccgaaggcatccgttattatcttgtcttttttgcaactttcatagccgcagtgttttcctgcgactttgtattttcactttcaagtatttgatattcagttttcgtctaagtctttcatcatttctgttataatgttttcaatcgttgttttgctattgtctttgattatgtctgagtagtgaactgtatttctgaggatggaatagattagttgtggtttacttggtcgttttaggtggttgagtttagaatactagaatcccttctggcgtttaatgggcgttggatcctattaattccagagatatctgactctaccccaagggattggttgtagatagggtattggctttaacatgttgattcgataatacctacttagttagagatcgctaatgggaattagatcagtgtctagctttgcttgaggatttctatcacgggagtgaattaatttgttgttgaacttattgtctagggataaccgtgaaattttgtcaaccacctaaatagattaaggagaccatactattcgattaccccatccttaagaatcgtatatccatttgattgccagttatcatttctgctttgttatttacctgcctactattgccatttctgcttttagtttcatttcatttctgttattgcatactaggactgttagaaccaaccgactctctacttggcttgacttagagctttctaatcatatctcatctgtttgcatcacaccggattggattgacatcttaaaatactacaacgacaggatagtgttttacgattaattgagaaaaatcctactatcatatcttctaacaaggaaacaatactttaacttttaggaaccggttgtgattctaggtcttatcctcaatcatataactgacatctagtcatagttgactacaaaacactaaccaagcttcttattgcttctcaaaacttttatggtgaagccaaagtccctatgagtatttggctttgtatcttctaacaaggaaacactacttgaacctttgggaaccggttccggttctagttcttatactcaatcatacacataacatatagtcatatttgaatccaaaacactaaccaagcttcttattgcttctcaaagctttgatggtgtagtcgaagtttgtatgagtctttggctttgtatcttctaacaaggaaacaatactttatctcttgggaaccagttgcggttctagttcttctactcaatcatacacatgacatatagtcatatttgactccgaaacactaaccaagcttcttattgcttctcaatattttcatggtgtagccgaagtccgtatgagtctttggctttgtatcttctaacaaggaaaaaatactttatcttttgggaaccgactgcgattccagttcttatactccatcatacacatgacatctagtcatatttgactctaaaacactatccaagcttcttcttgcttctcaaagctttgatggtgttgccaaagtaagtatgtgtctttggatttgtaacttcaaacaaggaaacactactttggcttttgggaaccagttgcgtttctagttcttatactcaatcatacacatgacaagtagtcatatctgacttcaaaacactaaccaagcttcttcttaattttcaaagctttgatgctgaagctgtagtccgtatgagtctttggtttgtgtcatgtaacaaggaaatatacttaggttttcaagaactagttgcgattctagttcttatacgcaatcatacacatgacatctagttatatttgaatcctaaacactaaacaagcttcttctagtttctcaaagatttgatggtgtagccgaagtccatatgagtctttggctttgtatcttctaataaggaaacactattttagcttttgggaaccggttgcggttatagttcttatactcaatcatacacatgccatataatcatatttgaatccaaagcacttaccaaatttcttattgcttctcaaagttttgatggtgtagccgaaatccgtatgagtctctatctttgtatcttctaacaaggaaacactactttagcttttgggaaccagttgcggttttagttcttatgctcaatcatacacatgacatcaagtcatatttgactccaaaacactaaccaagcttcttattgcttctcaaaactttgatggcttagccgaagtccgtatgagtctttggctttgtatcttctaacaggaaacaatacttttgcttttgggaaccggttacggttctagttcttataaacaatcatccacatgacatcaagtcatatttgactccaaaatactaaccaagcttcttattgctacgcaatactttgatggtgtagccgaagtttgtataagtctttggatttgtatcttttaacaaggaaacattactttagcttttgggaatcgatggcggttctagttcttatactcaatcataaacataacatctagtcatatttgacttcgaataactaaccaagtttcttattgcttctccaagctttgatggtgtagccgaagtccgtatgtgtatttagctttgtatcttcaaacaaggaaacattactttagcttttgggaatcagttgcggttctagttcttatactcaatcatacacacgacatattgtcttattttgactccataacactaactaggcttcttaatgcttcccaaaacttttatggtgtagccaaagtccgtataagtctttggatttgtatcttttataaaggaaacattactttcgcttttgggaattggttgcggttctagttcttatactcaatgattcacatgacatcatgtaatatttgacttcaaaatactaaccaagcttcttattgcttctcaaaatttcgatggtgtatccgaagaccgtatgagtctttggctttgtatcttctaacaaggaaacataactttagctattgggaatcggttgccgttcaagttcttatgctcaatcatacacatgacatctagtcattttgactccaaaacactaaccaagcttcttattgcttctaaatattttcatggtgtagccgaattccgtatgagtctttggctttgtatcttctaacaaggaaacaatactttatcttttgggaaccgactacgattctagttcttatactcaatcatacacatgacatctagtacactatccaagctttgactctaaaacactatccaagctttttcttgcttgtcaaagctttgttggtgttgccaaagtcagtatgagtctttggatttgtatcttcaaacaaggaaacactactttggcttttgggaaccagttgcgtttctagttcttatactcaatcatacacatgacaagtagtcgtatgtggcttcaaaacactaaccaagcttcttcttgcttttcaaagctttgatgctgaagctgtagtccgtatgagtctttggtttgtatcatgtaacaaggaaatatacttaggttttcaagaactagttgcggttctagttcttatacgcaatcatacacatgacatctagttgtatttgaatcctaaacactaaggtggtgttattcaattatggagttaaagtcaattcttaaagctttagacttgttttctgatattgcttttaagaatatgtttgtatgaattttaaaatctctgcaatatgtcttggattttgattctagtgatttactcatgaaactccaaagaggtttcatttcaaatgaattaatatacaaagattttacaagtcttttagtttttaataacgctggattttaatgaaatatttaaaatcttaattgaataacatcaaactttaaaatctattaagcatgatttacaaagatgagttccaataacactaaattttaaagttggatatagaatcattagttgaataacagtggattcggcttggatttcaattctattaaaatccattaacgaataacaccccctaaacaagcttcttctagcttctcaaagttttgatggtgtagccgaagtccgtatgagtctttggctttgtatcttctaataaggaaacactattttagcttttgggaaccggttgcggttatagttcttatactcaatcatacacatgacatatagtcatatttgaatccaaaacacttaccaaatttcttattgcttctcaaagttttgatggtgtagccgaaattcgtatgagtctctagctttgtatcttctaacaaggaaacactactttagcttttggcaaccggttgcggttctagttcttatactcaatcatacacatgacatctagtcatatttgactccaaaaaaataaccaagcttcttattgcttctcaaaacattaatggcttagccaaagtccgtatgagtttttagctttgtatcttctaacaaggaaacattaatttagcttttgggaattagttgcggttctagttcttatactcaatcatacacatgacatctagccatatttgattccgaaaaactaaccaagcttcttattgcctcacaaagctttgatggtgtagccgaagtcggtatgagtctttggctttgtatctacaaacaagaaacattactttagcttttgggaatcggttgcggttctagttcttatactcaatgatacacatgatatcctgtaatatttcactctaaaatactaaccaagcttcttattgcttctcaaaattttgatggtgtacacgaagtccgtatgagtctttggctttgtatcttctaacaaggaaacataactttagctattgggaatcggttgccattctagttcttatactcaatcatacacatgacatctagtcatatttgactccaaaacactaaccaagcttcttcttgcttctcaaaattttcatggtgtagccgaagtccgtatgagtctttggctttgtatcttctaacaaggaaacactacttttgcttttgggaaccagttgcggttctagtttttatactcaatactacacatgacatatagtcttttttgactccaaaacactaaccaaacttcttgttgcttcttaaagctttgatggtgtagccaaagtctgtatgaatttttggctttgtatcttctagaagggaaacacaactttagcttttgggaatcagttgtggttctagttcttatacttaatcaaacacataacatctagtcatatttgactccaaaaaactaacgaagcttcttattgcctcacaaagttttgatggtgtagccgaagtccgtatgagtctttgactttgtatcttcaaacaaggaaatattactttaggttttgggaaacggttgcggttctagttcttatactcaatcatacacatgacatctagtcatatttgactccaaaaaaaataaccaagcttcttattgcttctcaaaacattaatggcttagccggagtccgtatgagtttttagctttgtatcttctaacaaggaaacattaatttagcttttcggaattagttgcggttctagttcttatactcaatcatacacatgacatctagccatatttgattccgaaaaactaaccaagcttcttattgcctcacaaagctttgatggtgtcgccgaagtcggtatgagtctttggatttgtatctacaaacaagaaacattactttagcttttgggaatcggttgcggttctagttcttatactcaatgatacacatgatatcctataatatttcactctaaaatactaaccaagcttcttattgcttctcaaaattttgatggtgtacacgaagtccgtatgagtctttggctttgtatcttctaacaaggaaacataactttagctattgggaatcggttgccattctagttcttattctcaatcatacacatgacatctagtcatatttgactccaaaacactaaccaagcttcttatcgcttctcaaaattttcatggtgtagccgaagtccgtatgagtctttggctttgtatcttctaacaaggaaacactacttttgcttttgggaaccagttgcggttctagtttttatactcaatactacacatgagatatagtctttttttactccaaaacactaaccaaacttcttgttgcttcttaaagctttgatggtgtagccaaagtccgtatgagtttttggctttgtatcttctagaaaggaaacacaactttagcttttgggaagatgttgcggttctagttcttatactcaatcaaacacataacatcttgtcttattttactccaaaatactaaccaagcttcttattgcttctcaaaactttgatggtgtagccgaagtccgtatgagtctttggctttgtagcttctaacaaggaaacactactttagcttttgggaaacggttgcggttctagttcttatactcaatcatacacatgacatctagtcatatttgactccaaaacactaacaaggcttcttattgcttctcaaaattttgatggtgtacacgaagtccgtatgagtctttagctttgtatcttcaaacaaggaaacataactttagctattgggaatcggttgccattctagttcttatactcaatcatacacatgacatctagtcatatttgactccaaaacactaaccaagcttcttattgcttctcaaaattttcatggtgtagccgaagtccgtatgagtctttggctttgtatcttctaacaaggaaacataacttttgcttttgggaaccagttgcggttctagtttttatactcaatactacacatgacatatagtcttttttgactccaaaacactaaccaaacttcttgttgcttcttaaagctttgatggtgtagccaaagtccgtatgagtttttggctttgtatcttctagaagggaaacacaactttagcttttgggaagatgttgcggttctagttcttatactcaatcaaacacataacatcttgtcatatttgactccgaaaaactaacaaagcttcttattgcttctcaaagctttgatggtgtagctgaattccatatgattctttggctttgtaacttctaacaaggaaacactactttagcttttgggaaacggttgcggttctagttcttatactcaatcatacacatgacatctagtcatatttgactccaaaaaaataaccaagcttcttattgcttctcaaaacattaatggcttagccaaagtccgtatgagtttttagctttgtatcttctaacaaggaaacattaatttagcttttgggaattagttgcggttctagttcttatactcaatcatacacatgacatctagccatatttgattccgaaaaactaaccaagcttcttattgcctcacaaagctttgatggtgtagccgaagtcggtatgagtctttggctttgtatctacaaacaagaaacattactttagcttttgggaatcggttgcggttctagttcttatactcaatgatacacatgatatcctgtaatatttgactctaaaatactaaccaagcttcttattgcttctcaaaattttgatggtgtagccgaagtccgtatgagtctttggctttgtatcttctaacaaggaaacataactttagctattgggaatcggttgcggttctagtttttatactcaatactacacatgacatctagtcttttttgactccaaaacactaaccaaacttcttatcgcttctcaaaattttcatggtgtagccgaagtccgtatgagtctttagctttgtatcttctagaagggaaacacaactttagcttttgggaatcagttgtggttctagttcttatacttaatcaaacacataacatctagtcatatttgactccaaaaaactaacgaagcttcttattgcctcacaaagttttgatggtgtagccgaagtccgtatgagtctttgactttgtatcttcaaacaaggaaatattactttaggttttgggaaacggttgcggttctagttcttatactcaatcatacacatgacatctagtcatatttgactccaaaaaactaaccaagcttcttattacctcacaaagctttgatggtgtagccgatgtccgtatgagcctttggttttgtatcttcaaacaaggaaacattactttagcttttgggaattggttacggttctagttcttatactcaatgatacacatgacatcctgtaatatttgactctaaaatactaaccaagcttcttattgcttctcaaaattttgatggtgtatccgaagtccgtatgagtctttggctttgtatcttctaacaaggaaacataactttagctattggcaatcggttgccgttctagttcttatactcaatcatacacatgacatctagtcatatttgactccaaaacactaaccaagcttcttattgcttctcaaaattttcatggtgtacccaaagtctgtttgagtctttggctttgtatgttctaacaaggaaacactacttttgcttttgggaactggttgcggttctagttcttatactcaatactacacatgacatatacttttatttgactccaaaatactaaccaaacttcttgttgcttcttaaagctttgatggtgtagcagaagtctgtatgagtttttggctttttatcttcaagaagtgaaacactattttagcttttgggaagatgttgcggttctagttcttatgctcaatcaaacacataacatattgtcttatttgactccaaaatactaagcaagcttcttattgcttctcaaagctttgatggtgtagccgaagtccgtatgagtctttggctttgtatcttctaacaaggaaacactactttagcccttgggaaccagttgcggttttagttcttatactcaatcatccacattacatctagtcatatttgactccaaaaagctgacatagcttcttattgcttctcaaagctttgatggtgtagctgaagtccttatgattctctggctttgtatcttctaacaaggaaacactactttagcttttgggaaacggttgcggttctagttcttatactcaatcatacacatgacatctagtcatatttgactccaaaacattaaccaagcttcttattgcttctcagaacttggatggcttagccgaagtccgtatgagtttttagatttgtatcttctaacaaagaaacattactttagtttttaggaatcagttgcggttctagttcttatactcaatcgtacacatgacatctagtcatatttgactccgaaaaactaaccaagcttcctattgcgtcacaaagctttgatggtgtagccgaagtccgtatgagtctttggctttgtatctttgaacaaggaaacattactttagcttttgggaatcggttgcggttctaattcttatagtcaatgatacacataacatcctgtaatatttgactttaaaatactaaccaatcttcttattgcttctcaaaattttgatggtgtatccgaagtctgtatgagtttttggctttgtatcttctaatagggaaacataactttagcaattgggaatcggttgccgttctagttcttatactcaatcatacacatgacatctagtcatatttgattccaaaacactaaccaagcttcttattgcttctcaaaactttcatggtgtagccgaagtccgtatgagtctttggctttgtatcttctgacaaggaaacactacttttgcttttgggaaccggttgcggttctagttcttatactcaatactacacatgacatatagtcttatttgactccaaaatactaaccaaacttcttgttgcttcttaaagctttgatggtgtagcagaagtctgtatgagtttttggctttttatcttcaagaagtgaaacactattttagcttttgggaagatgttgcggttatagttcttatgctcaatcaaacacataacatattgtcttatttgactccagaatactaagcaagcttcttattgcttctcaaagctttgatggtgtagccgaagtctgtatgagtctttggctttgtatcttctaacactactttagcccttgggaaccagttgcggttttagttcttatactcaatcatccacatgacatctagtcatatttgactccaaaaagctgacatagcttcttattgcttctcaaagctttgatggtgtggctgaagtccatatgattcttttgctttgtatcttctaagaaggaaacactactttagcttttggaaaatgggttcgattctagttcttatactcaatcatacacatgacatctagtcatatttgactccaaaacactcaccaaacttcttattgcttctcaaagctttgatggtgtagctgaagtccttatgattctttggctttgtatcttctaacaaggaaacactactttagcttttgggaaacggttgcgattctagttcttatactcaatcatacacatgacatctagtcatatttgactccgaaaaactaaccaagcttcttatagcctcacaaagctttgatggtgtagccaaagtccgtatgagtctttggctttgtatcttccaacaaggaaacattactttagcttttgggaatcggttgaggttctatttcttatactcaatgatacatatgacatcctgtaatatttgactccaaaatactaaccaagcttcttattgcttctcaaaatgttgatggtgtatccgaagtccgtatgagtctttggctttgtatcttctaacaagaaaacataactttagctattgggaatcggttgccgttctaattcttatactcaatcatacacatgacatctagtcatatttgactccaaaaaactaaccaagcttcttattgccttacaaagctttgatggtgtagccgatgtccgtatgactctttggttttgtatcttcaaacaaggaaacattactttagcttttgggaattggttgcggttctagttcttatactcaatgatacacatgacatcctgtaatatttgactctaaaatactaaccaagcttcttattgcttctcaaaattttgatggtgtatccgaagtccgtatgagtttttggctttgtatcttctaacagggaaacataactttagctattgggaatcggttgccgttctagttcttatactcaatcatacacattacatctagtcatatttgattccaaaacactaaccaagcttcttattgcttctcaaaactttcatggtgtagccgaagtccgtatgagtctttggctttgtatcttttgacaaggaaacactacttttgcttttgggaaccggttgcggttctagttcttatactcaatactacacatgacatatagtcttatttgactccaaattactaaccaaacttcttgttgcttcttaaagctttgatggtgtagtagatgtctctatgagtttttggctttctatcctctagaagtgaaacactattttagcttttgggaagatgttgcggttctagttcttatgctcaatcaaacacataacatcttgtcttatttgactccaaaatactaagcaagcttcttattacttctcaaagctttgatggtgtagccgaagtccgtatgagtctttggctttgtatcttgtaacaaggaaacactactttagcctttggaaaccggttgcggttctagttcttatactcaatcatccacatgacatctagtcatatttgactccaaaaaactaaccaagcttcctattgcctcacaaagctttgattgtgtagccaaagtctgtatgagtctttggctttgttcttcaaacaaggaaacattactttagcttttgggaatcggttgcggttctagttcttatactcaatcatacacatgacatctagtcgtatttgactccaaaacactaaccaagcttcttattgcttctcaaaattttcatggtgtaggcgaagaccgtatgagcctttggctttgtttcttctaacaaggaaacactactttaccttttgggaaccagttgcggttctagttcttatactcaatactacacatgacatatagtctttttttgaatccaaaacactaaccaaacttcttgttgcttcttaaagctttgattgtgtacccaaagtccgtatgaggtttttgttttgtatcttctagaagggaaacattactttagcttttggaaaaatgttgcggttctagttcttatactcaatcaaacacataacatcttgtcttatttgactccaaaatactaaccaagcttcttattgcttctcaaaactttgatggtgtagccgaagtccgtatgagtctttggctttaaatcttctaacaaggaaacattactttagctttcgggaaccggttgcggttctagttcttatacttaatcatccacatgacatctagtcatatttgactccaaaaaactaacaaagcttcttattgcttctcaaagctttgatggtgtagctgaattccatatgattctttggctttgtaacttctaacaaggaaacactactttagcttttgggaaacgattgcggttctagttcttatactcaatcatacacatgacatttagtcatatttgactccaaaaaaataaccaaacttcttattgcttctcaaaacattattggcttagccgaagtccgtatgagtttttagctttgtatcttctaacaaggaaacattaatttagcttttgggaattagttgcggttctagttcttatactcaatcatacacatgacatctagccatatttgattccgaaaaactaaccaagcttcttattgcctcacaaagctttgatggtgtagccgaagtcggtatgagtctttggctttgtatctacaaacaagaaacattactttagcttttgggaatcggttgcggttctagttcttatactcaatgatacacatgatatcctgtaatatttcactctaaagtactaaccaagcttcttattgattctcaaaattttgatggtgtacacgaagtccgtatgagtctttggctttgtatcttctaacaaggaaacataactttagctattgggaatcggttgccattctagttcttatactcaatcatacacatgacatctagtcatatttgactccaaaacactaaccaagcttcttattgcttctcaaaattttcatggtgtagccgaagtccgtatgtgtctttggctttgtatcttctaacaaggaaacactaaatttgcttttgggaaccagttgcggttctagttttaatactcaatactacacatgacatatagtcttttttgactccaaaacactaacgaaacttcttgttgcttcttaaagctttgatggtgtagccaaagtccgtatgagtttttggctttgtatcttctagaagggaaacacaactttagcttttgggaagatgttgcggttctagttcttatactcaatcaaacacataacatcttgtcatatttgactccaaaaaactaacaaagcttcttattgcttctcaaagctttgatggtgtagctgaattccatatgattctttggctttgtaacttctaacaaggaaacactaccttagcttttgggaaacggttgcggttctagttcttatactcaatcatacacatgacatctagtcatatttgactccaaaaaaataaccaagcttcttattgcttctcaaaacattaatggcttagccgaagtccatatgagtttttagctttgtatcttctaacaaggaaacattaatttagcttttgggaattagttgcggttctagttcttatactcaatcatacacatgacatctagccatatttgattccgaaaaactaaccaagcttcttattgcctcacaaagctttgatggtgtagccgaagtcggtatgagtctttggctttgtatctacaaacaagaaacattactttagcttttgggaatcggttgcggttctacttcttatactcaatgatacacatgatatctagtcatatttgactccaaaacactaaccaagcttcttattgcttctcaaaattttcatggtgtagccgaagtccgtatgagtctttggctttgtatcttctaacaaggaaacactacttttgcttttgggaaccagttgcggttctaggttttatactcaatactacacatgacatatagtcttttttgactccaaaacactaaccaaacttcttgttgcttcttaaagctttgatggtgtagccaaagtccgtatgagtttttggctttgtatcttctagaagggaaacacaactttagcttttgggaagatgttgcggttatagttcttatactcaatcaaacacatatcatcttgtcttatttgactccaaaatactaaccaagcttcttattgcttctcaaaactttgatggtgtagccgaagtccgtatgagtctttggctttgtagcttctaacaaggaaacactactttagcttttgggaaacggttgcggttctagttcttatactcaatcatacacatgacatctagtcatatttgactccaaaacactaaccaagcttcttattgcttctcaaaattttgatggcttagccgaagtccgtatgagtttttagctttgtatcttctaacaaggaaacattaatttagcttttgggaattagttgcggttctagttcttatactcaatcatacacatgacatctagccatatttgattccgaaaaactaactaagcttcttattgcctcacaatgctttgatggtgtagccgaagtcggtatgagtctttggctttgtatctacaaacaagaaacattactttagcttttgggaatcggttgcggttctagttcttatactcaatgatacacatgatatcctgtaatatttgactctaaaatactaaccaagcttcttattgcttctcaaaattttgatggtgtacacgaagtccgtatgagtctttggctttgtatcttctaacaaggaaacataactttagctattgggaatcggttgccattctagttcttatattcaatcatacacatgacatctagtcatatttgactccaaaacacttaccaagcttcttactgcttctcaaaattttcatggtgtagccgaagtccgtatgagtctttggctttgtatcttctaacaaggaaacactacttttgcttttgggaaccagttgcggttctagtttttatactcaatactacacacgacatatagtcttttttgaccccaaaacactaacgaaacttcttgttgcttcttaaagctttgatggtgtagccaaagtccgtatgagtttttggctttgtatcttctagaagggaaacacaactttagcttttgggaaaatgttgcggttctagttcttatactcaatcaaacacataacatcttgtcttatttgactccaaaatactaaccaagcttcttatttcttctcaaaactttgatggtgtagccgaagtccgtatgagtctttgcctttgtatctgctaacaaggaaacactacttttgcttttgggaaccaattgcggttatagtttttatactcaatactacacatgacatatagtctttttttactccaaaacactaaccaagcttcttattgcttctcaaaactttgatggtgtagctgaagtccgtatgagtctttggctttgtagcttctaacaaagaaacactactttagcttttgggaaacggttgcggttctagttcttatactcaatcatacacatgacatctagtcatatttgactccaaaacactaaccaagcttcttattgcttctcaaaattttgatggcttagccgaagtccgtatgagtttttagctttgtatcttctaacaaggaaacattactttagcttttgggaatcagttgtggttaaagttcttatacttaatcatacacataacatcttgtcttatttgacaccaaaatactaaccaagctacttattgcttctcaaaactttgatggtgtagccaaagtccgtatgagtctttggctttgtatcttctaacaaggaaacactactttttcttttgggaaccagttgcggttctagtttttatactcaatactacacatgacatatagtcttttttgactccaaaacactaaccaaacttcttgttgcttcttaaagctttgatggtgtagccaaagtccgtatgagtttttggctttgtatcttctagaagggaaacacaactttagcttttgggaagatgttgcggttatagttcttatactcaatcaaacacatatcatcttgtcttatttgactccaaaatactaaccaagcttcttattgcttctcaaaactttgatggtgtagccgaagtccgtatgagtctttggctttgtagcttctaacaaggaaacactactttagcttttgggaaacggttgcggttctagttcttatactcaatcatacacatgacatctagtcatatttgactccaaaacactaaccaagcttcttattgcttctcaaaattttgatggcttagccgaagtccgtatgagtttttagctttgtatcttctaacaaggaaacattactttagcttttgggaatcagttatggttctagttcttatacttaatcatacacatgacatctagtcatatttgactccaaaaaactaacaaagcttcttattgcctcacaaagttttgatggtgtagccgaagtccgtatgagtctttgactttgtgtcttcaaacaaggaaacattactttagcttttgggaatcggttgcggttctagttcttatactcaatcatacacatgacatctagtcatatttgactccaaaaaaataaccaagcttcctattgcttctcaaaacattaatggcttagccgaagtccgtatgagtttttagctttgtatcttctaacaaggcaacattaatttagcttttgggaattagttacggttctagttcttatactcaatcatacacatgacatctagccatatttgattccgaaaaactaaccaggcttcttattgcctcacaaagctttgatggtgtagccgaagtcggtatgagtctttggctttgtatctacaaacaagaaacattactttagcttttgggaatcggttgcggttctagttcttatactcaatatacacatgatatcctgtaatatttgactctaaaatactaaccaagcttcttattgcttctcaaaattttgatggtgtacacgaagtccgtatgagtctttggctttgtatcttcaaacaaggaaacataactttagctattgggaatcggttgccattctagttcttatactcaatcatacacatgacatctagtcatatttgactccaaaacactaaccaagcttcttattgcttctcaaaattttcatggtgtagccgaagtccgtatgagtctttggctttgtatcttctaacaaggaaacactactttttcttttgggaaccagttgcggttctagtttttatactcaatactacacatgacatatagtcttttttgactccaaaacactaaccaaacttcttgttgcttcttaaagctttgatggtgtagccaaagtccgtatgagtttttggctttgtatcttctagaagggaaacacaactttagcttttgggaagatgttgcggttatagttcttatactcaatcaaacacataacatcttgtcttatttgactccaaaatactaaccaagcttcttattgcttctcaaaactttgatggtgtagccgaagtccgtatgagtctttggctttgtagcttctaacaaggaaacactactttagctttttggaaacggttgcggttctagttcttatactcaatcatacacatgacatctagtcatatttgactccaaaacactaaccaagcttcttattgcttctcaaaattttgatggcttagccgaagtccgtatgagtttttagctttgtatcttctaacaaggaaacattactttagcttttgggaatcagttatggttctagttcttatacttaatcatacacatgacatctagtcatatttgactccaaaaaactaacaaagcttcttattgcctcacaaagttttgatggtgtagccgaagtccgtatgagtctttgactttgtgtcttcaaacaaggaaacattactttagcttttgggaatcggttgcggttctagttcttatactcaatcatacacatgacatctagtcatatttgactccaaaaaaataaccaagcttcctattgcttctcaaaacattaatggcttagccgaagtccgtatgagtttttagctttgtatcttctaacaaggaaacattaatttagcttttgggaattagttgtggttctagttcttatactcaatcatacacatgacatctagccatatttgattccgaaaaactaaccaagcttcttattgcctcacaaagctttgatggtgtagccgaagtcggtatgagtctttggctttgtatctacaaacaagaaacattactttagcttttgggaatcggttgcggttctagttcttatactcaatatacacatgatatcctgtaatatttgactctaaaatactaaccaagcttcttattgcttctcaaaattttgatggtgtacacgaagtccgtatgagtctttggctttgtatcttcaaacaaggaaacataactttagctattgggaatcggttgccattctagttcttatactcaatcatacacatgacatctagtcatatttgactccaaaacactaaccaagcttcttattgcttctcaaaattttcatggtgtagccgaagtccgtatgagtctttggctttgtatcttctaacaaggaaacactactttttcttttgggaaccagttgcggttctagtttttatactcaatactacacatgacatatagtcttttttgactccaaaacactaaccaaacttcttgttgcttcttaaagctttgatggtgtagccaaagtccgtatgagtttttggctttgtatcttctagaagggaaacacaactttagcttttgggaagatgttgcggttatagttcttatactcaatcaaacacataacatcttgtcttatttgactccaaaatactaaccaagctacttattgcttctcaaaactttgatggtgtagccaaagtccgtatgagtctttggctttgtatcttctaacaaggaaacactacttttgcttttgggaaccagttgcggttctagtttttatactcaatactacccatgacatatagtcttttttgactccaaaacactaaccaaacttcttgttgcttcttaaagctttgatggtgtagccaaagtccgtatgagtttttggctttgtatcttctagaagggaaacacaactttagcttttgggaagatgttgcggttatagttcttatactcaatcaaacacatatcatcttgtcttatttgactccaaaatactaaccaagcttcttattgcttctcaaaactttgatggtgtagccgaagtccgtatgagtctttggctttgtagcttctaacaaggaaacactactttagcttttgggaaacggttgcggttctagttcttatactcaatcatacacatgacatctagtcatatttgactccaaaaaaataaccaagcttcctattgcttctcaaaacattaatggcttagccgaagtccgtatgagtctttagctttgtatcttctaacaaggaaacattaatttagcttttgggaattagttgcggttctagttcttatactcaatcatacacatgacatctagccatatttgattccgaaaaactaaccaagcttcttattgcctcacaaagctttgatggtgtagccgaagtcggtatgagtctttggctttgtatctacaaacaagaacattactttagcttttgggaatcggttgcggttctagttcttatactcaatgatacacatgatatcctgtaatatttcactctaaaatactaaccaagcttcttattgctactcaaaattttgacggtgtacacgaagtccgtatgagtctttggctttgtatcttctaacaaggaaacataactttagctattgggaatcggttgccatgctagttcttatactcaatcatacacatgacatctagtcatatttgactccaaaacactaaccaagcttcttattgcttctcaaaattttcatggtgttgccgaagtccgtatgtgtctttggctttgtatcttctaacaaggaaacactaaatttgcttttgggaaccagttgcggttctagtttttatactcaatactacacatgacatatagtctttttttactccaaaacactaacgaaacttcttgttgcttcttaaagctttgatggtgtagccaaagtccgtatgagtttttggctttgtatcttctagaagggaaacacaactttagcttttgggaagatgttgcggttctagttcttatactcaatcaaacccataacatctagtcatatttgactcccaaaaactaacgaagcttcttattgcctcacaaagttttgatggtgtagccgaagtccgtatgagtctttgactttgtatcttcaaacaaggaaacattactttagcttttgggaatcggttgcggttctagttcttatactcaatcatacacatgacatctagtcatatttgactccaaaaaaataaccaagcttcctattgcttctcaaaacattaatggcttagccgaagtccgtatgagtttttagctttgtatcttctaacaaggaaacattaatttagcttttgggaattagttgcggttctagttcttatactcaatcatacacatgacatctagccatatttgattccgaaaaactaaccaagcttcttattgcctcacaaagctttgatggtgtagccgaagtcggtatgagtctttggctttgtatctacaaacaagaaacattactttagcttttgggaatcggttgcggttctagttcttatactcaatgatacacatgatatcctgtaatatttgactctaaaatactaaccaagcttcttattgcttctcaaaattttgatggtgtacacgaagtccgtatgagtctttggctttgtatcttctaacaaggaaacataactttagctattgggaatcggttgccattctagttcttatactcaatcatacacatgacatctagtcatatttgactccaaaacactaaccaagcttcatattgcttctcaaaattttcatggtgtagccgaagtccgtatgagtctttggctttgtatcttctaacaaggaaacactacttttgcttttgggaaccagttgcggttctagtttttatactcaatactacacatgagatatagtcgttttttactccaaaacactaaccaaacttcttgttgcttcttaaagctttgatggtgtagccaaagtccgtatgagtttttggctttgtatcttctagaagggaaacacaactttagcttttgggaagatgttgcggttctagttcttatactcaatcaaacacataacatcttgtcttatttgactccaaaatactaaccaagcttcttattgcttctcaaaactttgatggtgtagccgaagtccgtatgagtctttggctttgtagcttctaacaaggaaacactactttagcttttgggaaacggttgcggttctagttcttatactcaatcatacacatgacatctagtcatatttgactccaaaacactaaccaagcttcttattgcttctcaaaattttgatggcttagccgaagtccgtatgagtttttagctttgtatcttctaacaaggaaacattactttagcttttgggaatcagttatggttctagttcttatacttaatcatacacatgacatctagtcatatttgactccaaaaaactaacgaagcttcttattgcctcacaaagttttgatggtgtagccgaagtccgtatgagtctttgactttgtatcttcaaacaaggaaatattactttaggttttgggaatcggttgcggttctagttcttatactcaatcatacacatgacatctagtcatatttgactccaaaaaaaataaccaagcttcttattgcttctcaaaacattaatggcttagccggagtccgtatgagtttttagctttgtatcttctaacaaggaaacattaatttagcttttgggaattagttgcggttctagttcttatactcaatcatacacatgacatctagccatatttgattccgaaaaactaaccaagcttcttattgcctcacaaagctttgatggtgtagccgaagtcggtatgagtctttggatttgtatctacaaacaagaaacattactttagcttttgggaatcggttgcggttctagttcttatactcaatgatacacatgatatcctgtaatatttcactctaaaatactaaccaagcttcttattgcttctcaaaattttgatggtgtacacgaagtccgtatgagtctttggctttgtatcttctaacaaggaaacataactttagctatagggaatcggttgccattctagttcttattctcaatcatacacatgacatctagtcatatttgactccaaaacactaaccaagcttcttattgcttctcaaaattttcatggtgtagccgaagtccgtatgagtctttggctttgtatcttctaacaaggaaacactacttttgcttttgggaaccagttgcggttctagtttttatactcaatactacacatgagatatagtcgttttttactccaaaacactaaccaaacttcttgttgcttcttaaagctttgatggtgtagccaaagtccgtatgagtttttggctttgtatcttctagaagggaaacacaactttagcttttgggaagatgttgcggttctagttcttatactcaatcaaacacataacatcttgtcttatttgactccaaaatactaaccaagcttcttattgcttctcaaaactttgatggtgtagccgaagtccgtatgagtctttggctttgtagcttctaacaaggaaacactactttagcttttgggaaacggttgcggttctagttcttatactcaatcatacacatgacatctagtcatatttgactccaaaacactaaccaagcttcatattgcttctcaaaattttcatggtgtagccgaagtccgtatgagtctttggctttgtatcttctaacaaggaaacactacttttgcttttgggaaccagttgcggttctagtttttatactcaatactacacatgacatatagtcttttttgactccaaaacactaaccaaacttcttgttgcttcttaaagctttgatggtgtagccaaagtccgtatgaatttttggctttgtatcttctagaagggaaacacaactttagcttttgggaagatgttgcggttatagttcttatactcaatcaaacacataacatcttgtcttatttgactccaaaatactaaccaagcttcttattgcttctcaaaactttgatggtgtagccgaaatccgtatgagtctttggctttgtagcttctaacaaggaaacactactttagcttttgggaaacggttgcggttctagttcttatactcaatcatacacatgacatctagtcatatttgactccaaaacactaaccaagcttcttattgcttctcaaaattttgatggcttagccgaagtccgtatgagtttttagcattgtatcttctaacaaggaaacattactttagcttttgggaatcagttatggttctagttcttatacttaatcatacacatgacatctagtcatatttgactccaaaaaactaacgaagcttcttattgcctcacaaagttttgatggtgtagccaaagtccgtatgagtctttgactttgtgtcttcaaacaaggaaacattactttagcttttgggaatcggttgcggttctagttcttatactcaatcatacacatgacatctagtcatatttgactccaaaaaaataaccaagcttcctattgcttctcaaaacattaatggcttagccgaagtccgtatgagtttttagctttgtatcttctaacaaggaaacattaatttagcttttgggaattagttacggttctagttcttatactcaatcatacacatgacatctagccatatttgattccgaaaaactaaccaagcttcttattgcctcacaaagctttgatggtgtagccgaagtcggtatgagtctttggctttgtatctacaaacaagaaacattactttagcttttgggaatcggttgcggttctagttcttatactcaatatacacatgatatcctgtaatatttgactctaaaatactaaccaagcttcttattgcttctcaaaattttgatggtgtacacgaagtccgtatgagtctttggctttgtatcttcaaacaaggaaacataactttagctattgggaatcggttgccattctagttcttatactcaatcatacacatgacatctagtcatatttgactccaaaacactaaccaagcttcttattgcttctcaaaattttcatggtgtagccgaagtccgtatgagtctttggctttgtatcttctaacaaggaaacactacttttgcttttgggaaccagttgcggttctagtttttatactcaatactacacatgacatatagtcttttttgactccaaaacactaacgaaacttcttgttgcttcttaaagctttgatggtgtagccaaagtccgtatgagtttttggctttgtatcttctagaagggaaacacaactttagcttttgggaagatgttgcggttctagttcttatactcaatcaaacacataacatcttgtcatatttgactccaaaaaactaacaaagcttcttattgcttctcaaagctttgatggtgtagctgaattccatatgattctttggctttgtaacttctaacaaggaaacactactttagcttttgggaaaaggttgcggttctagttgttatactcaatcatacacatgacatctagtcatatttgactccaaaaaaataaccaagcttcttattgcttctcaaaacattaatggcttagccaaagtccgtatgagtttttagctttgtatcttctaacaaggaaacattaatttagcttttgggaattagttgcggttctagttcttatactcaatcatacacatgacatctagccatatttgattccgaaaaactaaccaagcttcttattgcctcacaaagctttgatggtgtagccgaagtcggtatgagtctttggctttgtatctacaaacaagaaacattactttagcttttgggaatcggttgcggttctagttcttatactcaatgatacacatgatatcctgtaatatttgactctaaaatactaaccaagcttcttattgcttctcaaaattttgatggtgtacacgaagtccgtatgagtctttggctttgtatcttctaacaaggaaacataactttagctattgggaatcggttgccattctagttcttatactcaatcatacacatgacatctagtcatatttgactccaaaacactaaccaagcttcttattgcttctcaaaattttcatggtgtagccgaagtccgtatgagtctttggctttgtatcttctaacaaggaaacactacttttgcttttgggaaccagttgcggttctagtttttatactcaatactacacatgacatatagtcttttttgactccaaaacactaaccaaacttcttgttgcttcttaaagctttgatggtgtagccaaagtccgtatgagtttttggctttgtatcttctagaagggaaacacaactttagcttttgggaagatgttgcggttctagttcttatactcaatcaaacacataacatcttgtcttatttgactccaaaatactaaccaagcttcttattgcttctcaaaactttgatggtgtagccgaagtccgtatgagtctttggctttgtagcttctaacaaggaaacactactttagcttttgggaaacggttgcggttctagttcttatactcaatcatacacatgacatctagtcatatttgactccaaaacactaaccaagcttcttattgcttctcaaaattttgatggcttagccgaagtccgtatgagtttttagctttgtatcttctaacaaggaaacattactttagcttttgggaatcagttatggttctagttcttatacttaatcatacacatgacatctagtcatatttgactccaaaaaactaacgaagcttcttattgcctcacaaagttttgatggtgtagccgaagtccgtatgagtctttgactttgtgtcttcaaacaaggaaacattactttagcttttgggaatcggttgcggttctagttcttatactcaatcatacacatgacatctagtcatatttgactccaaaaaaataaccaagcttcctattgcttctcaaaacattaatggcttagccgaagtccgtatgagtttttagctttgtatcttctaacaaggcaacattaatttagcttttgggaattagttacggttctagttcttatactcaatcatacacatgacatctagccatatttgattccgaaaaactaaccaagcttcttattgcctcacaaagctttgatggtgtagccgaagtcggtatgagtctttggctttgtatctacaaacaagaaacattactttagcttttgggaatcggttgcggttctagttcttatactcaatatacacatgatatcctgtaatatttgactctaaaatactaaccaagcttcttattgcttctcaaaattttgatggtgtacacgaagtccgtatgagtctttggctttgtatcttcaaacaaggaaacataactttagctattgggaatcggttgccattctagttcttatactcaatcatacacatgacatctagtcatatttgactccaaaacactaaccaagcttcttattgcttctcaaaattttcatggtgtagccgaagtccgtatgagtctttggctttgtatcttctaacaaggaaacactactttttcttttgggaaccagttgcggttctagtttttatactcaatactacacatgagatatagtcgttttttactccaaaacactaaccaaacttcttgttgcttcttaaagctttgatggtgtagccaaagtccgtatgagtttttggctttgtatcttctagaagggaaacacaactttagcttttgggaagatgttgcggttctagttcttatactcaatcaaacacataacatcttgtcttatttgactccaaaatactaaccaagcttcttattgcttctcaaaactttgatggtgtagccgaagtccgtatgagtctttggctttgtagcttctaacaaggaaacactactttagcttttgggaaacggttgcggttctagttcttatactcaatcatacacatgacatctagtcatatttgactccaaaacactaaccaagcttcttattgcttctcaaaattttgatggcttagccgaagtccgtatgagtttttagctttgtatcttctaacaaggaaacattactttagcttttgggaatcagttatggttctagttcttatacttaatcatacacatgacatctagtcgtatttgactccaaaaaactaacgaagcttcttattgcctcacaaagttttgatggtgtagccgaagtccgtatgagtctttgactttgtgtcttcaaacaaggaaacattactttagcttttgggaatcggttgcggttctagttcttatacttaatcatacacatgacatctagtcatatttgactccaaaaaaataactaagcttcctattgcttctcaaaacattaatggcttagccgaagtccgtatgagtttttagctttgtatcttctaacaaggaaacattaatttagcttttgggaattagttgcggttctagttcttatactcaatcatacacatgacatctagccatatttgattccgaaaaactaaccaagcttcttattgcctcacaaagctttgatggtgtagccgaagtcggtatgagtctttggatttgtatctacaaacaagaaacattactttagcttttgggaatcggttgcggttctagttcttatactcaatgatacacatgatatcctgtaatatttcactctaaaatactaaccaagcttcttattgcttctcaaaattttgatggtgtacacgaagtccgtatgagtctttggctttgtatcttctaacaaggaaacataactttagctattgggaatcggttgccattctagttcttattctcaatcatacacatgacatctagtcatatttgactccaaaacactaaccaagcttcttattgcttctcaaaattttcatggtgtagccgaagtccgtatgagtctttggctttgtatcttctaacaaggaaacactacttttgcttttgggaaccagttgcggttctagtttttatactcaatactacacatgagatatagtctttttttactccaaaacactaaccaaacttcttgttgcttcttaaagctttgatggtgtagccaaagtccgtatgagtttttggctttgtatcttctagaagggaaacacaactttagcttttgggaagatgttgcggttctagttcttatactcaatcaaacacataacatcttgtcttattttactccaaaatactaaccaagcttcttattgcttctcaaaactttgatggtgtagccgaagtccgtatgagtctttggctttgtagcttctaacaaggaaacactactttagcttttgggaaacggttgcggttctagttcttatactcaatcatacacatgacatctagtcatatttgactccaaaacactaacaaggcttcttattgcttctcaaaattttgatggtgtacacgaagtccgtatgagtctttagctttgtatcttcaaacaaggaaacataactttagctattgggaatcggttgccattctagttcttatactcaatcatacacatgacatctagtcatatttgactccaaaacactaaccaagcttcttattgcttctcaaaattttcatggtgtagccgaagtccgtatgagtctttggctttgtatcttctaacaaggaaacataacttttgcttttgggaaccagttgcggttctagtttttatactcaatactacacatgacatatagtgttttttgactccaaaacactaaccaaacttcttgttgcttcttaaagctttgatggtgtagccaaagtccgtacgagtttttggctttgtatcttctagaagggaaacacaatcaaacacataacatcttgtcatatttgactccaaaaaactaacaaagcttcttattgcttctcaaagctttgatggtgtagctgaattccatatgattctttggctttgtaacttctaacaaggaaacactactttagcttttgggaaacggttgcggttctagttgttatactcaatcatacacatgacatctagtcatatttgactccaaaaaaataaccaagcttcttattgcttctcaaaacattaatggcttagccaaagtccgtatgagtttttagctttgtatcttctaacaaggaaacattaatttagcttttgggaattagttgcggttctagttcttatactcaatcatacacatgacatctagccatatttgattccgaaaaactaaccaagcttcttattgcctcacaaagctttgatggtgtagccgaagtcggtatgagtctttggctttgtatctacaaacaagaaacattactttagcttttgggaatcggttgcggttctagttcttatactcaatgatacacatgatatcctgtaatatttgactctaaaatactaaccaagcttcttattgcttctcaaaattttgatggtgtacacgaagtccgtattagtctttggctttgtatcttctaacaaggaaacataactttagctattgggaatcggttgccattctagttcttatactcaatcatacacatgacatctagtcatatttgactccaaaacactaaccaagcttcttattgcttctcaaaattttcatggtgtagccgaagtccgtatgagtctttggctttgtatcttctaacaaggaaacactacttttgcttttgggaaccagttgcggttctagtttttatactcaatactacacatgacatatagtcttttttgactccaaaacactaaccaaacttcttgttgcttcttaaagctttgatggtgtagccaaagtccgtatgagtttttggctttgtatcttctagaagggaaacacaactttagcttttgggaagatgttgcggttctagttcttatactcaatcaaacacataacatcttgtcttatttgactccaaaatactaaccaagcttctaattgcttctcaaaactttgatggtgtagccgaagtccgtatgagtctttggctttgtagcttctaacaaggaaacactactttagcttttgggaaatggttgcggttctagttcttatactcaatcatacacatgacatctagtcatatttgactctaaaacactaaccaagcttcttattgcttctcaaaattttgatggcttagccgaagtccgtatgagtttttagctttgtatcttctaacaaggaaacattactttagcttttgggaatcagttgtggttctagttcttatacttaatcatacacatgacatctagtcatatttgactccaaaaaactaacgaagcttcttattgcctcacaaagttttgatggtgtagccgaagtccgtatgagtctttgactttgtatcttcaaacaaggaaatattactttaggttttgggaatcggttgcggttctagttcttatactcaatcatacacatgacatctagtcatatttgactccaaaaaaaataaccaagcttcttattgcttctcaaaacattaatggcttagccggagtccgtatgagtttttagctttgtatcttctaacaaggaaacattaatttagcttttcggaattagttgcggttctagttcttatactcaatcatacacatgacatctagccatatttgattccgaaaaactaaccaagcttcttattgcctcacaaagctttgatggtgtagccgaagtcggtatgagtctttggatttgtatctacaaacaagaaacattactttagcttttgggaatcggttgcggttctagttcttatactcaatgatacacatgatatcctgtaatatttcactctaaaatactaaccaagcttcttattgcttctcaaaattttgatggtgtacacgaagtccgtatgagtctttggctttgtagcttctaacaaggaaacactactttagcttttgggaaacggttgcggttctagttcttatactcaatcatacacatgacatctagtcatatttgactccaaaacactaaccaagcttcttattgcttctcaaaattttcatggtgtagccgaagtccgtatgagtctttggctttgtatcttctaacaaggaaacataacttttgcttttgggaaccagttgcggttctagtttttatactcaatactacacatgacatatagtcttttttgacttcaaaacactaaccaaacttcttgttgcttcttaaatctttgatggtgtagccaaagtccgtatgagtttttggctttgtatcttctagaagggaaacacaactttagcttttcggaagatgttgcggttctagttcttatactcaatcaaacacataacatcttgtcttatttgactccaaaatactaaccaagcttattattgcttctcaaaactttgatggtgtagccgaagtctgtatgagtctttggctttgtagcttctaacaaggaaacactactttagctttcgggaaacggttgcggttctagttcttatactcaatcatacacatgacatctagtcatatttgactccaaaacactaaccaagcttcttattgcttctcaaaattttgatggcttagccgaagtccgtatgagtttttagctttgtatcttccaacaaggaaacattactttagcttttgggaatcagttgtggttctagttcttatacttaatcatacacatgacatctagtcatatttgactctaaaaataacgaagcttcttattgcctcacaaagttttgatggtgtagccgaagtccgtatgagtctttgactttgtatcttcaaacaaggaaacattactttagcttttgggaatcggttgcggttctacttcttatactcaatcatacacatgacatcagtcatatttgactccaaaaaaataaccaagcttcctattgcttctcaaaacatgaatggcttagccgaagtccgtatgagtttttagctttgtatcttctaacaaagaaacattaatatagcttttgggaattagttgcggttctagttcttatactcaatcatacacatgacatctagtcatatttgactccaaaacactaaccaagcttcttattgcttctcaaaattttcatggtgtagccgaagtccgtatgagtctttgcctttgtatcttctaacaaggaaacactacttttgcttttgggatccagttgtggttctagtttttatactcaatactacacatgacatataatcttttttgactccaaaacactaaccaaacttcttgttgcttcttaaagctttgatggtgtagccaaagtccgtatgagtttttggctttgtatcttctagaagggaaacacaactttagcttttgggaagatgttgcggttctagttcttatactcaatcaaacacataacatcttgtcttatttgactccaaaatactaaccaagcttcttattgcttcttaaaactttgatggtgtagccgaagtctgtatgagtctttggctttgtagcttctaacaaggaaacactactttagcttttgggaaacggttgcggttctagttcttatactcaatcatacacatgacatctagtcatatttgactccaaaacactaaccaaacttcttattgcttctcaaaattttgatggcttagccgaagtccgtatgagtttttagctttgtatcttctaacaaggaaacattactttagcttttgggaatcagttgtggttaaagttcttatacttaatcatacacataacatcttgtcttatttgacaccaaaatactaaccaagctacttattgcttctcaaaactttgatggtgtagccaaagtccgtatgagtctttggctttgtatcttctaactaggaaacattactttagcttttgggaaccagttgcagttctagttcttatactcaatcatccacatgacctctagtcatatgtgactccaaaaccataacaaagcttttcttattgttcctcaaagctttgatggtgtagctgaagtccatatgattcttttgctttgtatgttctaacaaggaaacactactttagcttttgggaaacggttgcggttctaattcttatactcaatcatacacatgacatcagtcatatttgactccaaaaaaataaccaagcttcctattgcttctcaaaacatgaatggcttagccgaagtccgtatgagtttttagctttgtatcttctaacaaggaaacattaatttagcttttgggaattagttgcggttctagttcttatactcaatcatacacatgacatctagccatatttgattccgaaaaactaaccaagcttcttattgcctcacaaagctttgatggtgtagccgaagtcggtatgagtctttggctttgtatcttcaaacaagaaacattactttagcttttgggaatcggttgcggttctagttcttatactcaatgatacacatgatatcctgtaatatttgactctaaaatactaaccaagcttcttattgcttctcaaaattttgatggtgtacacgaagtccgtatgattctttggctttgtatcttctaacagggaaacataactttagctattgggaatcggttgccattctagttcttatactcaatcatacacatgacatctagtcatatttgactccaaaacactaaccaagcttcttattgcttctcaaaattttcatggtgtagccgaagtccgtatgagtctttgcctttgtatcttctaacaaggaaacactacttttgcttttgggatccagttgtggttctagtttttatactcaatactacacatgacatataatcttttttgactccaaaacactaaccaaacttcttgttgcttcttaaagctttgatggtgtagccaaagtccgtatgagtttttggctttgtatcttctagaagggaaacacaactttagcttttgggaagatgttgcggttctagttcttatactcaatcaaacacataacatcttgtcttatttgactccaaaatactaaccaagcttcttattgcttctcaaaactttgatggtgtagccgaagtctgtatgagtctttggctttgtagcttctaacaaggaaacactactttagcttttgggaaacggttgcggttctagttcttatactcaatcatacacatgacatctagtcatatttgactccaaaacactaaccaaacttcttattgcttctcaaaattttgatggcttagccgaagtccgtatgagtttttagctttgtatcttctaacaaggaaacattactttagcttttgggaatcagttgtggttaaagttcttatacttaatcatacacataacatcttgtcttatttgacaccaaaatactaaccaagctacttattgcttctcaaaactttgatggtgtagccaaagtccgtatgagtctttggctttgtatcttctaactaggaaacattactttagcttttgggaaccagttgcagttctagttcttatactcaatcatccacatgacctctagtcatatgtgactccaaaaccataacaaagcttttcttattgttcctcaaagctttgatggtgtagctgaagtccatatgattcttttgctttgtatgttctaacaaggaaacactactttagcttttgggaaacggttgcggttctaattcttatactcaatcatacacatgacatcagtcatatttgactccaaaaaaataaccaagcttcctattgcttctcaaaacatgaatggcttagccgaagtccgtatgagtttttagctttgtatcttctaacaaggaaacattaatttagcttttgggaattagttgcggttctagttcttatactcaatcatacacatgacatctagccatatttgattccgaaaaactaaccaagcttcttattgcctcacaaagctttgatggtgtagccgaagtcggtatgagtctttggctttgtatctacaaacaagaaacattactttagcttttgggaatcggttgcggtcctagttcttatactcaatgatacacatgatatcctgtaatatttgactctaaaatactaaccaagcttcttattgcttctcaaaattttgatggtgtacacgaagtccgtatgagtctttagctttgtatcttcaaacaaggaaacataactttagctattgggaatcggttgccattctagttcttatactcaatcatacacatgacatctagtcatatttgactccaaaacactaaccaagcttcttattgcttctcaaaattttcatggtgtagccgaagtccgtatgagtctttgcctttgtatcttctaacaaggaaacactacttttgcttttgggatccagttgtggttctagtttttatactcaatactacacatgacatataatcttttttgactccaaaacactaaccaaacttcttgttgcttcttaaagctttgatggtgtagccaaagtccgtatgagtttttggctttgtatcttctagaagggaaacacaactttagcttttgggaagatgttgcggttctagttcttatactcaatcaaacacataacatcttgtcttatttgactccaaaatactaaccaagcttcttattgcttctcaaaactttgatggtgtagccgaagtctgtatgagtctttggctttgtagcttctaacaaggaaacactactttagcttttgggaaacggttgcggttctagttcttatactcaatcatacacatgacatctagtcatatttgactccaaaacactaaccaaacttcttattgcttctcaaaattttgatggcttagccgaagtccgtatgagtttttagctttgtatcttctaacaaggaaacattactttagcttttgggaatcagttgtggttaaagttcttatacttaatcatacacatgacatctagtcttatttgacaccaaaatactaaccaagctacttattgcttctcaaaactttgatggtgtagccaaagtccgtatgagtctttggctttgtatcttctaactaggaaacattactttagcttttgggaaccagttgcagttctagttcttatactcaatcatccacatgacctctagtcatatgtgactccaaaaccataacaaagcttttcttattgttcctcaaagctttgatggtgtagctgaagtccatatgattcttttgctttgtatgttctaacaaggaaacactactttagcttttgggaaacggttgcggttctagttcttatactcaatcatacacatgacatcagtcatatttgactccaaaaaaataaccaagcttcctattgcttctcaaaacatgaatggcttagccgaagtccgtatgagtttttagctttgtatcttctaacaaggaaacattaatttagcttttgggaattagttgcggttctagttcttatactcaatcatacacatgacatctagccatatttgattccgaaaaactaaccaagcttcttattgcctcacaaagctttgatggtgtagccaaagtcggtatgagtctttggctttgtatctacaaacaagaaacattactttagcttttgggaatcggttgcggtcctagttcttatactcaatgatacacatgatatcctgtaatatttgactctaaaatactaaccaagcttcttattgcttctcaaaattttgatggtgtacacgaagtccgtatgagtctttagctttgtatcttcaaacaaggaaacataactttagctattgggaatcggttgccattctagttcttatactcaatcatacacatgacatctagtcatatttgactccaaaacactaaccaagcttcttattgcttctcaaaattttcatggtgtagccgaagtccgtatgagtctttggctttgtatcttctaacaaggaaacactacttttgcttttgggatccagttgtggttctagtttttatactcaatactacacatgacatataatcttttttgactccaaaacactaaccaaacttcttgttgcttcttaaagctttgatggtgtagccaaagtccgtatgagtttttggctttgtatcttctagaagggaaacacaactttagcttttcggaagatgttgcggttctagttcttatactcaatcaaacacataacatcttgtcttatttgactccaaaatactaaccaagcttattattgcttctcaaaactttgatggtgtagccgaagtctgtatgagtctttggctttgtagcttctaacaaggaaacactactttagctttcgggaaacggttgcggttctagttcttatactcaatcatacacatgacatctagtcatatttgactccaaaacactaaccaaacttcttattgcttctcaaaattttgatggcttagccgaagtccgtatgagtttttagctttgtatcttctaacaaggaaacattactttagcttttgggaatcagttgtggttaaagttcttatacttaatcatacacatgacatctagtcttatttgacaccaaaatactaaccaagctacttattgcttctcaaaactttgatggtgtagccaaagtccgtatgagtctttggctttgtatcttctaactaggaaacattactttagcttttgggaaccagttgcagttctagttcttatactcaatcatccacatgacctctagtcatatgtgactccaaaaccataacaaagcttttcttattgttcctcaaagctttgatggtgtagctgaagtccatatgattcttttgctttgtatgttctaacaaggaaacactactttagcttttgggaaacggttgcggttctagttcttatactcaatcatacacatgacatcagtcatatttgactccaaaaaaataaccaagcttcctattgcttctcaaaacatgaatggcttagccgaagtccgtatgagtttttagctttgtatcttctaacaaggaaacattaatttagcttttgggaattagttgcggttctagttcttatactcaatcatacacatgacatctagccatatttgattccgaaaaactaaccaagcttcttattgcctcacaaagctttgatggtgtagccgaagtcggtatgagtctttggctttgtatcttcaaacaagaaacattactttagcttttgggaatcggttgcggttctagttcttatactcaatgatacacatgatatcctgtaaaatttgactctaaaatactaaccaagcttcttattgcctctcaaaattttgatggtgtacacgaagtccgtatgattctttggctttgtatcttctaacagggaaacataactttagctattgggaatcggttgccattctagttcttatactcaatcatacacatgacatctagtcatatttgactccaaaacactaaccaagcttcttattgcttctcaaaattttcatggtgtagccgaagtccgtatgagtctttgcctttgtatcttctaacaaggaaacactacttttgcttttgggatccagttgtggttctagtttttatactcaatactacacatgacatataatcttttttgactccaaaacactaaccaaacttcttgttgcttcttaaagctttgatggtgtagccaaagtccgtatgagtttttggctttgtatcttctagaagggaaacacaactttagcttttgggaagatgttgcggttctagttcttatactcaatcaaacacataacatcttgtcttatttgactccaaaatactaaccaagcttcttattgcttctcaaaactttgatggtgtagccgaagtctgtatgagtgtttggctttgtagcttctaacaaggaaacactactttagcttttgggaaacggttgcggttctagttcttatactcaatcatacacatgacatctagtcatatttgactccaaaacactaaccaaacttcttattgcttctcaaaattttgatggcttagccgaagtccgtatgagtttttagctttgtatcttctaacaaggaaacattactttagcttttgggaatcagttgtggttaaagttcttatacttaatcatacacataacatcttgtcttatttgacaccaaaatactaaccaagctacttattgcttctcaaaactttgatggtgtagccaaagtccgtatgagtctttggctttgtatcttctaactaggaaacattactttagcttttgggaaccagttgcagttctagttcttatactcaatcatccacatgacctctagtcatatgtgactccaaaaccataacaaagcttttcttattgttcctcaaagctttgatggtgtagctgaagtccatatgattcttttgctttgtatgttctaacaaggaaacactactttagcttttgggaaacggttgcggttctagttcttatactcaatcatacacatgacatcaatcatatttgactccaaaaaaataaccaagcttcctattgcttctcaaaacatgaatggcttagccgaagtccgtatgagtttttagctttgtatcttctaacaaggaaacattaatttagcttttgggaattagttgcggttctagttcttatactcaatcatacacatgacatctagccatatttgattccgaaaaactaaccaagcttcttattgcctcacaaagctttgatggtgtagccgaagtcggtatgagtctttggctttgtatctacaaacaagaaacattactttagcttttgggaatcggttgcggtcctagttcttatactcaatgatacacatgatatcctgtaatatttgactctaaaatactaaccaagcttcttattgcttctcaaaattttgatggtgtacacgaagtccgtatgagtctttagcttggtatcttcaaacaaggaaacataactttagctattgggaatcggttgccattctagttcttatactcaatcatacacatgacatctagtcatatttgactccaaaacactaaccaagcttcttattgcttctcaaaattttcatggtgtagccgaagtccgtatgagtctttggctttgtatcttctaacaaggaaacataacttttgcttttgggaaccagttgcggttctagtttttatactcaatactacacatgacatatagtcttttttgactccaaaacactaaccaaacttcttgttgcttcttaaagctttgatggtgtagccaaagtccgtatgagtttttggctttgtatcttctagaagggaaacacaactttagcttttgggaagatgttgcggttctagttcttatactcaatcaaacacataacatcttgtcttatttgactccaaatactaaccaagcttattattgcttctcaaaactttgatggtgtagccgaagtccgtatgagtctttggctttgtagcttctaacaaggaaacactactttagctttcgggaaacggttgcagttctagttcttatactcaatcatacacatgacatctagtcatatttgactccaaaacactaaccaagcttcttattgcctcacaaagttttgatggtgtagccgaagtccgtatgagtctttggctttgtatctactaacaaggaaacactactttaggttttgggaatcggttgcggttctagttcttatactcaatcatacacatgacatctagtcatatttgactccaaaaaaataaccaagcttcttattgcttctcaaaacattaatggcttagccgaagtccgtatgagtttttagctttgtatcttctaacaaggaaacattaatttagcttttgggaattagttgcggttctagttcttatactcaatcatacacatgacatctagccatatttgattccgaaaaactaaccaagcttcttattgcctcacaaagctttgatggtgtagccgaagtcggtatgagtctttggctttgtatctacaaacaagaacattactttagcttttgggaatcggttgcggttctagttcttatactcaatgatgcacatgatatcctgtaatatttcactctaaaatactaaccaagcttcttattgctactcataattttgatggtgtacacgaagtccgtatgagtctttggctttgtatcttctaacaaggaaacataactttagctattgggaatcggttgccatgctagttcttatactcaatcatacacatgacatctagtcatatttgactccaaaacactaaccaagcttcttattgcttctcaaaattttcatggtgttgccgaagtccgtatgtgtctttggctttgtatcttctaacaaggaaacactaaatttgcttttgggaaccagttgcggttctagtttttatactcaatactacacaggacatatagtctttttttactccaaaacactaacgaaacttcttgttgcttcttaaagctttgatggtgtagccaaagtccgtatgagtttttggctttgtatcttctagaagggaaacacaactttagcttttgggaagatgttgcggttctagttcttatactcaatcaaacacataacatctagtcatatttgactcccaaaaactaacgacgcttcttattgcctcacaaagttttgatggtgtagccgaagtccgtatgagtctttgactttgtatcttcaaacaaggaaacattactttagcttttgggaatcggttgcggttctagttcttatactcaatcatacacatgacatctagtcatatttgactccaaaaaaataaccaagcttcttattgcttctcaaaacattaatggcttagccgaagtccgtatgagtttttagctttgtatcttctaacaaggaaacattaatatagcttttgggaattagttgcggttctagttcttatactcaatcatacacatgacatctagccatatttgattctgaaaaactaaccaagcttcttattgcctcacaaagctttgatggtgtagctgaagtcggtatgagtctttggctttgtatctacaaacaagaaacattactttagcttttgggaatcggttgcggttctagttcttatactcaatgatacacatgatatcctgtaatatttgaccctaaaatactaaccaagcttcttattgcttctcaaaattttgatggtgtacacgaagtccgtatgagtctttggctttgtatcttctaacaaggaaacataactttagctattgggaatcggttgcaattctagttcttatactcaatcatacacatgacatctagtcatatttgactccaaaacactaaccaagcttcttattgcttctcaaaattttcatggtgcagccgaagtccgtatgagtctttggctttgtatcttctaacaaggaaacactacttttgcttttgggaacaagttgcggttctagtttttatactcaatacaacacatgacatatagtcttttttgactccaaaacactaaccaaacttcttgttgcttcttaaagctttgatggtgtagccaaagtccgtatgagtttttggctttgtatcttctataagggaaacacaactttagcttttgagaagctgttgcggttctagttcttatactcaatcaaacacataacatcttgtgttatttgactccaaaatactaaccaagcttcttattgcttcttaaaactttgatggtgtagccgaagtccgtatgagtctttggctttgtagcttctaacaaggaaacactactttagcttttgggaaacggttgcggttctagttcttatactcaatcatacacatgacatctagtcatatttgactccaaaacactaaccaagcttcttattgcttctcaaaattttgatggcttagccgaagtccgtatgagtttttagctttctatcttctaacaaggaaacattactttagcttttgggaatcagttatggttctagttcttatacttaatcatacacatgacatctagtcatatttgactccaaaaaactaacgaagcttcttattgcctcacaaagttttgatggtgtagccgaagtccgtatgagtctttgactttgtatcttcaaacaaggaaatattactttaggttttgggaatcggtcgcggttctagttcttatactcaatcatacacatgacatctagtcatatttgactccaaaaaaaataaccaagcttcttattgcttctcaaaacattaatgtcttagccggagtccgtatgagtttttagctttgtatcttctaacaaggaaacattaatttagcttttcggaattagttgcggttctagttcttatactcaatcatacacatgacatctagccatatttgattccgaaaaactaaccaagcttcttattgcctcacaaagctttgatggtgtagccgaagtcggtatgagtctttggatttgtatctacaaacaagaaacattactttagcttttgggaatcggttgcggttctagttcttatactcaatgatacacatgatatcctgtaatatttgaccctaaaatactaaccaagcttcttattgcttctcaaaattttgatggtgtacacgaagtccgtatgagtctttggctttgtatcttctaacaaggaaacataactttagctattgggaacggttgccattctagttcttattctcaatcatacacatgacatctagtcatatttgactccaaaacactaaccaagcttcttattgcttctcaaaattttcatggtgtagccgaagtccgtatgagtctttggctttgtatcttctaacaaggaaacactacttttgcttttgggaaccagttgcggttctagtttttatactcaatactacacatgagatatagtctttttttactccaaaacactaaccaaacttcttgttgcttcttaaagctttgatggtgtagccaaagtccgtatgagtttttggctttgtatcttctagaagggaaacacaactttagcttttgggaagatgttgcggttctagttcttatactcaatcaaacacataacatcttgtcttatttgactccaaaatactaaccaagcttcttattgcttctcaaaactttgatggtgtagccgaagtccgtatgagtctttggctttgtagcttctaacaaggaaacactactttagcttttgggaaacggttgcggttctagttcttatactcaatcatacacatgacatctagtcatatttgactccaaaacactaaccaagcttcttattgcttctcaaaattttgatggcttagccgaagtccgtatgagtttttagctttgtatcttctaacaaggaaacattactttagcttttgggaatcagttgtggttctagttcttatacttaatcatacacatgacatctagtcatatttgactccaaaaaactaacgaagcttcttattgcctcacaaagttttgatggtgtagccgaagtccgtatgagtctttgactttgtatcttcaaacaaggaaacattactttagcttttgggaatcggttgcggttctagttcttatactcaatcatacacatgacatctagtcatatttgactccaaaaaaataaccaagcttcttattgcttctcaaaacattaatggcttagccgaagtccgtatgagtttttagctttgtatcttctaacaaggaaacattaatttagcttttgggaattagttgcggttctagttcttatactcaatcatacacatgacatctagccatatttgattccgaaaaactaaacaagcttcttattgcctcacaaaactttgatggtgtagccgaagtcggtatgagtctttggctttgtatctacaaacaagaaacattactttagcttttgggaatcggttgcggttctagttcttatactcaatgatacacatgatatcctgtaatatttcactctaaaatacttaccaagcttcttattgcttctcaaaattttgatggtgtaaacgaagtccgtatgagtctttggctttgtatcttctaacaaggaaacataactttagctatagggaatcggttgccattctagttcttattctcaatcatacacatgacatctagtcatatttgactccaaaacactaaccaagcttcttattgcttctcaaaattttcatggtgtagccgaagtccgtatgagtctttggctttgtatcttctaacaaggaaacactacttttgcttttgggaaccagttgcggttctagtttttatactcaatactacacatgagatatagtctttttttactccaaaacactaaccaaacttcttgttgcttcttaaagctttgatggtgtagccaaagtccgtatgagtttttggctttgtatcttctagaagggaaacacaactttagcttttgggaagatgttgcggttctagttcttatactcaatcaaacacataacatcttgtcttatttgactccaaaatactaaccaagcttcttattgcttctcaaaactttgatggtgtagccgaagtccgtatgagtctttggctttgtagcttctaacaaggaaatactactttagcttttgggaaacggttgcggttctagttcttatactcaatcatacacatgacatctagtcatatttgactccaaaacactaaccaagcttcttattgcttctcaaaattttgatggcttagccgaagtccgtatgagtttttagctttgtatcttctaacaaggaaacattactttagcttttgggaatcagttatggttctagttcttatactcaatcatccacatgacctctagtcatatgtgactccaaaaccataacaaagcttttcttattgttcctcaaagctttgatggtgtagcagaagtccatatgattcttttgctttgtatgttctaacaaggaaacactactttagcttttgggaaacggttgcggttctagttcttatactcaatcatacacatgacatcaagtcatatttgactccaaaaaaaataaccaagcttcctattgcttctcaaaacatgaatggcttagccgaagtccgtatgagtttttagctttgtatcttctaacaaggaaacattaatttagcttttgggaattagttgcggttcttgttcttatactcaatcatacacatgacatctagccatatttgattccgaaaaactaaccaagcttcttattgcctcacaaagctttgatggtgtagccgaagtcggtatgagtctttggctttgtatctacaaacaagaaacattactttagcttttgggaatcggttgcggtcctagttcttatactcaatgatacacatgatatcctgtaatatttgactctaaaatactagccaagcttcttattgcttctcaaaattttgatggtgtacacgaagtccgtatgagtctttggctttgtatcttctaacaaggaaacataactttagctattgggaatcggttgccattctagttcttatactcaatcatacacatgacatctagtcatatttgactccaaaaaactaaccaagcttcttattgcttctcaaaattttcatggtgtagccgaagtccgtatgagtctttggctttgtatcttctaacaaggaaacataactttagctattgggaatcggttgccattctagttcttatactcaatcatacacatgacatctagtcatatttgactccaaaacactaaccaagcttcttattgcttctcaaaattttcatggtgtagccgaagtccgtatgagtctttggctttgtatcttctaacaaggaaacactacttttgcttttgggatccagttgtggttctagtttttatactcaatactacacatgacatatattcttttttgacttcaaaacactaaccaaacttcttgttgcttcttaaagctttgatggtgtagccaaagtccgtatgagtttttggctttgtatcttctagaagggaaacacaactttagcttttgggaagatgttgcggttctagttcttatactcaatcaaacacataacatcttgtcttatttgactccaaaatactaaccaagcttcttattgcttctcaaaactttgatggtgtagccgaagtccgtatgagtctttggctttgtagcttctaacaaggaaacactactttagcttttgggaaacggttgcggttctagttcttatactcaatcatacacatgacatctagtcatatttgactccaaaacacaaaccaagcttcttattgcttctcaaaattttgatggcttagccgaagtccgtatgagtttttagctttgtatcttctaacaaggaaacattactttagcttttgggaatcagttgtggttaaagttcttatacttaatcatacacataacatcttgtcttatttgacaccaaaatactaaccaagctacttattgcttctcaaaactttgatggtgtagccaaagtccgtatgagtctttggctttgtatcttctaactaggaaacattactttagcttttgggaaccagttgcagttctagttcttatactcaatcatccacatgacatctagtcatatgtgactccaaaacactaacaaagcttttcttattgcttctcaaaactttgatggtgtagccgaagtccgtatgagtctttggctttgtagcttctaacaaggaaacactactttagcttttgggaaacagttgcggttctagttcttatactcaatcatacacatgacaactagtcatatttgactccaaaacactaaccaaacttcttattgcttttcaaaacattgatggcttagtcgaagtccgtatgagtttttagctttgtatctttcaacaaggaaacattaatttagcttttgggaattagttgcggttctagttcttatactcaatcataaacatgacatctagtcatatttgactcccaaaaactaaccaagcttcttattgtctcacaaaactttgatggtgtagccaaagtccgtatgagtttttggctttgtatcttcaaagaaggaaacattactttagcttttgggaatcaattgcgtgtctttttcttatactcaatgatacatatgacatcctgtaatatttgactccaaaatactaactaaggttcttattgcttctcaaaatgttgatggtgtatccgaagtccgtatgagtctttggctttgtatcttttaacaagaaaacactactttagcctttgggaaccggttgcggttctagttcttatactcaattatccacttgacatctagtcatatttgactctaaaacactatcaaaacttcttattgcttctcaaagctttgatggtgtagctgaagtccatatgattttgtggctttgtatcttctaacaaggaaacacacctttagcttttgggaaacggttgcggttctagttctaatactcaatcatacacatgacatctagtcatatttgactccaaaacactatccaatcttcttattgcttctcaaaactttgatgccttagccgaagtccgtatgcgtttttagctttgtatcttctaacaaggaaacattactttagcttttaagaatcagttgcggttctagttcttatactcaatcatacacatgacatctagtcatatttgactccaaaaaactaaccaagcttcttattgcctcacaaagctttgatgatgtagcctaagtccgtatgagtctttcactttgtatcttcaaacaaggaaacattactttatcttttggaaatcggttgcggttctacttcttatacttaatgatacacatgacatcttgtaatatttgactctaaaatactaaccaagcttcgtattgcttctcaaaattttggtggtgtatccgaagtccgtatgagtctttggctttgtatcttctaacaaggaaacataacttcggctattgggaatcggttgccgttctagttcttatactcaatcatacacatgacatctagtcatatttgactccaaaacactaaccaagcttcttattgcttctcaatattttcatggtgttgccgaagtccgtaagagtctttggctttgtatcttctaacaaggaaacacaactttagcttttgggaaccggttgcggttctagttcttatactcaatactacatattacatacatcacctgaagtatacagggtctctactggtgggcaaaactcgatgttgccgcaatctctgatcgaagtggaggcggaatttagaaggagaaaaatagattgtcctgctgcagggtgatcgaacctatatttatataggtaattcttctgctgcgacaaaaattgtttggaatttatgaggtgttgcatatcaatccatctcggaggaatctgttttgaatgtagaggtacattgcatgctctgagaattagggtcgcaactcctcccatagccattcttcctggtttcttaagtcccttagtccatcctctgtagctcagcagatgttcgattaggtagaatgaaactgaagcttctgtctgatctcctgctagaacggtaccatctgatgctaaaccaagtagctcctgtagcgctgtctccaacaattctagctctccattgtcaaaggtcccattcctctctcttgcaaatagtgcactggctaaagacctatgaaagtacctaaccaccggactccttattcgttgctcttggtcctagaggatgaaaacccatgtttagacccaagcatggccaagaatgactgaagctctctcttgtcaaaacgatgactcgtgtctttttcgcttgggaacccatacatatgctctaaatgatcgattggaagccgatactctacgtcatagacacagaactccaagtatcccaaacttccgtctggcctgattccatcgtcctctgactctccatatatgaacaattctacagatgaaagaaaattgacggtctcttcctcatacccatccattggccgaaacatgtgaatattctggctgcactgcttaaacatgtactctacatcatcatatatgccgagtctctccatggtctcaggatgagggtatcgagttcctaaaaactcgttgcgtttcagtagtttgtagtactcgtttcgagttgcgcacttctctgattccaaatcatcaccacctccattctctgtttgatctgcttcctcaggtgaagccatttcttcctcggagtcttcatctaccagttccaaccttctccccacgggcttctttcatcgagtgatatcttccttgttccttgagaactcccttgtagaggccttactcgaccttcgggatcgagtgttttcggcgggggagttgaaagtttgttcttcttgcatgcatcctcgtcttggcttgattcgctgtgattgatctcgaaacttgctcgttctctcctgctcgaccctatgggtgatggttcagaaagtcttcgagctgctgcatgtgaagaacgtgttgggtacctcttcgatggggagagagctatgtttcggatccttgacaggagcgtgcgcttgtttgtcattgagaacgagagactcaaaggttaggagatcgagtgatgaagaaaatagatggattatgttgagtttttgataaaaagaggaagtgcaagagaaagggatagagagaggtataagaattcgagattgctttggtatggaggtggagagatgagtttgtagtgttcgggaattgcaatggggggaccaaaattattatgaggggacaagaagacaaggaggtatgatggaattcaatggaggcgggtcacgaggcgtcggaatccacaaggtggtctctttggtttcttcactcaatcagacggtggagagtgcttcgctattaatcactcgatcaaacggaccataataaacctcaagaagtcactcgatcaaaacggtgatgatgcttttctcatttgatcattcaatccaacgacttagagcactcctcctcaatttactcgaatggttgagatcatctcttgactaggtttgattttactcgaacgttgacttcctcaaggtcaatgaaataaacctgaaacacttaaacaaaaacatcaaaaataacaagaaaaatataaagttatatacatggatagacatgggacttcccccccaagtgagcttgttttaagtcactaagcttgactcttacaaagcttagtcagaaaaaggttgaggagaggaacagagaagtcctcatcttcagtggttgaattttcagtgtctgaatcatacgttgcatcctttcttgacatatggtaggatgagtactcatttgatttttcttcaaaataagcttctttttgatcagcagagtagtcttcttcttctgaaccaggctcctttgaccaatcctcaagttcaaaactggggtagcctttaaccatttcttgaagttccagaatggtgctatttaactcttccatcttatgaattaactttccaattgtatcctcctgagctttatacccaatccaaagctccaggagttcttcagcaatagaatcaagaatcaagtgttcttcttcagaagagggtttagtgggcggtttaggtacctctggagaataagtcggaataatttcctcctcactcaacaacttgctctccaagcttctttcctctaagtgaactcctttctgatcttctggtgcaaaccattctattgcgaaatcttttgtcctctttgatagctagtgtagtttccatcttctctggatcaatactcattgaaaacttattaaatcttttttcaaacatccatagttgatctttcagcttcatcactattggagctggattttcctccaggaatccacctgcaaaaataccaggccaacccaccaagcccaccaagtagaagacctgcgcaactgatgagcccacgtacgcaaatcggtacttgggcctgataagcccggtcacctgatgaagggagataagcgaataacaacctaggaactaacagggagatattcgcagaatggacctgatatcttggaattgacctgccgaatatctaagagaatctccgcagatcccggacgaagctaccacgtgcgtagatctatataagaaagcaaggacgacttggaagacattaaattcagctttacattcacacttacacttttacacttgtaatctcctttcacattgtaaaagctctgtgataatcaatacacaagtccattggttcttagcaatataaatctcaatgttcctgtgaagatctagccctcctttctcataatctcaattacaaatctgtactgtggatttcagaacccacatttggcgccgtctgtggggaccgaaatagatccttccaacaccgaaactaacacatcaattgtgaccaacgatcatggatcctaattcatccgattcaatgagatctagcgtaccaagtcagatcgcaaacgataacgtcgccgacgggcacgaatgcatctagcatagatcgagtgatcgaagaaaccaggcgcaccccattcacggataggatcgcccattgtcacatcttagacgccgggagactccgtttcctggagtacgatggaacgagtgacccaaaggctcatctgagagccttctgtctggctataacacgagcgtacctgatagacaaagaaaatgaagcaggtcattgccgtttctttgcagagaacctcgtatgtgacgcactcaaatggtttgctagtctcaaagggaactctattgataccttcgaccagcttgcccccgccttctaaaaacagtactcggtactcatcgtaaacaggacgtctgaagccgtcctctgggtgtcacccaacttcagaacgaatttttgcgatcttacgtcgaaaaattcaaagcaatcaaatcaaagattgcgaacctaaacgaggaggtagccatagccgcccttcgcaacggcttgtggttttcctctaggttccgtgaggaactcaccgttaggcaactggtctctttagacgatgcccttcacaaagctctccacttcgccaaagccggagtccggagaggagctcgccgtttcggccctaagattcaaagaatctaaagcacaaaacgcttcccttgcaactaaaaaacccttcaaaaaggaaaaccaaatactagggtagcataccttatttgcaatagaagaggcagccgaggacgagagtccagaacttgaccacgaaaaatattacaagtaccacaaaaagagaggacattccatcgaggaatgtcgcggcgttaaaaaattaatcgcagccgggggcaaaactaaaaaaggttcaaacgctaatgccgacacccctcctcccgacgagcaggaggaggagcaaactcccaaacgaaagaaacgggactgaacaccgaaaggaggtgagtctcctccacctgctaggaaagagcgcacagacctactctttgcaggacttgatctggaaggtaggacagaaatatcagtcactacacctcctctcgccccgcaaaagaaaaacatgaggttcccattatgcctcccgaaattctgtagaaacgcaaccgagcacctctccctgaaacgcatcgatttcatcatgggagaatctcggctctgcaacgactcaatcaatttgatcaaacacatcagaggaaggcagattcctacacaaaaggcaaaagcccgatgatgtgagaccccgttccggacgtctcggcgtccggcgacgttggactcaagttcgcgcctcttcccggccgaacctcttaattttttgcgattcaacatagaattgcctttacgaggcttaattctataatcgctctcttattacacagcggaagtctttctaaccttggtttaattctaaccaactcttgtaccggtttcatcgtctttgtcccttagacttagatcaatcctttactcggtcaagacatgcatattgttcggtaaccattctaggcctaacaatcgcatattcctttatcctattttcacggtcgattcccaaacgtctatcctaactagtaagctagatcgttacataccttggccaatatgcggatttgattccctagcccatttgtcgccttattctattcgttcaacgattcgtatgcgatcgtgaattgatgaaccaatccctatcgttacttagccatacaaccaaccaaccacactggtctaagtacaacgatagagattggggatcgtacgattcccttggttcacgatggccgaatcaagctcttggattggtccatctgtcctccaaacgtacgccccttcggttccatggtggacgattgagcccttggcttatcgaatcatccatgtttccgatccggtcgtttaacactacgaccgcccacggtttactaaccgtttacccgtcgataaagctttcgccttaatgatccatccatgcggtctgaacgatatccttatcacacccaagggtccgtggattcatccaccggagtatcgtaggctagcccatgaaatccttcttccatcggccttaggtttgctcgcgggtccaacatccgttttgtccatcggttccaactgtggactttcccgttggttatccgtcgagtcaccctttggtcttaccgatctccgatcggtttcaccatggctgaggagatagatacatgaaggcagccgcgatattgatcctatatggtgaatcacgttccttacccattcttggtgctttctccctttaccagtaagattgcatccatgggcgacccttgggtgtgttcggatgcacttatccttgtccttcctcaaacacttttcttgatccatcccatccgacgatcggtctgtccgactcgttccgtctgacgatcagtctatcccatccgacccgtccgaagatcggtctgtccaatccgatccgtctggccgatccgatccgtccgacgatcggtttggccgatccgatacgacgatcggtctaccagatccgatttgtctctaagacgaacggtctaccctctccatcctctacactccatcaaaccgttggaccgagaggtggtatgcgcatcagttcggtcgacttatactcgccgagccgcaccccctttctgaccaacaacttcaggatgtgttgggactgttttgagaatattttgtggtgtatggatgttgtatgagatgctctaaagaccttgggcgtcctcccttatatagggggcgaatggatgcttcctgaagcatcccatccgttccttgcacccttccgaaaggtcacatcccttccttgcatccttccgaaaagtcacatccgttccttgcattctatgggcgatgcaaacgttcattggtacccgctcgaccttgcaccttttggccgagacacctcttcacccatgagttaccacagtccaccagctcgagtgtcagctgaccggaccacccatctgggtcagtactccgctcaccgagcttagtcgagctgttggtcagctcaactagctgagctagctagtcttccagctggtttagctcacatagcttagctagctagttcatccagcttgtccagctcacctagctggtttagcttgaactttctctttcttcctacttagtattttggttcgttcctcgaccatgatctagttttctcctaaaacaaaccggcctcgatcaccagatcacattctgggaaaatgaaaccactgacctcaataaacctcacattgacgctcttgatatccgaatcgacgtaggcaactacgaactctctcgtataatgatcgacacgagaagctcagttgacgtactcttctacgacgccttcaaaaaaatggggcacctcgattccgagttgcaaggcagaaaaacgccacttaccgggtttgatggagatacgaccttttccctaggaaccatccagctcccaaccgtcgcacggggagtaagacaactcacgaacttcctcgtggtcgataagaaagctcctttcaacgcaatactgggaagaccatggctacacgccatgaaagccgtcccatcgacctactaccaatacattaaattcccctccgacaaggggataacagtcgtatacggcagccagcgcagctcccgaaaatgttatatgggtggttacgagcatatcaaaaaagccgaccccgtggtaataatgatagaggacaaactcgcagaaatgaaaacagtcaggtcctccgacccttctcaacgtggacctcaaaaatcgctgataacgcaggtctgcatagacgaatcagatcctaaacgatgcgttaggataggtcacgacctcgacccaacaatatgagaggatctcgtaacctttctcaaggaaaacaaagacagctttgcctggtcaagcgcaaacattcgaggaataagcctcgaggtaacctcacacgaactcaacgtcgatccgacctaccgacctataaagcagaaacgtcgcaagctaggtcctgaaagggctaaggctatgaacgatgatgtcgactgattgctcaaatttggatcgataagggaagtaaaataccctgactggctcgccaacccagtcgtcgttaaaaagaaaaacgggaagtggagagtatgcatcgactttacggacctgaataaagcatgtcctaaagacagtttcccactcccgcatatcgaccgacttgtcgaagccattgtaggacacgaactactgtccttcatggacgcattctccgggtataaccaaatacttatgcgcctagatgaccaagaaaaaacagcttttattactgaccgaggcacctacttttttaaagtaatgccctttggtttaaaaaatgctggagccacctaccaacgattggtgaacaaaatgttcgctgaccagataggtaaaacgatggaggtctacatcgacgacatgctggacaaatcagctcacaaaaaggaccacgttccaccattaaaataatgcttcaaaatcctaaacaaatttgaaatgaagctaaatcctgagaaatgctctttcggagttccatcaggagaattcctcggatacctagtaaccgaaagaggcatcgaggtcagtcctaagcagattgcagccttcatcaaaatgttatcactaaaaaaggcacgagaggtccaacggctaaacggttgtattgctgccctgaacaagttcatatccaggtccaccgacaaatgcgtccctttctaccagctcctctgaaaggagaaaaagtttgacttgaatgaggactgcgaacaagccttcaagcaattgaaagcatacctgaccgaaccacccatactcgcaaaacctgaagaaggagaacagctgtacctgtacacggcagtctcccgaaccgcgataagcagtgtcctggtgagagaagatcacgagggataaaaaacgatctattacgtgagtaaaacgttgatagacgctgaaacccgttatccagcaatgaaaaaacgggcactggccgtagtcatgtcagctcgcaaactgagaccatatttccaatcacaccccatagtagtgatgacgtcccaaccaatccaaaccattttgcatagcccgacctaatcaggacaacatgcaaaatgggccatagaattaacttaacgtctttgaaccatattttataaactttctcagattgttatgtgttgttggaaatcgttattatcccaacggacaaaaaaagaactatatttatttatacttttatagtgtttgacacattaactttttcattagagctttttgggtatgtcctttttaattttatcagttaaatatctttgaactatgttttatgttttgttttttcaggttaccgtatttgttagtggcattgatattattgcaaaaaaaaaagacaaagtgaattatcatgattcataatatttaggaaaaaattaactatatctatttgttgacaaaaaaaaagaactatatttactaatggtgtttagcacaacacttttttcattggagctttgtgtgtatgtattttcttattttattatctaaatatccttaaaccatgttttatattttctttaggttacgtgtttcttaatggtgttaatactattgcaacacaaattcctctttttgtttaggtagtgaagctagaacagaatgtaaacaattatgtaatccgtggatgttgatgtatcttattttctttacataaacaatttccgttaacataagtttaattgagtgtcttttttttctagactcaagtgtcttaaaaaatggttatgagtaaagttactacattttttatatccaaccaaaattcagagtaaaaaatgaatttatttgagtttattttcatcatcaaaatttaaaataccattttcacttggattcaaagatctaaagaagcaaatatatgatggtggggcaatgcgattgcatttttttttaactcacccaaaagtaagaaaatgttatgttttttatttggttcatttttttttaactaaattttatttgttgtattttgtgatctttcaaaagtaatcgtattttgaaataccataaaaattattgttttagatctttttgtctacgcattgtaagacttttgaacataatcgattagtaaggttttcaaaatctttcgatgtgtaactaatcaagtgttacttattttataatatattttaaaagttgtacctaatttgtaaaatattgataaattagaaatattagaagacaaccacaaggtacgaaaactaaaaactaaataattaaaacaagtgaatgataatgtgactgacattttctattttcatgtaagaagaaaatagaaacatgttatagattacaagtgaatgataatgtgaaaagtctgtttttggatctaagggtgagtactcttactctattatgaattgttctctatgttttctctttgttcattctttgttgagtttgtctaagttatcgatgacattttgaaattgtttgattattatgaatgatttttcttttaatgacatgaatgtccaactaccaataatgcattagttatatgcttaaatatagaagatacaatgtctaaggatataacaaattatatgaaaagcatgtattaatttaaaaatataataaagatatcgaagatgcctattaacacaaggttaaaaacttgtgtaaaagaatcgaaattaatatattttacaatatgtggtcttaattttatttttatggagacaaaaacaacattttcttagagattttgtatggtttaatttatcatattttaattcataaatactaaagcaaaaatttaagtaagaaaataaatttaattaatttgatatgtatgcttagccacaaaatgttgcatgatttattatattaattcaaagttgcgtgagattttctctagtaataagatatatttcattcatgatctaatttaaaaacatctactctgcctgattgttagcttccatcttgtttgatctctttggttttgaattaagaaaacaatactggtcgggttagtgtagttggattttgtcgtacttttaaaagaaatgggtttgatgtacctatatatgaatgaacttttccaaagggtgcttcatcgcaaagtagtcgacgtatatgcaattattccaacaacacctctataggtggaaaacaatgatatatagattattagccacacttggtctcaggatgttcttgagattgaaaaataaaagactagtaaacacagagtctttttccttgccttttctcaagaatatgtacttaaaaggtggtatatttcctacgtatgtagttgttattacaagcttaaaagattcttcaggataatcagtgtgagttatacaattatagtactcacaccagtatttcactttctaactataacataaacaattaacaacccaaaaaaagatttgggtatggaaacaaaaccaagccttgacatgataatatttttgaatgaatctgcaagaaagatggggtttttaataaaaaccgcaaatcttcatcttcatcattcttttgcaacaatagaatttgcttcatatacataatcgtgcctgcaatccacacatatcaatgtcaaaacagagacaaacaccaatggtgaagttagaaacccatgattcaagtcataaccaaactatatatgttccttagttaaagaaggtgttcttttttcccattgctaatcaaagcaaagcacttctgtacatcttactttattttacgagtaagttggtatatccctgtcacagccataccaagactcacgctaaagagattccagtttttctgtaaacaaaaagctagaccaacataagaagaaaccagtaatcatctaacaaataagtacaagagaaaagcaaaatgtactctgtaaatgacaacaatatgattcacagaatacataccggagtaattacagtgctgtaacgtgaccaaacaagtccagtacctgtgatcactgatacaatgacagccatacgaggcatcatataaacattaaagttcacacatcgatacataaccgcaatatgtgcagaataaagatagctaagaccaatagtgagtataataccaatttgttgagggtatgaaagtgtctctggaggtttttgaaagtctgcaatattggcaatgcttataccccacttgaacgtcggcgcccaaaaatgaactgacaaatacaaaaatgattttacagttcaggtttttgtagcaagtttgatcaagctaccaaatgcacttgtttgattaaacttatattagtctattggagaaaacagagcatgttaagcaaactaatctaaaccaaactttaacaaatctaaaccgaatatgaatcttatgcataaactgataaaccattttcagagacacaaaaatcaaccaaactaagaaggatctgttacggagtcactcaagaattggaattaggtttgaaacaaagcaaatcgaggaacaaaagatgaaattctacaaatactgattgttcaataataaaaatactatgatcaatctcaccgtgtgaaaagtcaaaagtgaagaaaaaaacattcatggatatcgaagactcacttgtcttaggtccagctggatgattccaaagagcttgaagcttcgaagttgccatcaatttttctctgtaatattcccaaagttctctcaagaaataatattctctattgtaacattgctagtcaaacaaaaaaaaagttattcgttctgattacttgttccgtgtggttgggtgttattgattacgacggtgtttaatagtattgtatttgatatcgctacaaaatgattggaggaatcttctaaagactaaaccttaatttactcatctataatataatacaacgaatcaaagtattacttgattgtcacttaagttaaaaaggaattaagaaaagcaaattggttgtcacatattcacattttaaggtaaagataaatcaaagtaatttcctttcctaaacgaaaatatagatcgaaattcgtcaacccaaaataaaaatgaattctagcaagaatttttattttattttttataaagtagtctgaactgcatccaattaagaaattgaaccgaagaaaaccaaaaatcactaaatcactaaattaattagttatttatattttatttttgggtaaataatattagttatttaggttcatttatttatattttatgtaaatccaaacaaaaccaaccggccgagcaaaatctcaaactgaaccaaaccaaaatctgaaaattctaaaccgaataaccgtacgcacaaggcaaaatgatattattatagataagaaaaaaacattctcttctaagaaaaactccaagtgatatctatttatattgtatatgatgattataatttgataaactttatagatagaaggtttattgatgacataatttggagaagaagcataaaaaaaaactcaatgaccaaacaaagaagattttaaagggactgacactactaattaccatccaaatatcatttagtttttgtttttataaatactttttgtgggggaagatatcatttggaatttatgtgagtcgttagatcatcgacccatgatgaataatggaggggcatatgaatcatgatgagtgaatatgaaatgtgagggaattgaagatttgaaattgcatgtgcatgctctttttttagttctcctttggttcttgtttcatacccacaatttttctcttttgtgagtaccacaacataccttttcattacataaaacattatactaaacattagatattaaccgtagtacaccacgggcctatattattatttcaaaaaaaatcttctataaatatatgctattttgttttttaatttaaatatatggtacaccgcgagacgatataatctaactaaaaatttaagttgtatttcttttgttaatattgtttattttgtttagtgtttaagagtgaaaaattgtacatgattgtttattttacgcgtagtatacaagtatgtattaatatcgacctaaatccgtcaattttaggatttcacccgtagtataaagttgaaatgtttataatgtttaaacttcttataaaataatcaaaatgtgttttttaaaaaatgaaatttaagttgtatgtttttgttaatattgttcgtttttttgtgtagtgtttaaaattgtatacttatattttgattgttaatcttaagatttcacctgtagtataacgtcccatattgttatcgaccaaaatccattaattctaagatattatctttagtacaaagcttaaatatctataatatttaaaatttctataaaataattgagatgcatttaaaaaaaaatattagttgtatttgttttgttaatgttttttgttttgtttattatttaagattgtataattatatattgattattaattctaggctttcacccgtcctatatcgtcatgtattattatcaacctaaacccgtcaattctaggattttacctgtagtataaagtttaaatttttaatattttgaaactttttaagagtttccattctttgaaataaataactagagtaaatcgaacaattctagttttggacgtttgagaactcaagtttcttgttcattgtattcggaatcattttggtcatttttactctaaactattggccacatttttttaagcaatgtaggacattgtacacatattatttcctcatcgattggataatatatgtccattttaaaaaatttgaatcgcatcatatacaaaaaaagaaaattttctaaactatatgtattttatataaattcaaattaaattaaatataagatcaaatcaaagtgaaaaatcatagatttatttttaaataagttagagaggttttaggaaattatttaaggtaagtaacatatatgcttagtttagagatattatatttattaaatttggtaattcaataattaatttcgtttttaattaattgttttagagaaaatggtaacttttttcaagaattaatgttatccaggatccgtacactattaaatcgggtaataacccaatcgattaaagttattcaagattggaacataattaaaccggataatatcctatccaagtaaattaaaagggattaaaaggaattaaggctcaaaatcccctaccaaaaatgtatatctagatttggagtttgtaacatcatacgtcatgactagcaccagctcaatcatttaaatcaacacacgtgcggatatatatctcttaggatattaaaaggatcaattcgaaactgacatgttgttggagttagcttgaagaagacttaaggaggaatcaaaccgaaacctagttatggttcaaaccgagttatggtttagaaaattagataaattctaatgaatctagaagatatttacgatatctaaatatgtatttctaatagtattaggactagattcttttacatataaggacatgttgagttgtaacatggtccttaagagagtttgtgagatttgagagaacttgaaagctttagttttgtgtaagtttctaaagcataataagagagtcattcttattgatcttgtgttcttacatacaaactttaaacacatgaattggtatgagagcttacaagatcttaagaccgtatagggagaacttgtaagatcaagagagagagatgagtgaaatagttgcgtcaacaccgaaatcaaaagaaggagggtcttcttcgattcaatatcccaatcttactcaaaccaattatacagcttgggctatgaagatgcagatcgttctccaagtgaaacagagtcaaccgatccaagcgatgaagataagatcttggccatagccttgttagttcaatccatacatgaatctctaacttagtagattggagaattcaaggtagcaaagaaagcttgggaagctatcaaggctaggaacgtaggtgcataacgattaaagaagctagactacagacactaatgaacgaatttaataaccttaagatgaaggacaccgaaaaaattgatgactttgtaggcaagctagctgaaattgcgtctaaatcagcggcactaagaaagaaaatcgaagaatcaaaatgataaacttgacagttcactcgagaatgtaacaagaagaaataggagggagatagtattgcgccagatgcggcggagaggaaagagagagagattagaaaatagtaatgtttttggtaggtaatgattgaggaggccctaaacgggaaaccctcctttaaatacagagtgtatcaaaacccttacataaaacgcaacacttgaattaaaagacaacaatattaaagtgaaccctctttctccttcagtgtctcttgtgcactctagccactcttgagtatcttcttcagaagcttctcccagactcttgccttcttccctccagctctcagtcttcttctcatacaagctaggggaatcatgagtcttctaagagtatctatttgagctgctagcatttccctaatgagcttctctatctcatttttctgttcataagagtatctataaggtctcaagttgattggtgaggtacctttttccaatgtaatcgcatgttccctgtttctcttgggaggcaaggcctgtggcatttaaaaaacagtctggtgttgatccagaacacgttgcagaaccggcgtcacttcctttggtttctgctgttcatcactctcaaacagtgtagccaattccagcaaataggcttcatctgcatgtttgatctccttttccatggtgcggaatgatacttgttctctgcacaactccgggtctccatggatagtcacccacgtgcgcccaatctgccagctgagtctcaatcttccccaattcgctcttgtttcacccaacttagcaagccaagcaaaccctaacactatgtctagatctcccaagtcaaagagcaggaaatcctccatgattcgataccttgaatctccagaggtaccttaacacacatgcctctgcctttaatcactctacctcctcccactttaacgcagaaccctctagtctcagtactcggccagcccctttcatgaaccaagctctcatctataaagttactagtagcgcccgaatctaccaacaccaccactttagctcttcccacatagcctttgagcttcatagacctttctctttcaacatcaaatagtgatcccaatgtatgagtcgccaaggtttcttcttcagcttgctcttcttcatcattctgctctacatattcttcttcaggtgggtcttcctggtcctcttcaccagcagttaccaaacttttcaacctttgctgcttgcagtgatggccagggaaccatctatcgccacagttcctgcagggattggtgttctttggttctccacttcctgaagcacggttcaggtcgttactgggatcatatggacgtttagactgcgtcctctccattgctctggatccggatggcgtttggctagctgagaacgatggtctctgttggggtctaacttgataactttggttagtcctctcctgtgcttcaataagtcttgctatctccacaatgtcattcaagttgacaggacgacatctgaccacctggtctttaagacttctcttcaatccattcaagaacgctgactccactatgtcaatagggacatgaggcaactccaccaaaagctcttcgaatctgcctcgatactcatcgacagtgcttgtctgtctaatgttcagcaagtgatccaccactgagcttcctctgctcggtctgaaccttattttaaacttgtcttggaagtccttccatgtgtaaatcccttctctttctttagcacatctccaccacgttacagctggaccagtcaaacaagatatcaccttttcgagcttgatgtcttctggtgtgttatgagttaagaaacactgctccacgcggaaaatccagtcatctaggttttctcctttgtacagcggtagctcgaggggtctcaccggagcctcgtgcctctgtctcggtgaataaccctgttgttccaacgctggcggtaggaaacgagtctccacttgtctcatttgcaggttctggagtcgggaaaggcagaatagcctctctgtttccacgctcggagtttggaggtggtgtcgcttggaaagctgggccaggagaaggactagcgaacgcagctggtaagtttccttgaccttcacgaggtggaccaaagatctggttccttaagatctgggttaaagcttcccttatgtaaaggagctctttttccaccatttctactctgttatccagcggcggtaaggttgcagcgggagggttacttggttctggtgatcctgactgagaatcttcaccggcggccattgtgtttatgggggactctaacaactgaaagcaccaatgataaacttgacagttaactcgagagtgtaacaagaagaaataggagggagatagtattgcgccagatgcggccgagaggaaagagagagagattagaaaatagtaatgtttttggtaggtaatgattgaggaggccctaaacgggaaaccctcctttaaatacagagtgtatcaaaacccttacataaaacgcaacacttgaattaaaagacaacaatattaaagtgaaccctctttctccttcagtgtctcttgtgcactctagccactcttgagtatcttcttcagaagcttctcccagactcttgccttcttccctccagctctcagtcttcttctcatacaagctaggggaatcctgagtctatcacaaaactagtgaagaaatttcttaagagtcttcctcgaaaaaaattcattcacatagttccatcaatcttaacactaacatgttcgaggatattttaggacgactgaaagtttatgaagagtgagtcatagaagaagaagaaccgcaagaagatcaaggcaagcttctatactcaaaccaggattatcaatcgaatcaagaatacaacagaggaagaggtcgcagaggacggaacagaggtagaggttgtggaggacgttttaacaatggtggaagagatacatcaaaagtaacgtgttatcgatgtgataagttaggtcactacgcctctaattgtcctgactaattacttaagttgcaagaagctctagaaacagagaacagtgacacccgagaagccgatgaccttatgatgcatgaagtagtgtacttgaatgaaaagaattgcgtgccgagcaagtatgagaagaacacagtggatgagtacatttgttaccttgataatggagatagcaaccacatgataggggatcgaagatacttcaataaaattgatagctctatcacaggaaaggtcagatttggtgatgactcatgcattgatattaagggaaagggctcaatctcgttcattgatatcaatggtaaagcaaggatcatgatcatgacttgaagagtaacattatcagtttgggacaggctacagaatcagggtgtgacataagaatgagaggagatcacttaacaatgcacgattacgagggtaaacttctcgtcaaagaagacagatcaagagatcggctttacaaagtgcatatgaggatgatgaatacggctgcatctctaaacctttcaaagataagcgagagtagcaggtagcatgctagaatggggcatataaatttcgatacaataaagtcaatgatacaaagaaagcttgttaatggagtatcatgtgtcgagatacaaaaggaaatatgcatctcgtgcttactcggaaagcaaacttggagagtattcccgcaagcaacgttatatcgaacaactcaagttctagagttaattcacttagacctttgtggtcctacaacaccgagtactacagctggaaataagtacgtctttgtcctcatatatgatcactctcgatatatgtggacaatactattgaaagaaatgggagaagcctttgagaggttcaagaaatttaaacaatcggtggaaaaagacttagaagttaccataaaaacatttaaaactgatagaggaaaagagttcttatcacaagatttcaatagtttttgcaaagatgttggtatacaagggcatctcacggcaccctacacaccacaacagaacggtgtggttgaaagatgtaatagaacactaatggagatggctcggagtgttccaaaacatgtaaaatgcacacttatcaactcccccaaatttagtatttgcttgccataaagcaaacaattaagaacaagctggaggtgaggtttgaaagcggagactcagagccaaagcaccagataaattagatgaaatcaatgttcaagttggtagttctaagctgcgatatgatcgaattctacttaaaacgttagccatgccttgttatcaatcaatccgactcttatgctctacctacacatgttttcaaatctaccaatctctttaacattcattagttctagaacgtgaatcaagcaatgcatcatcaatgaactcatttggttaaggtaaaggtcaagagacaaagatgatcccttacagaataggcttcagtaacaggggatctctaaaaaatgattaagctttagtagaatgctaaaggtaagtccgaagctatgcatacagagataagatcccatctacccagagtataacaaatgaagctctaatggtaatcccatctccaatcccaatataagaacttaactctactctttgcattcatgaatcttttaagacatttttctaatcattcttttcttttctcttaactctaggagaagctttctcaacactgatacatctagcgaatttggatttctttaacaactaagggttcctgtttttaaaatttaaaattaagggcttttgcccttcttcattagctaacaagaactcttttctttacaaatcccaaaacatttattagactttttctgcttctttagcttacttcacctagagtcttttaccttttttatcaatgaatcaacccttttttttttttagacacatcccaacccaaagtataagcgcttacctagtcctatctagtccagaaaatgcgatgtagaactacatgagacactatctctgtcgttacaaacctaacactttctaccaatctaaatcggaataaaacctcacaaacactcacaagtgatatagggcttgaaagaaagtttatgtttgggttcgggttaactgatctaataacgagagtcagttacttggattaacaagagtgatcaaaatgaataagaatgcaacacacacttcctgagccctcccccaaacttaaatcacacagtccactgtgtgactaaacttggaagagagtactcaggacaaatcaaatcacagaaacaaaataaagaacaaatcacaagagatgatataatacaatggagaagtgaggcgcttacctcagtcgaagaatgaacgaagttggtcgtcaatggttgcatgtgattgctccgaggccatagaagaatcgccctgttctgtatcagctctagcatgtgggtactcgatctcatcagctctgtggcggccagcaccgcttgaggatactcgacctctcttcttctaccgcggtcgcgtaaactacgagattgcagaagtcgtctgttcctgctgctagatcgagtaagtttggtcctcctctttctcccaaattcacgaggctcgaatgatgaatgcctcgcagggacatgcataatctcttgctcagtaggctcaggcctgcgccgacttgtctcaggcgcatcatatctcctcgagggcatgtcctgagggagctgtccatgcggaatagctgtagtggtagaggagcagcttagcttgtccttcagaaacttgatagctttgaggcacttggcaagtaacttatcatgtttcttacaccacttctgcaacttgttgttgttcctgtgagcttcactcaaactcttgctttccctcgctggaggtacatgctcactgaaatgagacatgctcgtgtcaaactccgcttcatctatttcatctgtctcatcaacttcttctattgtagctccttccgtgtgactgatctcctcagttggcggactgcccttgaaataaagatcttcaagcgtaggctagaagtcaatattcctgccctcgagaatcctggtagcgtcaatgtaggggagaaaaatgttggcgattctgatcgatgaatgcttgaacctgtagctgtggaagttgccaaccatgtcatgctccaagaactcacatcggcgtaaatgatccaaatctatcattctcggctctaacccctgtttcttgagcggtactccacaagcttcgagaatcggcgtcacaacgccacctacgcatagtgttcctctcactttcttcttgcagtttgtcaacgcccatttcctgtatccacacaggtggatcaacagaagcattactggtggcgcgtcattgagatcacctctcaggaccttctttccctttgtacggtggagaatgcttgtaagtgcggaatctatc

SEQ ID NO: 208 - DNA, 94905 bp, Arabidopsis thaliana
gaattctccaccgttcgatcgagtaatgcgtaattctagaagatgcttgatcctttactcgagcttgaattatttggagaccaaggagtgaagttgtgtgaccccacttattcccccaacactcctttactcgatggacaaagaaattacccatgctcctcaccatttccaatcaacgtttctatctcttccaaaaacaaaccaaagaccattctcctccacccattgaattgaattcgccaaacccttttgaaactctctctttcatcatctcatttttgcaattctctatctctcacaaagcttcaaaagtttcatcccaaactctccctatcactcttcaagaattcgttctcaccttcaccaatacttcaccaaagttactcgatcactcccaagtctatcctcacacatttaatcggttttaagcacaaaatttcatcaccaaagaaaccgaatccattccactttgataccccttggagagttgttcttgtttgccctgttgaagctcaccaccaatctccatggattcaaggagaaagagttcatctcggggtagaagatcctccgttgataacgaagaagttgaggcgtttgacatgagtggcatgactgaacgccaaatttgccaagatcgttgtgctcaaagatcaagcttgattctaggtggaagctcaagccgctcagccatgttaagagaagaagtagctcggggaaagagggttgttgaggttgaggaagtacaccgtgaagaggcagtcttcgaagaagcggtcatgaggaagaggttgagatcatcggggatgatacactagccccggttggcaaaagaaaccgaccaaggaggaagagagagccaaccccaagtgagtactatcaatacttgaaggagttaaagtttgagcttggtatttgtggtgatgtggaatacttcatggaattggccaatcttgcaacgttcatgagctgccaatgtggaggatttaaagaggagagctgccaactcctttcaaccctcaaggttcacttttgtgttgatgattcggagaaagaagaaagaggagggcttggttacataaatttcaaggttgggggtgtcgagcttgatattagccaccttgataccatttttgggtttccaagtggagaaagaatccgccaagactatgaccaagatgagataaaatctctttggacaacaattgccggtccaaagccctactcgcccgccaagagcaagagttcttcaattcgaagtctcgtgattagatacctccaccaatgtatcgccattacccttttcccaaagaagactaccagattcgtttatgaaggagagctattcatgattgctcaagctttggtcttcattctgagagagaccgaggatgggaggaagatggcgggtgatagagtagacacttcgttgactgtcgttcttttggaccacctactgagctatagagagtatgttgcaaccatccatctctcggggatttgcggaagtctttgtgttggtggtctcttaacaccaatcttaggagcttcaaggatacaatttggaacccctgacgtgttccccaagttcatcgacctcaactatctcaaggggaaggattttcttgaaaagaagactccggcggatcattatatcttcaagttcaaccatccaaagcttggaccttctttgttacctctaccttgcgagaaccggacttcattgaagacaaggcacaacatcaacttcatgccatctccctcttccctgaacatcgacatcgaaggagctagagaagatgaacaagagtatactcaagctgactatgagcaacaagaatattatactcaagctgactatgagcagcaagtcgagttcgagcaacttagcgaacaaccggagcaagagaccaaagaattcaagcaagctcattatgaagcagatgctgatcaaggaggagatgagataactgaagtttacaagaagctccgtgtgcttgaagagcttgggaaccttcacagcaaaacgatgaagggtttcaagaagaagatgagaacaatgaagaaatcactaaagagtatggctagtcaaatcaaagacttctagagcaagccaaggccaccgtctcccacccccgaagtaagaagaagcggttccacaaggagggctgaaaggagggctgaaaggattgatcaaccccgagcttcatcactcgagcctcgggaagtgatctccgagttgagagagccaaggagtaggcagagacgaggttctacacgctcgaccaactactcgaccagacagaacgagcaaaatcctcccgcgtcaacatctgccccttcttatattctatagagtatggacgattaagttttcatctacttcacctgaccgctgaggtaacaccaccaccaccattgtacataccatagcatttttatttttctatgtgtgttttgtgttttggtcttgaattctttctccgatttttattacacaagggactgtgtaatttaagtttcattttaggattgtatacagagtgtttgcatttaggattgctaatttgcataggggataatgatgatttcaaaccgttaagtatgttttgattcaatgaagtaagttcaatgccgaggttgttagttttcttttgcataaccgattggttctctgaagtaagaccgctccctgctttgaatttacaacttgactatactgctttgattcgaaactcgcttatctgatgtcattccctatctattagaacctgaactaaatttgcaattatcatgtatatgcattgtttgtgaactcatggctaccatatacatacttggattatcttattcacttcaccaccctttggtaatccaagtagttgactctcatttttagagcagtttccaataccttgagcctagcctaatttcaagctaaagatcatttgtgtgtgattgtgaggtctttttcgattgagcttggtataacgtgttaggtatgagccgacaagaccagtctttcatgtagacctagccgacgctttttgagttagctaggactaggtggtgacttgtatttgggattgggatgatgtatggaatgattggaaaagagaatgggaatgaaaaaaaaagaaaaaaaaaagagagtaaaagtttagagttcttaagggggatacaaaaagtgttagtgtagtaaagggtttggaattcaaagaagttaggcattgtaattcaaagaaaagggtaaacgccctatatgctaagattagaagaaaagccttaagtgtgtcaaagtttaaaaccaaacccgctagactcttgaatcgttttaaagaagaaccccttacaacttgaaccaaaaagagaaagaatgagaaaaagggtagagttaggacacctataggactgggatcatcttctgagctatcatacgatatcattgggtagatgggagtctattcttgtatgtttccattggattttacctttagcattctactaaagctcaatcttttctctgagtgtctcctgttactcgaccaatcattagaggaaccatttttgtctcttagcctaagcctgaaaccaattgagttcataaccattgcattgcttgatccattgttcgtgcttaatgaatgttaaagggaattggttaaggcaggttgttaggttgcattgtgacgagtatggctaaagtttttaagtaagggtctatcatcttgcaacctagaattagctacctgaacatttagcttaccagttctatatgcatgcttcggtttttgaatccccaccttcaaacctcttcttcaatttaagattttttgtttgcttgagggcaagcaagagataagtttgggggagttgataacactgtaatttactcattttaggtgtgtatttatcatcatttagcttagtgatcactcattatatcaaatcattttgcatcacatttagcttattttgcacacttaggcaattaggatcatcttgcatacatattgcatgttttggtgtgttttcaggtgcagaaagagcttacaaggcattctactcgaccctctactctatcaaaccaggagggaagcataagagcattctactcgaccggtttactcgatctaggcagccatggaggaggcagcagactttactcgaccctccttctcaatcctctaatcgaccagtttactcgagcaagggcaacctactctacaagacttgttgatcattcaaagcgtcttctgattctcctgattcccaacaagacatttgagcataagaataggagaggaagaagcaactacttgaccaattgatcactcggagcatggacacaaaggcgcagactttgcagcaccctctttactcgatccccaagatcgagcactcgcccaaacatcctcaagtctcttgtcttctagtaaatctagggttttcaatactttagtataaatagatcactttgggatttgtccaaaggatctagcttttatctcttagtttttctttgtgttcttgaatcttcaaaacttaattactcttaatctatttcgtttttgcatttggttctttaagtaatgtcgtttagcttgtttagatctacattttgatatgatttcaataatttctgggtttgtgttcttgagtatgttgcttgagtagtgattagggttcttgaggatgaataagattagggtaatctctaggttagtcaggtggttaagattaggttagatcccttctggattcgttggcccctatgcggttttcgctggctaatgtagacattcgaccataggtatccagcgtccaaaagacgttcaaatggattccggatctacgaataccagagatttgtagactctagacaaggagtttggctagactgcttattgaatttggttgattggttctaaaccctgttttgctatgtttcatcaacgaaagttgagattaggaagttgtagagttacgggggtctcggtcacgagaatggattgacccggtttctgaatctatcgtctagggtatctccctttcacctgttagccacctcatgaaccctaaagttgctcttatcaatgaatccatccttaggacttctattgttcttagatttatatgtattcaccccctgattgcactttgatttacctgtaatttgtgtcacctgttgattgcattttagttcttaaatttgttgcctattggtattactcgacccaatgatcgagtagggcttttaagttcatatttttgcttgtttgaatcctcacctaggattgttactagaaaccaatcatttctataatttggcttgacttagttgattctgtacaaattttgatagctagcaataacagtggactggattgacaccccctatagctgcatcgacatgttagtgtttaaagggaattgaactgaacacaccacacttctgcaaataactaggcataaaaacctagttatcacggactttggctacactatcaaagcttcgaaaagcaataagaagcttggttaatatttcagagtcaaatatgactagatgtcatgtgtatgattgagtataagaactaaaaccgcaactggtttccataagctaaactagtggttccttattagaagatacaatgccaaagactcatacggacttcggctacaccatcaaagctttgagaagcaataaaaagcttggttagtgtttcagagtcaaatatgacgatatgtcctgtgtatggttgagtataagaactagaatctcaactggatcttgaaagcctaagtagtatctccttgtcagaagatacaacgcaaaagactcatacaaagttcggctacaccatcaaagctttgagaagcaagaagaagctttcttagtgttttggagacaaatatgactagatgtcaagtgtatgattgagtataaaaactagaaccgcaaccggttccgaaaagctaaagtaatgcttccttgttagaagatacaaagccaaagactcatacggacttcggctacaccatcaaagcttggaaaagcaataagaagcttggttagtattttggactcaaatatgactagatgtcatgtgtatgattgagtataagaactaaaaccgcaactggtttccataagcagaagtagtggttccttattagaagatacaaagccaaagactcatacggacttcggctccaccatcaaagctttgagaagcaataaaaagcttggttcgtgtttcagagtcaaatatgactacatgtcatgtgtacgattaagtataagaactggaatctcaactagatcttgaaagcttaagtagtatctccttgttagaagatacaaagcaaaagattcatacggcgtttggctacaccatcaaagctttgagaagcaataagaagcttggttagtgttttggagtgaaatatgaatagatgtcatttgtatgatgagtataagaactagaaccgcaatcggttcccaatagctaaagtagtgtttccttgttagaagatacaaagccaaagactcatacggacttcggctacacaatcaaagcttggaaaagcaataagaagcttggttagtattttggagtcaaatctgactagatgttatgtgtatgattgagtataagaactaaaaccgcaactggtttccataagctaaagtagtggttccttactagaagatacaaagccaaagactcatacggacttcggctaacccatgaaagctttgagaagctattaaaaagcttggttattgtttcagagtcaaatatgactacatgtcatgtgtatgattgagtataagaactagaatatcaacttgatcttgaaagcctaagtagtatctccttgttagaagatacaaagcaaaagactcatacagagttcgactacaccatcaaagctttgagaagcaataagaagcttggttagtgttttggagacaaatatgaatagatgtcatttgtatgattgagtataagaactagaaccggaaccggttcccaaaagctaaagtagtatttccttgttagaagatacatagccaaagactcatacggagttcagttacaccaataaagtttggaaaagcaataagaagcttggttagtattttggagtcaaatatgactagatgtaatgtgtatgattgagtataagaactagaactgcaactggttcctaaaagctaaagtagtggttccttattagaagatacaatgccaaacactcatacgaacttcggctacactatcaaagctttgagaagcaataaaaagcttggttagtgtttcagagtcaaatatgactatatgtcatgtgtatgattgagtataagaactagaatctcaactagatcttgaaagcctaagtagtatctccttgttagaagatacaaagcaaaagactcatacggagttcggctacaccatcaaagcgttgagaagcaagaagaagatttgttagtgtttcggagacaaatatgactagatgtcatgtctatgattgagtataaggactagaaccacaaccagttccaaaaagctaaagtagtgcttccttgttagaagatacaaagcaaaagactcatacagacttcggctacaccatcaaagcttggaaaagcaataagaagcttggttagtattttggagtcaaatatgactagatgtcatgagtatgatcgaatataagaactaaaaccgcaactagtttccataagctaaattagtggttccttattagaagatacaaagccaaagactcatatggacttcagctacaccattaaagctttcagaagcaataataagcttggttaatgtttcatagtcaaatatgactacatgtcatgtgtatgattgagtataagaactagaatctcaactggatcttgaaagcctaaataatatctccttgttagaagatacaaagcaaaagattcatacagagttcagctacaccatcaaatctttgagaagcaataagaagcttggttagttttttggagtcaaatatgaatagatgtcatttgtatgattgagtataagaactagaaccggaaccggtcccaaaacctaaagtattgtttccttgttagaagatacaaagcaaaagactcatacggacttcggctacaccatcaaagcttggaaaagcaataagaagcttggttagtattttggagtcaaatatgactatatgtcatgtgtttgattgagtataagaactacaaccgtaattggattccataagctaacgtagtggttccttattagaaaatacaaagccaaagactcatacggacttcggctacactattaaagctttgagaagctataaaaaagcttggttattgtttaagagtcaaatatgactacatatcatgtgtatgattgaatataagaactagaatctcaactggatcttgaaagcctaagtagtatctccttgttagaaggtacaaagcaaaagactcatatagagttcggctacaccatcaaagctttgagaagcaataagaagcttggttagtgttttggagtgaaatatgaatagatgtcatttgtatgattgagtattagaactagaaccgcaaccggttcccaaaagctaaagtagtatttccttgttagaagatacaaagccaaagactcatacggacttcggttacaccaataaagttaggaaaagcaaaaagaagcttggttagtattttggagtcaaatatgactagatgtcatgtgtatgatggagtataagaactagaaccgcaactggtttccaaaagctaaagtagtggttccttattagaagatacaacgcctaagactcatacggacttcggctacactatcaaagctttgagaagcaataaaaagcttggttagtgtttcagagtcaaatatgactatatgtcatgtgtatgattgagtataagaactagaatctcaactggatcttgaaagcctaagtagtatctccttgttagaagatacaaagcaatagactcatacggagtttggtacaccatcaaagctttgagaagcaagaggaagttttgttagtgtcttgggacaaatatgacgagatttcatgtgtatgattgagtataaggactagaaccgcaaccggttccgaaaagctaaagtattgcttccttgttagaggaaacaaagccaaagactcatacggacttctgctacaccatcaaagctttgaaaagcaaaaagaagcttggttagtattttggagtcaaatatgactagatgtcatgtgtaattttgagtataagaactaaaaccgcaattggtttccataagctaaagtagtggttccgtattagaagatacaaagccagagactcatatggacttcggctacaccatcaaatctttgagaagctataaaaaagcttggttattgtttcatagtcaaatatgactacatgtcatgtgtttgagtgagtataagaaatagaatcttaactggatcttgaaagcctaagtagtatctccttgttagaagatacaaagcaaaagactcatatagagttcggctacaccatcaaagctttgagaagcaaaaataagcttggttagtattttggagtcaaatatgactagatgtcatgtgtatgatggagtataagaactagaaccgcaactggtttacaaaagctaaagtagtggttccttattagaagatacaaagcctaagactcatacggacttcggctacaccatcaaagctttgagaagcaataaaaagcttggttagtgtttcagagtcaaatatgactatatgtcatgtgtatgattgagtattagaactagaatcttaactggatctggaaagcctaagtagtatctccttgttagaagatacaaagcaaaagactcatacggagtttggtacaccatcaaagctttgagaagcaggaggaagttttgttagtgtcttgggacaaatatgacgagatgtcatgtgtatgattgagtataaggaatagaaccgcaaccggttccgaaaagctaaagtattgcttcgttgttaaaggatacaaagccaaagactcatacggacttctgctacaccatcaaagctttgaaaagcaaaaagaagcttggttagtattttggagtcaaatatgactagatgtcatgtgtattattgagtataagaactaaaaccgcaattggtttccataagctaaagtagtggttccgtattagaagatacaaagccagagactcatattgacttcggctacaccaacaaatctttgagaagctataaaaaagctggttattgtttcagagtcaaatatgacgacatgtcatgtgtttgagtgagtataagaagtagaatcttaactagatcttgaaagcctaagtagtatctccttgttagaagatacaaagcaaaagactcatatagagttcggctacaccatcaaagctttgagaagcaataagaagcttggttagtgttttggagtcaaatatgagtagatgtcatttatatgattgagtataagaactagaaccgcaaccaattcccaaaagctaaagtagtatttccttgttagaagatacatagccaaagactcaaacggacttcggttacaccaataaagtttggaaaagcaataagaagcttggttagtattttggagtcaaatatgactagatgtcatgtgtatcattgaatataagaactaaaaccgcaactagtttccataagctaaagtagtggttccttattagaagatacaaagccaaagactcatacgaacttcagctacaccatcaaagctttgagaagcaataaaaagcttggttaatgtttcagagtgaaatatgactacatgtcatgtgtatgattgagtataagaactagaatctcaactggatcttgaaagcctaaatagtatctccttgtaagaagatacaaagcaaaagattcatacagagttcggctacaccattaaatctttgagaagcaataagaaggttggttagttttttggagtcaaatatgaatagatgtcatttgtatgattgagtataagaactagaaccggaaccggtcccaaaacctaaagtattgtttccttgttagaaagcaaaagactcatacgaacttcggctacaccatcaaagcttagaaacgcaataagaagcttggttagtattttggagtcaaatataactatatgtcatgtgtatgattgtgtataggaactacaaccgtaattggattccgtaagctaaagtagtggttccttattaggagatacaaagccaaagactcatacggacttcggctacactaagctaaagtagtggttccttattaggagatacaaagccaaagactcatacggacttcggctacactatcaaagctttgagaagctataaaatagcttggttattgtttaagagtcaaatatgactacatatcatgtgtatgattgaatataagaactagaatctcaactggatcttgaaagcctaagtagtatctccttgttagaaggtacaaagcaaaagactcatatagagttcggctacaccatcaaagctttgagaagcaataagaagcttggttagtgttttggagtgaaatatgaatagatgtcatttgtatgattgagtattagaactagaaccgcaaccagttcccaaaagctaaagtaatatttccttgttagaagatacaaagccaaagactcatatggacttcggttacaccaataaagttaggaaaagcaaaaagaagcttggttagtattttggagtcaaatatgactagatgtcatgtctatgatggagtataagaactagaaccgcaactggtttccaaaagctaaagtagtggttccttattagaagatacaaagcctaagactcatacggacttcggctacaccatcaaagctttgagaagcaataaaaagcttggttagtgtttcagagtcaaatatgactatatgtcatgtgtatgattgagtataggaactagaaccgcagccgattcctaaaagctagagtaatgtttccttgttagaagatacaaagccaaagagtcttacggagtttggtacaccatcaaggctttgagaagcaagaggaagtttaagaactagaactgcaaccagtttccaaaagctaaattaatggttttcggctaaagatacggatttttggctacaccatcaaagctttgaaaagcaataaaaagcttgcttagtgttttagcgtaaaatataactatatgtcaagtgtataattgagtataagaactagaatctaacttggatcttgaaagcttaagtaatgtttccttgttagaagatacaaagccaaagactcgtacggacttcggcttcaccatcaaagctttgagaagcaataagaagcttgataggtgttgtggagtcaaatatgactatatgtcatgtgtatgattgagtataagaactagaaccgcaaccggttcccaaaagctaaagtaatgtttccttgttagaaaatacaaagccaaagactcttacggatttcggctacaccatcaaagctttgagaagcaataagaagcttggttagttttttggactcaaatatgactagatgtcatgtgttcgattgagtataagaactagaaccgcaacaggttcccaatagctaaagtagtgtttccaagttagaagatacaaagcaaaagactcatacggacttcggctataccatcaaagtttatgagcaataagaagattggttagtgttttggagttaaatatgactagatgtcatgtgtacgattgagtttaacagctaggactgcaactggttcccaaaagctaaagtagtgttttcttgttagaagatacaaagccaaagacgcatacggacttcggctacaccatcaaatttttgagaagcaataaggatcttggttagttttttggagtcaaatatgactagatgtcatgtgtatgattgagtataagaactagaaccgcaaacggttccaaaagctaaagtagtgtttccttgttagacgatacgaagacaatgactcatacggacttcggcttcaccatcaaagctttgagaagcaggaagaatcttggttagtgtatgggagtcaaacatgactagatgtcatgtatatgatttagtataagaactagaacatgaatctgttcccaaaagcaaaaataatgttttcttgttagtataccatcaaagtgtatgagcaataagaagcttggttagtgttttggagttaaatatgactagatatcatctgtatgattgagtataaggaaacagtactactttagcttttaggaactaattgtggttctagttcttatatagaatcatagacatgacatctagtcatatttgactccaaaacactaaccaggctttttattgcttttcaaagatttgatggtgtagccgaaatccgtatgagtctttggctttgtatctttaacaaggaaccactactttagcttttgagaaccgattgcggttctatttcttatactcagtcatacacaggacatctagttatatttgactccaaaacactaaccaaccttcttattttttctcagagctttgatgggtagccgttcgtatgagtctcatggtttgtattttctaacaaggaaacagtactactttagcttttcgtaaccgattgcggttctagttcttatatagaatcatacatatgacctctagccatatttgactccaaaacactaacaaagattctattgcttctaaaagctttgatggtgtagcagaagtacgtatgagtctttggctttgtatcttctaacttggaaacactactttagcctttgggaaccagttgcgattctatttctgttactcaatcgaacacatgacatctagtcatatttgactccaaaagaccaaccaagcttcttattgcttctcaaagctttgatggtgtagccaaaatccgtaagactctttggctttgtatcttctaacaaggaaacattactctagcttttaggaatcggctgcggttctagttcctatactcaatcatacacatgacatctagtcatatttgactccaaaacactaactaagcttcttattgcttctcaaagctttaatggtgtagccgaagtcagtatgagtctttggctttgtatcttttagaagggaaactctactttagcttttgggaaccgattgcggttctagttcttatactcaatcatacacatgacatctagtcatatttgactccaaaaccctaaccaaacttttaattgcttttcaaagatttgatggtgtaaccgaagtccgtatgaagcttttgttttgtatcgctaacatggaaccactacttgagcttttgggaaccggttgcagttcaagttcttatactctgtcatacacatgacatctggtcgtatttaactctcagacactaaccaagcttcttattgcttctcaaagttatgatggtgtagccattcgtatggttctttgggtttgtatcttctaacaaggaaactctattttagcttttgggaaccagttgcagttctagttcctctactcaatcatacacatgacatctagttttattttattccaaaacgctaaccaagcttcttattgtttctcaaagaattgatggtgtagccgaagtccgtatgactctttggatttgtatcttctaacaaggaaacattactttagctttttggaaccactacaagaatatggattatttatagcactataatatagcagttaaccatgttgtgctataatttataaccggctaaacttttatagcgtttggtaatttcacaacgctataatctcgtacccggtaaataaaaaatgacgcgggtcatgtttttgaatttagggttattgttctatagcattaccattaattaaacgctacctaatgtaatagcgcggattaattttgttgccgccgaaacaaaaaaattagcctaaaaatattctaagtgaaaaaactatttgtgttctttctcgactgtttccctccctattcgtgttcttccctattcatgttctgctctaatcgattcttcttctctctgtctcactttgtgttcgtgttcttgctcaacgactctattcaatctctcttgacgactctcgctactccttagcttctcagtcacagatctgtttctaatttgagaaggttatgtgccttttctaatcgatttagggattgcatgtccaaattctcttgtttgagcatcgatttggggttttaatcagttttagggtttcgttttcaggttctcagaagcttttggtagccgtgtctcgaagatttcaatggtttctatttgacaggtatgttattttgacttagtttgaatagatttctgtagttcttagtttgcatatatcgatttgagtttctttcagaattgaacttgaggattcacttgtattgatttgagtttctaatagaattgaacttgagtattcacttagcttgtatcgattttgaatgtcatatagctttgaacttgagtattcacttgtatcgatttgtgtttcttataaaattgaccttgagtattcacttgtatcgattttgaacttgagtattgattttgaatttgaacttgagtaataacacagaacttgaattgatagtgaacttgagtttatgaaatttctcattttgtctttgctctttgagttttgtttgcttatatagctgaatgctaatatatatatatatatatatataagtaatatcatatatatggggttggagcttggtggtcttttaaaaatggataagtcatgggtatggctgccaaggaatagcattgagtatgagaaaggagcaacaacttttgtttacgcatcatcgagaagtctgggagatcatgctgaaatgttttgtccatgtattgattgccggaatctgtgtcatcaaccaattgagactattttggagcatctagttattaagggaatggaccataaatacaagagaaatagttgttggagtaagcatggggagatacgagctgataagttagaagttgagcctagtagtactactagtgaatgtgaagcttatgagctgattagaacagtttattttgatggagacgtccattctgattctcagaatcagaatgaagatgatagtaaggagccagaaacaaaagaagaagctgattttagggagaagttaaaggaagctgaaactccactatatcatggctgtccgaagtacactaaggtgtctgcaattatggggctttaccgcatcaaagtgaagagtgggatgtcagagaattattttgatcaacttttgagcttagtgcacgacatactaccaggagagaatgtgctgccaacatcaacaaatgagatcactaagatcaaatgagcttagtgatcaaacatcctgaagatgtttggttttgggtatgatatcattcacgcctgtcagaatgattgcatcttatacagaaaggagtatgagctgagggatacttgtccaagatgcaatgcttccagatgggaaagggataaacacacaggtgaagagaagaaggggattccagctaaggtactgaggtattttccaatcaaggatagatttaagagaatgtttagatccaagaaaatggccgaggatctacggtggcatttcagtaatgctagtgatgatggtacaatgcgaaatcctgtagactctttggcttgggctcaagtgaatgataaatggccacaatttgctgctgaagctagaaacctgagattgggactttctactgatgggatgaatccgttctctattcaaaacactaagtatagcacctggccagttttgattgttaactacaacatggctccaacgatgtgtattaaaccaaggttagaaagacttccgctgtgtaataagaaagcaaatatagaatttagcctcgtaaaggcaattctatggttaatcgcaaaaaattaagaggttcggccgggagaaggcgcaaacttgagtacacggtcgccggacgccgagacgtccgggactgggtctcacagcccttggttctagttcttacactcaatcatacccattacatctagctataattgtctcctaaatattaaccaagcttcttcttgcttctcaaacctttgatggtgaagccaaaggctgtatgagtctttggctttgtattttctaacaaggaaacactactttagcatttgggatcatattgcggttcttgttcttatactcaatcatacacatgaaatctagtcatttttgactccaaagcactacccaagcttcttcttgcttcactaagctttgatggtgtagccgaagtccgtatgtgtgttccgctttgtattttctaacaaggaaacacttcttggggttttatgatccggttgcggttctagtgcttatactcaatgatacacaaaacatctagtcatatttcactccaaaacagtaaccaagcttcttcttgcttctcaatgctttgacggtgttaccaaagtccgtgtgaatcttcgtctttgtatcttcaaacaaggaaatacaagtttagcttctgggatccggttgcagttctagttcttatactcaatcatacacatgacctctagtcatatttgaatccaaaacagtaaccaagcttcttcttgcttcttaaagatttgatggtgtagccgaagtcggtataagtctttggatttacatcttctaacaaggaaacatttgtttggcttttaagacccggttgtggttctagttcttatactcaaatttgactctcaaacactaaacaagcttcttcttgcttctcaatgctttgatggtgtagccgaagtctgtataagtctagggtttgtattttctaacaaggaaacactactttagctttttggatccgattgcagttctagttcttatactcaatcctacacatcacatctagttataattgactccttaacactaaccaagctttttcatgcttctcaaatctttgatggtgaagtagaagtttttatgagtctttggctttgtattttctaacaaggaaacactactttagcttttgggatcagtttgcggttctagttcttatactcaatcatcacatgacctctagtcatatttgactccaaaacactaaacaagcttcttcttgcttctcaatgctttgatggtgtagcctaactccgtatgaggttttggttttggatcttctaatagggaaacactactttagcttttgggatccggttgaagttctagttcttatactcaatcatccacattacatctagttataattgactcttaatcacaaaccaagctacttcatgcttctcaaagcattgatgatgaagctgaaggcagtatgagtctttggctttgtattttctaacaatgaaatacaactttagtttttggtatccggttgcggttctagttcttatactcaatcatacacatgacatctagtcatttttactccaaaaacactatccaagcttctgcttgcttctcaaagctttgatggtgttgccgaattcagtatgtgtctttgggtttgtatcttctaacaaggaaacacttcttaaggttttaagatccggttgcggttctagttcttatacataatgttacacatgagatctagtcatattagataccaaaacattaaccaagcttcttcttgcttctcaaagctttgatggcgtttccacattccgtgtgaatcttcggctttgtatcttctaacaaggaaacactaatttagcttttgggatcttgttgcggttctagttcttttactcaatcatacaaatgacatcaagttatatttgactcccaaacactaaacaagcttcttcttgcttctcactgctttgatggtgtagccgaagtccgtatgagtctttggctttgtctcttctaacaaggaaacactactttaccttttgggatccggttgcggttctaattctcatactcaattatacaaatgacatctagtcatatttgactccaagacacatactaagcttattctagcttctcaaacctttgatggtgtatcaaaagtttgtatgagtcttttgctttgtatcctccaacaaggaaacactacttaggcttttaagatccagttgtggttctacttcttatactcaatcatacacatgacatctagtcatatttgacacaaaaacactaaccaagcttcttcttgcttctcaaagatttgatggtgtagccgaagtcaatatctatgaatactaaccgtttgaagaggtaatacgaagagctgtgagattagctccagccttagtggttgagttggaaactaggatatcctcaagtgtgttggtttgctatctagattttttaatagtcggattaagtggaacctgcagcattcgtcaactagacaataatctaaagaaatatagatcatgattccaaagggtagagattttttaatagtcggattaagtggaacctgcagtttttggagatttgaaacacttattgacgaaattaggaggtgagtagctttgccgtttcggaggtggagcaaagggtagaggtgcggtgggagacgtggctgtagtgcctggagtatcatcactaaactcaacccgaaaactagctctaacaaagaactccggcttagccatctctatagatcgattctcaacaacgaatctggagcttgcttcatgtggacgcttggtgttgttgagtacctgttctgagacaaccattatctttgtcttgtcatcttaattctctggagcatcatctcgtagcatatcactctgaagagggggtgataacttatctatatcaaccggaggcaactgaagtagagtctcatccatgatacccatgcaatgcatctcaggaatctcatgcttagacactcaaggcagtagacaaggaacttgtggtgtgtagacttgtctagtgacaggtggagatgcaaggcatataggtggtgtctgagtccattgtcgatcgacactaggtgagtgtcgaacgacaccactgtctggaatcaatcatgctctgtcaaatgtcaacactggcctgtctgtttggtgttggtgtgatcgacatgaggtgggtgtcgttcgataccatcgagaattagtgcctcctctacgaaattatcgattccactcgacaaagtcaaaacagagtcgtcaagattaattggtgtcgatcgacaccctgatgtatcgattaacagtgagacatttcctacaactggaatagatgaagtccgagctgaactttcgcgctgaagtattggattgagttgctttccgctgcgtagtgtgactgcattgatagaggctaatggaggtgatagctcggagatatgagagcgtagattgtcaaacttgctatttatatatgtgtagagagaatcatgtttgctttcaagctttgtggagagagaatcatatttgctatcaacctttgtgaagcctgcaagaagctgcgtaaacatagactccattctggtctctgatgagggaggagggggggggggcttgggaaggagcagaaattgctgaaacaagagtctctttgcttgcggtgtcaaattcatgtgtcgaaagactagttaaagcattggtaatgaggagtaatgcttcactagtagttcttgtcatgaagttacagtagcttgctgcatcaagttgagtctggtatggcatgattatccctctttagaagatattgatgagttggctctcttggaaaccatgataaggacattctctctgataggatttgaatctgatccaagctgccttcaaaccttctgttggagcttgagaaaaagaagagatcttctcctgcagtaattttgtcactgaatcatcaaggaagtggatcatgaatgcattcttcgtgtcagtccaattggttagtgaacctggttctagctgtcgcagccataatgttcctctacccgcgagagaatgtgggaagagtttgcaaagaagataatcagctggtacacctgctgctttgattgaggacactaagtcttcgaagacttccagatgatctagtggtgattcattagaatgtcctcgaaactttcatcgtgaaacaagagtatagtaggcatggtgaatagcaaagtcttctcttgcaaaaggaggtaggcggatcgctgatagattggagtagaaaagatcaactctgttgaagtcacctatggtagctggtctgttctgtagatggtgaatagcaaagtcttctcttgcaaaaggaggtagctggatcgctgatagattggagtagaaaagatcagctctgttgaagtcgcctatggtagctggtttgttctgcagatggtgtcgatcgacacctagttggtgtcggtcgacactatcgtcgaaatctgccagcagtttgttgcgttccatcttttaactcccttgtcacaggaaaaagaagaaagaaaacgcgtgagaaacaaaataaagaaaaataaaagctagtctaaattctacacctagtctaatggtgaataaaagagaacttcggcaacggcgccaaatttgatataggtcaaattaatcttaagaccactctctcaaataaagaggtcggttgcagcacttagggattgaattcacaaagttctcggatcacgcaatagactaatggcaaatcgaattatgctaagtaaaacactaaataaaataaagggaaacaaaattaagcaatagcaatcgattggatggttgtaaaacaagataataaaagcgtcagccttagggaattttcaggaaatagatgatagtagatctagaaataactaaattgttatcgaaccgttctcaaactcaaactatgattttagagtaaccggtggcattccgcgaaactctctatacttagagctaagataaccggagaagccgagaaatcctaaactaaagcatgcattattatcaagtttgattagttcacctagtatctaaagaagagcccttctatgagcctacatgttctttcttaaatgcctatgttcatctatgatggatcaaataacaagtacctatggcgggcatacctattatctaatatcaagttctagttagctactctagaattaacattaagcataatcaagatgaagaatcctacagataacctaacaagggggcaatctactaaatcatctaaatccctaatgagaaaccctaaacctaacaagtggataacttagacatgatcaaagaaacacaaatcatagtctgaataagaaatcaatgatgaaaataacaagagaaaagagtaagaaagatccaaagggagtttctacagggttttgctcccaaagtacaaaagagatataaaatagcctctccaagcttaggtctaaaacaatgacctaaaaactatataaatgtctttaaaacgtgttgggccttaattaaacataggagaaagttctgggccgaatttgaaaatcttcaaaacatcaataagttgcgtctcaaatacgtgcgttttcgtctccagattgcttctgcagcttaagttgtcagttgatttctaggatgctccataatatccaaatgcatcccaaacatgtaaagacctgaaaaggattagaaaagactctagaaataacaaatagactctaaaacctaaacctaaaacataattaaaaacggtaaaaatagggatatatcaattaagaacaactaatccagaagggatctataaatcaaactcaaccacatagcatactgcgaattctaactactctaacccatcctcagaaacctagtcactactcagacatcattgcataaagcataaacgatgataagaatgaaaacatgatagcaattgagtaatagcaagatgataacagaatgcaaggtctccaagtgcaacaaaaagttttcaaaaattttgcactccactggattgtgtactcgatctctaggccttttgtagagtaaagtctttatgagtctttggttatgtattttctaacaaggaaacactactttagcttttgggatccgtttgcggttctatatcttatactcaatcatacacatgacatcgagtcatctttgactccaaaacactaaacaagctacttcttgcttctcaatgctttgatgatgtagccgaaggccgtatgagtttttggttttggatcttctaataaggaaacactactttagcttttgggatccggttgcggttctagttcttatactcaatcatacacattacatctagttataattgactcttaaacactaaccaagcttcttcatgcttttcaaagcattgatggtgaagccaaagtccgtgtgaatcttcggctttgtatcttctaaccaggaaacactaatttagcttttgggatcttattgcggctctagttctaatactcaatcacacacatgacatctagtcatatgtgacaccaaaacactaaccaagcttcttcttgcttctcatagatttgatggtgtagccgaagtccgtataagtctttggatctgcatcttctaacaaggaaatacttcttaggcttttaagatccacatgatggtgtagcggttctagttcttatactcaatcatacacatgacatcaagttttgtttgactcccaaacactaaacaagcttcttcttgcttctcaatgctttgatggtgtagccgaagttcgtatgagtctttggctttgtctcttctaactacgaaacattactttaccttttggaatccgatagcggttctaattattatactcaatcatacaaatgacatctagtcatatttgactccaagacaccaactaagcttcttctagcttctcaaacatttgatggtgtagcaaaagtttgtatgagtctttggctctgtatcctcgaacaaggaaacactactaaggttttaagatccacttgtggttctacttcttatactcaatcatacacatgacatctagtcatatttcacaccaaaacactaaccaagcttcttcttgcatctcaaagatttgatggtctagcgaaagtgcgtataagtctttggatttacatcttctaacaaggaaacatttgtttggcttttcagatctggttaaggttcttgttcgtatactcaatcatacacatgacatctagacaaatttcactctcaaacactaaacaagcttcttcttgcttctcatagatttgatggtgtagccgaagtccgtatgagtctttggctttgtctcttctaactacgaaacattactttaccttttggaatccgatagcggttcaagttcttatactcaatcatacacatgatatctagtcatatttgactccaaaacgctaaacaagcttcttcttgcttctcaatgctttgatggtgtagacgaagtccttatgagtttttggttttggatattcgaatagggaaacactacttttacttaaccttttgggatcttgttgcggttctagttcttatactcaatcatacacatgacatctagtcattttttactctaaaacactatccaagcttcttctttcttctcaaagctttgatggtgtaggcgaagtccgtatgtgtctttggctttgtatcttttaacaaggaaacacttcttaggcttttaagatccggttgcgcttctagttcttatactcaatgatacacatgacatctagtcatatttgacaccaaaacactaaccaaacttcttctcgcttctcaaagatttgatgatgtttccaaagtccgtgtgaatcttccgctttgtatcttctaacaagggtacactaattaagattttgggatccggttgcgattttagttcttataatcaatcatacacatgacctccagtcatatttgaatccaaaacagtaaccaagcttcgtcttgcttctcaaagatttgatggtgtagccgaagtccgtataagtctttggatatgcatcttctaacaaggaaacacttctttcgcttttaaaatccggttgcgattctagttcttatacttaaacatacacattacattgactcccaaacactaaacaagctcgttcttgctttttaatgctttcatggtgtagccgaagtccgtatgagtctttggctttatatcttctaacaagaaatctctacttaggattttaagttcttgttggggttctagttctaatataaaatcatacacatgacatcaagttattttcactcccaaacactaaacaagcttcttatttcttctcaatgctttgatggtgtagccgaagtccgtatgagtttttggctttgtctcttctaacaaggaaacactactttaccttttcggatccgattgcggttctaattcttatactctatcatacaaatgacatctagtcatatttgactccaagacaccaactaagcttcttctagcctctcaaacatttgatggtgtagaagaagtgtgagaccttgttgcgggacacgggcgttacaagaagtttgtatgagtctttggctttgactcctctaacaaggaaacactacatagacttttaagatccagttgtggttctacttcttatactcattcatacacatgacatctagtcatatttgacaccaaaaccctaaccaagcttcttcttgcttctcaaagttttgatggtgttgccatagtccgtgtgaatcttcgtctttgtatcttctaacaaggaaacactactttagcttttaggatcttgttgcgattctagttcttatactcaatcatacacatgacctctagtcatatctgaatccaaaacagtaaccaagcttcttcttacttctcaaagatttgatggtgtagccgaagtccgtataagtctttggatctgcatcttctaacaaggaaacatttctttggcttttaagatccgcttccggttctaattcttatactcaaacatacacatgacatctagacatatttgactcccaaacactaaacaagcttaatcttgcttctcaatgctttgatggtgtaaccgaagtctgtatgagtctttggctttgtatcttctaacaagataacactacttaggattttaagatcttgctgggcttctagttctaatattcaatcatacgcatgacatcaagttattgtgattcccaaacactaaacaagcttcttcttgcttctcaaagctttgatagtgttgccatagtccgtgtgaatcttcggcttcgtatcttctaacaagtaaacactactttagcttttgggatccagttgtggttctacttcttatactcaatcatacacatgacctctagtcatatatgaatccaaaacactaaccaagcttcttcttgcttctcatagatttgatggtgtagccgaagtccgtattagtctttggatatgcatcttctaacaaggaaacacgtctttcgcttttaagatccggttgcgattctagttcatatactcaaacatacacatgatatctagacatatttgactcccaaacactaaacaagcttgttcttgcttcttaatgctttcatggtgtagccgaagtccgtatgagtctaaggctttgtatcttttaacaagaaaacactaatttacattttgggatccttttgcggttctagttcttatactcaatcatacaaatgacatctagtcatatttgactccaagacaccaactaagcttcttcttgattctcaaacctttgatggtgtagaagaagtttgtatgagtctttgtctttgtatcctctaacaaggaaacactacttagccttttaagatccgtttgtagttctagttcttatacttactcatacaaatgacctgaagtcatagttgactccaaaacattaaccaaacttcttcttgcttctcaaagctttgttggtgtagccaaagtccgtatgagtctttgactttgtatcttctaacaaggatacactacttgggcttttaagatccggttgtggttctagttcttatactcaatcatacacatgacatcaaattatatttaactccaaaaaactaaccaagcttttttttttgcgtcttatagttttgatggtgtagcagaagtttgtatgaatctttggctttgtatcttaaacaagaaaacactacttaggcttttaagatcttgttgcggttctagttctcatactcaatcatacacatgagatcaagttatatttgactcccaaacactaaacaagcttcttcttgctgctcaattctttgatagtgtagccgaagtttgtatgagtctttggctttgtctcgtctaacaaggaaactctactttaccttttgggatccggttgcggttctaattcttatactcaatcatacaaatgacatctagtcatatttgactccaacacaccaactaagcttcttctagcttatcaaacctttaatggtgtaacagatgtttttatgagtctttggctttgtatcctctaataagaaaacactacttaggcttttaagatccagttgtggttctacttcttatactcaatcatacacatgccatctagtcatatttgacaccaaaacactaaccaaacttcttcttgcttctcaaagctttgatggtgttgcgaaagtcagtatgaatcttcggctttatatcttctaacaaggaaacactaatttagcttttgggatctggttgcgattctagttcttatacttaatcatacacatgaactctagtcatatttgaatccaaaacagtaaccaagcttcttctttgttctcaaatatttaatggtgtagccaaagtccatataagtctttggatctgcatcttctaacaaggaaacacttttttgtcttttaagatccggttgcggttttagttcttatactaaaacatacacatgacatcaagttatatttgactcccaaacactaaacaagcttcttcattgtctcaatgctttgatggtgtagccgaagtccgtatgagtctttggtttgtctcttctaacaaggaaacattactttacatttttgggtccttttgcggttctagttcttatactctatcatacaaatgacatctagtcatatttgactccaagacaccaactaagcttcgtcttgattctcaaacctttgatggtgtagcagaagtttctatgtgtctttgtctttgtatcctctaacaaggacacactatgataataggtttttctggtcaattatcctaaaacaccaatcatgtcgttgtagtattttaggtgtcaatccaaatgggtgtgatgcaaacagatgaaatgtgatcagaagtcactaagtcaagccaagcaataacagttttggggtttctaacagtcctaagcgaacatgtagaaaacagaagcaataacagaattactaaaatcactcgaccacaacaggctgatgccagaagtaggatgtggtcgagtaacaggtcgagtaacagacaagatatgaaacagctatactcgactgcacagtctgttgccagacactaggtgtggtcgagtatactggtcgagtaacagacaggaaacaagacaatcttactcgactgcacagtctgttgcaagacactgggtgtggtcgagtaagatggtccagtgattgtaaaaactaagaaacaggcaatgagaacgattaagcgataacgataaaacagagaaataagatagacgaaaaattcctaaggatggggtaatcgagtagagtggtatcctagcctatttgaatggttaataagcgcaatcaagctatccctagacaacaggttcaacaacagatcaattcactcccgtgatagaaatcctcaagcaaagctagcccaaactaattcccattaacggaatctaactatgcaggcaataagaactgactgataaagtcaataaacgctctaaacggcaaatcccttgggatagagacgcatatctcaggaactagtggatcaagcattccatcgaacaccttctgggtgcgggaatgcttgggatcgaattccaattgatcagaaagaaataagcagtaaacgcaactagtcctaaagggattcaatcaattctaaaacttaaccattctacagactacggattccacaactactctatcctatccctaagaattctaagtcactacttagacaacatgctcaaagacataaacgcagataaacgataatattgcataagtaaagagagaaagagtagagaaacaagatgacaaatgaaatcaaatgcggaatctgaataacttggaaaaatctcgaattacaggttgtaaaagcaaaagcggcgcagtagagtaaaacagaaaataaaactaaagcaaaaactcaatgtcgactagatgtctcaggacagaaccctaagacatctatttatacaaaacgaaataaaatgatagtagacgggccaataacctaatcgctcggcccatagagagataatgggccgagatgggcttcgtgatccgatggaagtccaggccgcttccaaacactttgtcttctcctcttctcttccttgtgctcagcttgtctggttgagtgcggatttgagtagactgtgaagacgtgatcgagtgtccggtcgagtgatgctgatggtggtgagtgatgatactcgaccagggggtcgagtaacttggtagagtgaatggtcgagtgatggtgatggtgtggcgaagtgatacttgaccgtggggtcgagtggtgtggtagagtgaacggtcgagtgttgtcaggtggtgtggtgaactgatactcgaccagggggtcgagtagtgtcatcgagtggcctgacctgaggttactcgacctggtggtcgagtggatgggaagaatggctccaaagtcactcgacctgggggtcgagtatgtgggaagaatggctccaaagtcactcgacctgggggtcgagtatgtcttcttgttctggctcgtttcttccaatttgcttgcaaacagctccaaatcacctgaaaaaaactcagaaatgcaatatgtatgcaaagctatcctaatcatgcaaagtatgcaaggatgatgagaaatgatataaaacagtgatgaatgatacgaaactggactcaaaacgatgatgaatggacattgaaaacatgcaaattatagatatatcaactctcccaaacttagtctttgcttgccctcaagcaaataagaagacatagttgaaggagaggagtgaaggcggggactcagaaccaaagcatatgatagagcaaataaaatcaatgtccaagttggtagttttaagatgcgatatgattgaatattactcaaaaacgttagtcatgccttgttatcaatcaatccgtctcttatactcgacctacacatgctttcaaatctaccaatccctttaacattcattagttctggaatgtgaatcaagcagtgcatcatgaatgaactcatttggctaaggtgaaggtcaagagacaaagatggtccctaacagaataggcttaagtaacaggggatccctcaagaatgattgagctttggtagaatgctaaaggtaagtcccaggttatgcatacaaagataagatcccatctacccagagtataacaatgaagttctaatggtaatcccaactcttgtcccaacttaactctaccctttgcactcatgaatctttcaaactctttttcatatcattcttttcttttctcttaactcaaggagaagctttctcaacgctctgatacatctagcgggtttggatttctttaacaactaaggttcctgtttttttttttctttaaaaccaaaggcttttaacccttcttctttagctaacaagaacctcattcttttctttaacattcccaaaacctttactagattttttttctaacttctttagcttacttcccctagaattctttccctttcctcatcaacaatgaattccctcttttcttttaaacacatcccaacccatgatataagcgcccacctagtcctatctagtccgaagaacgcgaactagaactacatgagacactatctctgtcgttacgaacctaacactttctaccaagctcaatcgaaataagacctcacaaacactcacaagtgatatagggcttgaaagaaagttcaggtttgggtatgggttaactgctctaataaggagagtcagctacttggatcaacaagagtggttaaaatgagtaagaaaatccaagtattttagggtatccatgagttcaaattcgatgccaagacatgataattctaaatcagattcaagttcaaattgatagggaatcatatcagatcctaacagtgtggtcgagtagagcaatctaggcatggtgcagttttacttcaatttcaatgacaacgcatcaaacaactaacaacgagggcactgagcttatctggtgaaccaaaatgcttacaaggctatctcatcattatcccctatgcatatgcaacaatcctaaacgaaacactctagactcaatcctaaatgcaatgcaactacatgaacactctatttttgtgaaaccattttctgaaatttttcaatttttttagtttttctatgccttagatgaatgcagactcaagattatatacaatgcaacacacacttcctgagccctcccccaaacttaaatcacacagtccactgtgtgactaaatttggaagagagtactcaggacaaaacacatcacaaaaacaaaataaaaacaagagatggtatattacagtggtggagtgaggtgcatacctcagtggaagaaggagcggagttggtcgtcaatagctgcctgtgattgctcccaggccatcgaagaatctccctgttgtgtctcagcttccccctgggggtactcgacttttgctccttcgtcgcggccagcaccgctatgatgatactcgacctctcttcttctgctgcggccagcaccgcggtcgcgtaagctacgggactggagaagtcgtgactacatcattcgctatactcgaccacatcgtcattcggtctctatagggtgtggtcgagtgatttcctggtgtgaagaagccagaacaatgtcgagtttgattgctctgtggtcgagtgtattgctgttccttcaaagccagaatctatttccagcaactcttcaaacttatctcctgaaaacactaacaagatgcatcaaaaacaacaaggaaaatgaaagatatgtacaaaggtaggcttgggacttcctcccaagtgagcttgttttaggtctctagcttgactcctcatactcattaggcgtttaaaggctcctccaaaggaacagaggttccttctggaataaactgatctatcatgtatttcttgagccgctggccattgactgtgaagtctccattctttccagctagagtgataacaccataaggttggactgcagtaacagagaaaggaccagaccatctagacttgagcttgcctggaaaaagcctcaggcgagagttgaacagcaacacttgatcaccaaccttaaaatctcttgagactatcttcttgtcatggaaagacttggtttgctccttgtagattttggaactctcataggcttctaagcgaatctcgttgagatcgttcagttggatcaaccgcttctcctcggcggttttaatgtcgaagttcaggagtttaactgcccacatggctttatactcgagttcaacagacaaataacaggattttccatagaggaggttgaaaggagtcgtgccaataggggtcttgaaggctgttctgtaagcccatagtgcgtcatcgagcttagcagaccaatctttccttgtacttctcactgttttctctaaaattgcttttatctctctgttggagatttccacctgcccgctcgtcagtggatgataaggagtggctaccttgtgctttactccatgcttcttcaaaaggttctaaaaaaccttgttgataaaatgtttccctccgtcactgatcacaattctcgggactccaaatctagggaagataattgtcttgaacagctttagcacaactctagcatcattggtgcggctggctatggcttccacccattttgatacatagtctactgcgaccagtatgtacttgttcccgtaagaagaaggaaacggacccataaaatcaattccccaaacgttaaagatctcaacttctaagatcggattctgaggcatctcattccttctactgatgttccctcttatttgacatgaatcacatttcgagataaattcctgagcatccttaaacattgatggccaccaaaaaccagcttgcaggattttcgacactgtcttgaacgttgcaaagtggccaccataggcagacccatggcaatgcaatagggtgccttcgatttcgtcttctgagacacatctcctgtagatcttatctttgcagagtgtgtagagataaggttcgtcccagtagaaatggttaatgtccttgaagaacttcttcttctcatagctcgacagattcggaggctcttcaccactaaccaagtagttgacgtgatcagcataccacagaagcttttcttcaattgcacatacttgatcgagtgatttccgaatttgagcactctcgttaagttgctgaattgccattagctgttcttctggcatggagtcgtcaatagggacctcgtcttcaatcctcatcctagacagatgatcagctacaccgttttcaattcccttcttatcaactatctccatatcaaactcttggaacaataagatccatctcaacagcctaggtttggtatccttcttcgcgtatatatgcctcagagcagcatgatcagtgtagactgtcactttagaacccactaggtagcttctaaatttttcaaatgcaaataccacagctagcagttccttctctgtagtggcataccttacttgtgcatcatccatcgttctgctcgcgtagtagatcacatgcagctttttatcaatccgctggcccaagactgctcctactgcgtaatctgaagcatcgcacatgatctcgaatgggaagtcccagtttggaccttggactattggtgcagtgatcaaagcttccttgattaacttaaaggctgtcaaacattcatcatcaaatgcaaactcggtttccttgcacagcagtctggtgagcggtcttgccaacttggagaaatccttgatgaatcttctgtaaaatcctgcatgtccaagaaaactcctgatgtctttgacagtttttggtggctgtaactgcatcatcacgtcaaccttagccttatcaacctctattccctcctcagaaattttgtggcccaaaacgatgccttctctaaccatgaaatggcatttctcccagttcagcaccatgtttgtctcttcacatcttttaagtaccctacacaggttcaacaaacacgaggagaaggaacagccatacacagaaaaatcatccatgaatacctctaccatctcctctatcaaatccgagaaaatagaagtcatacaccgctgaaaagtagctggtgcattacatagaccgaaaggcatacgcttgtaagcaaaggtcccataaggacaagtgaaagtggttttttcttggtcatttgggtgaatagggatttgaaaaaatccgctataaccatacaaaaagcaatagtaaggatggtttgctaatctttctagtatctgatcaatgaagggcaatgggaaatggtcttttctagaggcagcatttaacttcctatagtcaatacacatcctatgtccagttatagtcctagtgggtatcagttcatctttagaatttttaacaactgtcatacctccttttttaggaacgcaatgaactggagatacccaagtgctatcagagatagggtagataaccccaacatctaatagattaagtatctcctttttcacaacctctttcaagttagggtttaatctcctttgaggttcaatgctagagtaggattcattttcaagatggattctatgggtgcataaggtgggtgaaatccccttaatatcatctaacgaatatcctatagctttcctatacttcttgagctcagttatcagcaggtttacttgatcagcagttagctcatcattcactatgacacgataagtagagtttagtccaagaaaaacgtaccttagcccttttggtagcggtttcaaatctactttgggtgccttgagttcagaccagtcatcggatactaagttggctcagagaaggtgttgtggtcgagtagctcggtcgagtacaccgaatgggctgttggtcgagtgatgtggtcgagtatatattcctcccttgctctttcacccaaatcttcatactctcctggattctcaactgctttgtgttcatctatcagcttctggtaccccaaagtctccaaatgtaaatctccttccttgctatcctttgttagagcactctgtagatgatctgtttctcccagctcttctagcatttcgtgagctaacatatccatctcttcaatccagaaaacatttccttctatcgtaggcttcttcatggtgttggtgatatcgaaggtcatcttgagatctctcccgaggttaagatcgatttttcccttcttaacatcaatgatagctccagctgtagctaaaaatggtcttcccagtatcaaagggtctttgggttcttcatccatttctaaaaccacaaagtttgtcggtacttcgaccatgcctatcatgactggtaagtcctccagcagaccatggggaatcctaacagatctgtcagctaggatcaaggatatattgtagggcttgtacttgttgaagcccagtttctttgccacagagagaggcatgagactcacagatgcacctagatcacagaggcacttgctgaaggctaaagggccaagagcgcaaggtaaggtgaaggaaccaggatctcctagtttttttggaatgatcttctgctgaatgatcgcactgcatttgtgacttagcaccaccattccttggacttctttgatcctctctgtaatcatgtctttcacatatttgttagagtctggtataagtgcaagacagtcgacaagaggcatcgtgacttcaagatttttcaattgtttctccaggagagctttgtacttttgtatcatgaccttcttgaatcgcccaggaaatgggagtgggggcttgtaaggtgggggaacgaagacgttgtctttggttttggcggcaactggtttttcaacaagaggaaatgctgcaggagctagtgatcgagtaggttggtcgagtataggctcttctattgctttttcagcggaatctccattctgacagaaatcctccccatcttgatctacactgtcctcagtgttctggttcggactctcttttgtgggtaattctttaccgcttctaagtgtgatagcatgagcgtactcctttggatttggcattgattttccggaaggtcctgtaaatttgggtgctgcggtcgacccagtttggccttctatgtatctgatcttagatgtcagtgcttcaaccttgatattgatatcattgtaactacagtcaaccttgttgtgaatttctgccatcttttgcacaaatccattgctcctgttgcttgcccttggagaatctgctgtaacatgttcttcaagtctgaatctggagttgttgaagctggttgttgttgctgctgtgtgaacccaggtggtggaagttgctgctgatagttgccctgatactgctgcttaggaacatacccttgaccttggttgtaaggaacaaagggcttgggttgattctgctgctgtgaagggtagacttggtcctgcgggtttacaacgtttgtacttctgtaagacagattgggatggttctgcttgaagttgttgaaacctttgttgtaacctccttggttctgcacatagctgacctcttctgactgcagagtctccccatcctgaacttggaacgtctcatcatcacccagaaaatgaatgtgcttctgttgcacaaggagtagcttgtccagtttgtcattcatggctttcatttccctgcggtgcttctcatcagaatcagagctggtgcggatgcgtctgtcataatcttcattatagttgccatccgactgagccaagttctctaccagctcccatccgtcttaacatcttttttgaggaagttcccgttagaagcggtatctagaagcatcctgatcttgggaaggacacctctgtagagagtgctgagaagtgaagctttggagaaaccatgatgaggacattgcgtctgataacctttgaagcgctcccatgcttcacagaaagtctcattattcgtctgagtgaaaccggagatatcattccttagtctcgcagtcctggagtttgagaaaaacttagccaagaaggctttcttgcagtcattccaggaggtgatagagccttgaggaagtgacttttcccactaatgtgctttgtctccaagagagaatggaaacaatctgagcttgaagccatcctcactgacaccgttgatctttgttaggctgcagagcctatcaaactcgtccaggtgatcgagtggatcctccatagggaggccgtggaacttgttattctgaaccatggcaatgagaccgctcttgatctcaaagttgttgttctgcataggtggaggcacgatgccattacgctgattgtggttgcgtggtgcatcgcctgcacctatgttgtttggttgcacctgctcatcaacaactgcagccattttgtctgtttctgtctgtgctctgagttggtgtgcaatacggtcgatgttatcgttgaacaggagattctgatttcctcgtgaccgtgtttgcatacaacgagtaccaactggtgaagctggtgattcgtagtacctgaatcaaaacagacaaacacaaagttagtaactttcagagaaaattaaaaagaacttgatcttaaatattctgaaatctcaaatatagcaaacaaacacccaattggcaacggcgccaaattgataataggttattatggtcaattatcataaaacaccaatcatgtcgttgtagtattttaggtgtcaatccaaatgggtgtgatgcaaatagatgaaatgtgatcagaagtcactaagtcaagccaagtaataacagttttggggtttctaacagtcctaagcgaacatgcagaaattagaagcaataacagaattactaaaatctctcgagtaacaggtcgagtaacagacaggatatgaaacagctatactcgactatacagtgtgttgccagacactgggtgtggtcgagtatactggtcgagtaatagacaggaaacaagataatcttactcgactgcacagtctgttgccagacactgggtgtggtcgagtaagatggtcgagtgattgtaaaaactaagaaacaggcaatgagaacgattaagcgataacgataaaacagagaaataagatagacgagaaatgcctaaggatagggtaatcgagtagagtggtatcctagcctattcgaatggttaacaagcgcaatcaagctatccctagacaacaggttcaacaacagatcaattcactcccgtgatagaaatcctcaagcaaagctagcccagactaattcccattaacggaatctaactatgcaggcaataagaacagactgataaagtcaataaacgctctaaacggccaatcccttgggatagagacgcatatctcaggaactagtggatcaagcattccatcaaacaccttctgggtgcgggaatgcttgggatcgaattccaattgatcagaaagaaataagcagtaaacgcaactagtcctaaagggattcaatcaattctaaaacttaaccattctacagactacggattccacaactactctatcctatccctaagaattctaagtcactactcagacaacatgctaaaagacataaatgcaaataaacgataatattgcataagtaaagagataaagagtagagaaacaagatgacagatgaaatcaaatgcggaatctgaataactttgaaaaatctcgaattacaggttgccgaagcaaaaccggcgcagtagagtaaaacagaaaataaaactgaagcaaaaactcaatgtcgactagatgtctcaggacagaaccctaagacatctatttatacaaaacgaaataaaatgataatagacgggccaataacctaatcgctcggcccatagagagataatgggccgagatgggcttcttgatccgatggaggtccaggccgcttccaaacactttgtcttctcctcttctcttccttgtgctcagcttgtctggttgagtgcggatttgagtagactgtgaagacgtgatcgagtgtccggtcgagtgatgctgatggtggtgagtgatgatactcgaccagggggtcgagtaacttggtagagtgaacggtcgagtgttgtcaggtagtgtggcgaagtgatactcgaccagggggtcgagtagtgtcatcgagtggcctgagctgaggttactcaacctggtggtcgagtggatgggaagaatggctccaaagtcactcgacctgggggtcgagtatgtgggaagaatggctctaaagtcactcgacctgggggtcgagtatgtcttctggttctggctcgtttcttccaatttgcttgcaaacagctccaaatcacctgaaaacaactcagaaatgcaatatgtatgcaaagttatcctaatcatgcaaagtatgcaagaatgatgagaaatgatataaactgtgatgaatgatacgaaactggactcaaaacgatgatgaatggacactgaaaacatgcaaattatagacatatcacactacttaggcttttaagacccggttgcagttctagttcttatactcaatcatacaaatgacatctactcatatttgactccaaaacactaaccaagcttcttcttgcttgtcaaagcgttgatggtgtagccgaattttatatgaatcttttgctttgtatcctctaacaaggaaacactacttagccttttaagattcgtttgtagttctagttcttatacttaatcatacaaatgacctgaagtcatagttgactccaaaacattaaccaaacttcttcttgcttctcaaagctttgatggtgtagccaaagtccgtatgagtctttgactttgtatcttctaacaaggaaacactacttgggcatttaagattcggttgtggttctaattcttatactcaatcatacacatgacatcaaattatatttaactccaaaacactaaccaagcttttttttttttgcgtcttatagctttgatagtgtagccgaagttcgtatgaatctttgtctttgtatcttctaacaaggaaacactacttaggcttttaagatccggttgcagttctagttcttatacataatcatacacatgactacaattcatatttgactccagaacactaaccaagatttttcttgcttctcaaagctttgatggtgtagccgaagtctgtatgagtctttggcttcgtatcttttaaacaaggaaacactacttaggcttttaagattcggttgcggttctagttttatattcaatcatacacatgacatcaaatcatatttgactccaaaacactaaccaagcttcttcttgcttctcaaagcattgatggtgtagccaaagtccgtatgaatctttggctttgtatctactaacaaggaaacactacctacgcatttaagatcaggttgcggttttgcttcttatactcttataagtagtttttttaggcctacttatgtgctgaagtgtggtgtgttcagttcaattacccttaaccactaacatgtcgatgcagctataggggctgtcaatcctgtccactgttattgctagcaatcaagatgtgtacagaagcaactaagtcaagccagattatagagatggttggtttctagtaacaatcctacgtcaagattcgaatagcaaaaataagaacttaagagccctactcgatcattgggtcgagtagaaccaacaggcaacaaatttaagaactaaaatgcaatcaacagaacatgtaaataaaagtgcaatcagggggtgaatacaaataaatctaagaagattagaagtcctaaggatgaattcattgataagggcaactctagggttcattaggtggctaacaggcgaaaggcagataccctagacgatagattcaaaaaccgggtcaatccactctcgtgacagagacccccataactctaccacttcctaatctcaactctcgttgatgaaacatagcagaacagggtttaagcaacaatttaccaaagccaataagcagtctagccaatctcttggtctagagtctacaaatctgtggaattcgtagatcaggcatccatttgaacgtcttttggacgctggatacctatggtcgaattttcacattagccagcgaaaaccgcataggggccaacgaatctagaagggatctaacctaatcttaaccacctgactaacctagacattaccctaatcttatccatcctcaagaaccctaatctctactcaagcatcataactaagaacacaaacccagaaattactgaaatcataccaaaatgcaatcaacagaacatgtaaataaaagtgcaatcaggggtgaatacaaataaatctaagaagattagaagtcctaaggatgaattcattgataagggcaactctagggttcattaggtggctaacaggcgaaaggcagataccttagacgatagattcaaaaaccgggtcaatccactctcgtgacagagaccaacaagctaaacaactttactcaaagaactaaatgcaaaaacaaaatagattaagagtaattaagttttgaatattcaagaacacaaagaaaaacaaagagataaaagctagatcctttggacacatcccaaagtgatctatgtatactaaaatgttgaaaacctagattcactagaagacaagagacttgaacggtttgggcgagtgctcgatcttggggatcgagtaaagagtgtgcggcaaagtctacgcctttctgtccatgctccgagtgatcaattggtcgagtagttgcttcttcctctcatattcttattcgcaatcaagatgtggatataagcaactaagtcaagccagattataatgatggtgggtttctagtaactatcctaggtcaggattcaaacaagtaaaaatgagagcttaagagccctactcgatcattgggtcgagtagaaccaacaggtgacgaattaaagtaactaaaatgcaatcaaaaggggatacaaataacaggtaaataaaagtgcaatcaacaaggaatacaaataaatctaatagaagttctaaggatggattcattgataagggcaactctagggttcattagatggctaataggtgaaaggtagatacccttgacgatagattcaaaaatcgggtcagtccactgtcgtgacagagacccccataactctaccacttcctaatctcaactgtcgttgatgaaacatagcagagcagggtttaagaaacaatctaccaaagccaataagcagacaagccaatgtcttggtcgagtctacaaatctctggaattcgtagatttgacatccatttgaacgtcttttggacgctaaacgtctatgatcgaatctccacattagccaacgaaaaccgcatatgggccaagcgaacccagaagggttctaacctaatcttaaccacctaacttacctagagattaccctaatctaatccatcctcaagaaccttaatcactactcaagcaacattctcaagaacacaaacccagaaattattaaaatcataccaaaatgtagatctaaacaagttaaacaaatttacttaaacaactaaatgcaaaaacgaaatagattaagagtaattaagttttgaagattcataaacacaaagaaaaactaaaggataaaagatagattctttggacaaaccccaaagtgatcaatttatagtaaaatgttgaaaccctagattcactagaagacaagagacttgaggcggtttgggaggatgctcgatcttggggatcgagtaaagagggtgctgcaaagtctgcgcctttgtgtctatgctccgagtaatcaattggtcgagtagatgttccttcctctcctatatatatgcttagatgtctggttgagtggggaatgaggaggatccaaagacgctttgatagatcaacaagtcttgtagagttggtcacccttggtcgagtaaatgggtcgagtagaggatcaagtaggaggggcgagtagataaatctgctgcttccactgaggctgccttgagcgactaaaggggtcgagttaattgcagtctcctctgtagctgcctggatcgagtaaagaggtcgagtgaattgatgcctcttctgtagctgcttggatcgagtaaatggatcgagtagagtccttttagctccttctgcacctgaaaacacaccaaaacatgcaatgcatatgcaagatgatcctaaatgcctaagaatgcaaaataagctaaaatggtgcaaaatgatatgatacaatgagcaaatgcacagctaaatgatgataatcatacacctaaaatgagtaaaatacagtgttatcaccttctatgctccttctgcacctgaaaacacaccaaacatgcaatatgtatgcaagatgatcctaaatgcctaagggtgcaaaataagctaaatgtgatgcaaaatgatatgatacaatgagtgatcaaaaagctaaatgatgataaatacacacctaaaatgagtaaaataaagtgttatcaaatcccccaaacttatatcttgcttgccctcaagcaaacaaaaaatcttaagttgaaggagatgtttgaaggtggggattcaaaaaccaaagcatgcatatagaatgggtaagctcactgtccaggtagctaattctaggttgcaagatgatagacccttacttaacaactttagccatactcgtcacaatgcaacctaacaacctgccttaatctattcaagcattcacatcaaccaattccctttaacattcattaagcacgaacagtggatcaatcaatgcaatggttatgaacttacttggtttcaggcttagggtaagagacaaaaatggtccctctaatgatttggtcgaataacaagggactctcagagaaaagattgagcttcagcagaatgctaaaggtaaaagccaacggacacatacaagaacagactcccatctattatgaaagctcagaagatgatcccactcccttagatgtcctaactctacccttattctcattctttctctcttttggttcaagttctcaagggtgcttctttaaaatgattcaagagtctagcgggtttggttttaaactttggtaaacttaaggcttttcttctaaacttatagcatagagggcgttttacccttttctttgaatcacaatgcctaacttcttactctcttttttttttcttttcttttcattcctattccctttcccattcaatccatacacaatcctaatcccaaatacaagtctccacctagtcctagctaacccaaaaagcgtgggctaggtctacatgaatgactgctcttgtcggctcatacctaacacgttataccaagctcaatcgaaaaagacctcacaatcacacacaaattatctttggcttgaaataaggctaggctcagggtatgggaaactgctctaaaaatgagagtcagctacttggattaacagggggtggtgaagtaaataagataatccaaatatgtatatgttagccatgagttcacaaacaatgcatagacatgataattgcaaattcagttcagcttctaatagatagggaatggcataagataagcgagtttcgaatcaaagcagtatagtcaagttgtaaattcaaagcagggtgcggtcttacttcagagaaacaatcggttatgcaacagagaactaacaacctgggcattgaacttacttcattgaatcaaaacatgcttaacggtttgaagtcatcattatcccctatgcaaatgagcaatcccaaaagcaaacactctatatacaatcctaagatgaaatgcaatctacatgacattatgtttttgtgaaatcatttcctgaaaattttcgaatttttgtggttttttctctaccttagatgatgcaaaatatgaaataagaaaagtgaacacaatgttaaacatgtcttcaaccctctccctaacttaaattacatagtcccttgtgtaataaaaatctgagaaagaattcaagaccaaaacacgaaacacacaaagaaaaataaaaatgctatggtatgtacaatggtggtggtggtgttaccttaggtgaagtaggtggagacaaggtcatccatgctctcctttgtgtagctccagggagcgggtcgtgctggacttggattagttgaaagaagtagtgaaaaaagaaattttgaaactgcttgatgttggtgtcatctaccctatctctgatagtacttgggtttctccagtgcattgcgtccctaaaaagggtggaatgactgttgtcaaaaatgaaaaggatgaactgatccctactagaactgtaactggtcatagaatgtgcattgactataggaagctaaatgttgcatctaggaaagatcattttcctttaccattcattgatcaaatgcttgaacgcttagctaatcacccatactattgctttcttgatggatatagtggtttctttcaaataccaattcaccctaatgatcaagagaaaactactttcacatgtccttatggaacttttgcttataaaagaatgtcattcggtttatgcaatgctcctgcaacatttcagaggtgtatgacctctatattttcaaattaactcgaggagatggtggaggtcttcaaggacgattttttggtctatggcccctctttttcctcatgtttgttgagtcttggcaggttattgagcaggtgtgaggagacgaatcttgttctcaattgggaaaagtgtcatttcatggtgaaggaaggcatagtgttgggtcacaagatatcagaaaagggtatagaggttgacaaagggaaaattgaagtgatgatgcagttgcagccaccagaaatggtgaaggacagaagaagtttccttggtcatgctgggttctacagaagatttattaaagacttctccaagatagccaggccgttaaccagactattgtgcaaggaaaccgaatttgaattcgatgaggactgcctcaaatcctttcacaccatcaaggatggtttggtatctgctcctgttgttcgagcgcctaattgggactatcaatttgagatcatgtgtgatgcatcagattacgcagtaggagctattttaggctagaaaatagacaagaagcttcatgtcatatattacgccagccgaacgttggatgaagctcaaggaagatatgcaacaactgagaaggagcttctagctgttgttttcgcatttgagaagttcagaagctatttggttggatcaaaggtcactatctatacagaccatgccgccttgaggcatctgtatgccaagaagaatactaaaccaagactgttcagatggatacttctattgcaagagtttgacatggagatagtagataagaaaggtattgaaaatggtgcagcttaccatctgtcaaggatgagaattgaagaacccattccaatagacgattcaatgggagctacagtgggaaagagtttcaccacttgaatgctgtttaaggaggatctccatggtatgttgatcacgtcaattacttggcatgcggagtagagcctcccaacctgaccagttatgaaaggaagaagtttttcagagacatccaccattactactgggatgagcattatctttacactctctgtaaagataagatctataggagatgcgtctcagaagatgaagtagaaggtatcctgctgcattgccatggctcagcatatgctagtcacttcgcgacgttcaagacaatgtcaaagattcttcaagcaggcttttggtggccaacaatatttaaggacgctcaggagtttgttccaaagtgtgattcatgccagagaaaaggcaacatcagaagaagaaatgagatgcctcagaatccaatcttggaagttgagatctttgatgtatgggggattgatttcatgggtccattcccatcttcatacggtaacaagtatatactggttaccgtagactacatatcaaagtgggtcgaagctattgctagtcctaccaacgatgcaaaagttgtgctgaagctgttcaagaccataatcttccagagatttggagttcccaaggtagtaatcagtgatggtgggaagcatttcatcaacaaagttttttagaacctcctgaggaatcatggagtaaagcacaaggtttccactccctatcatccacagacgagcgggcaggttgagatctccaacagggagataaaaacaattctggaaaagactgttgggattacaaggaatgactggtctgcaaagctcgatgacgcattatgggcttaactgacagctttcaagacccccattggtacaactcctttcaatcttctctatggaaaatcatgtcacctacctgttgagctcgagtacaaagcaatgtgggcggtaaaacttctaaactttgacataaaaactgctgaggagaagcgattgatccaacttagtgacctcgatgagatccgtttagaaacttatgagagctctaaaatctacaaggagagaactaagcttttccatgacaaaaagatcatcaccaaggatttccaagttggtgatcaggtgctgctattaaactctcgcttgaaactctttctaggaaaacttaaatccagatggtctggccccttctgtatcactgaggttcgtccttatggagcagtcactctagctggtaagagtggagatttcacagtaaatggtgacatcggttcatctctaggagcttcttgatgattaaaggagtaaaggagtcaagccaatgactttaaacaagctcacttgggaggaagtcccatgactatctctgtaaataattttttcttttcttgttatttttgatttgtcttagttgtgtttgtggttctcaagaacaaaggaacaacgtggagatagagtaaaaattcaaaactgttactctacagaagacctggagatcgagtgtattgcctggtggagtgcaaaattttgaaagttttctgttgcatcgggagcccctgaattcgagtacatcagtcaagtatatgtgatgtttaaaacccaaaaaaattttaatcatctttgtactcgaccaacaagagctacagagactttaaaggatttcctgcaatttacagtagattttctgcagtttttctcagtcaacagagtgtgaaccacgcactaaaaataagatggagagagaatgtcaaactcaacttccaccacatctttcgaaaatcactcgacctacctatcttcatttttcaaccactcgacctaattcaacctttcttcctcaacgcacctcaccacgattcactgtatcgcacttgaccccatcagattactcgaccactggaaaggcactcgaccgcttcgccgccgtcaccgagttcatttgcttctttactcgaccttctcaccttgctgttcaccgttactctgttctcaatctactcggatccctctgcgccgccgcagtcgagtccctacctcgttcaccatcgaagtcttagggactactcaattacaaagagaagactagaccgtcgacttgtagtttcgaccataccaattccggctcaccgaaggattactcgacctctggactttaccggctgaactcgacctcaacgtttcactcgacctcctggagccgaccactcgaccaagcttcacgtttcaagattccaggcttcaattccggttcactgaggaaccactccaccgctggtactagcaaatcggcagacccactcgacttcagaaaagttattcaaccgcggtctctacattactcgatccaattcgtgtaaaaggaactcgggaacagcttagtttactcgagtacaagattgtactcgtccaattcggtccatttcattgcctgttgataacaattttggtttcattgttatctttgagactaatatattgacatttgagttttgagttctaaatcttctacaggagaatcatgagtaattacagtggtagttcttcagttgatccagactacaacatggatgagatagagtcgtcatcttcgaggctagagagagaacagagaatatgatagcttcagaagaaaagctgagatagctcgagggaagagagcaatgacagagaggtatgagcttatagatgaggatcaggaagacgagtacatgcctgagcatactcactgagccaccaaacttctgcacaaacctgatgtatagcctgctgaggaatatatcaggctcttcaaacttagagttttgtagcacgagttatccatgcttgaccacacttgcacaacttggattgttggaggatgttcagcacctgtaccagagtttaagtctcaagtaacagaatctttgagaattagacgaccagttataagatggcatggtggaatgaaaggaaccggatcgagagaaaagatcgcggacttgccttgtcatgctcacgcgaagttcaatcgagaaggagaagaccttcaagattggcttgctggatccccacagaaaaagtgaaagttctaaccaagttaagaacgtcgacaatttatctcattgggaattcgggacgaattataatgagagggtgaatgtagtgacccggtcattgactataggggcggttgtggtaagaaattttgagtcggagttatatgccaaggggttgtaaggtcttgggaaaagacttataattggaatgctaagtaaaatcctcttacttgactaagtcagttttggtcatggaactggggaatgctgtgaccctcccatgtgagcgttccatggttgaggacggcctaacttgtggcctagatgattcttggaacggtcgaatttagagaaatatttgaagcataaattccgaaaatcgaggaaaaagcgtaagaaaagtaatcattggtcggagagagaaagtccaccttatttacaggatcgacacaatgattatatctctgccccaatcaaaagaaagatattgcccatggtataagttatcttccttgggcgaaatcaaggcaatatttcagttctgagcgaatcgttgggcaagttacctcttttggacaaaacgaggtaatgatgagcttcgccgcacaaacatcgagtcaatcatggagaacgagtgttgccatgagttgggcgacacaaactatgacccaatgacaaggtggcgtgtcccatagggttggacgacgcaaactccaagccaatcagaggaagagtgtccttgtgggttttgcgtcacctaagacacgacatttgtccatcatgggtcgaatctcctcctctataagtagaacaaaggctttggagctaaacagaaatcgtgagagagagagagatagattcaaaatcttcgtgaagtgacgaccgctcctgaagccgacggtagaggtggacgactgaattccaaacggtgtagcagtttccatgaaccatccgacgatcagtttccgaaggtagatgaagtcttcgcgatcaaccagaagttcccgatcgacgttgtcattccgctaagtgatcactctcatccgatccgcttaatcatagtgagttccgaagcatgtgtggtggcacatgagttaccttatgtgcttgctttgatgattatgtgcttgttgatgttgttgttgattgatcatagaattaataagaattatcatttacgtcatgtatgcttgatgcttcaagtacactttgtcgtagcttagttaaatgcatatagagtttgtggtgttcgagtgcgcttccctgttttgttcgactcagcgagactaggtcgctcccaaggggccgagtgttgcatgacgatgcaacgaggatacatgttgtggtagtcccatgtggtacatcgcttgtagacttggtggctaatagcggattgttcacttggtttgatgggaaggatcgttcacatggccatatgattgcattgttatcatttacccgtgcatccattatattgcattattattgcatattgattgcttgttgcttgttgcttaactaacgtttattgttatgggttgggttgtttagcttctgagattaggcgccgaactcattgagtacttatattcatgattccaccatttctgttgcaggtgaccttagggggaaaaaccatagagggtcgttgggacaataggttcttggtgtagattgttgggtataaatgtaaagactactattgtgtattatgtattgtgaaacgggatccccggaaaccttatatgattgtttgtgcgatttttatcatattatactatgtataaaaaggttttctaaaaacaaatggggatggttgatgatataaggttttgtctgaaccgcataactccctttcccggtaaaaggttggcaagccggatattgggatttggagggacggtactatgcgtgggcaggttggagggacgagtttggtgcttaaacctggatcggcccgtgcgaagtacttgtcacctgtacgattctacccaggctatttctaaaacggttcagaatcgctatagtcatggtatgtgtcatttgatttagaccgttaagcatgacaaaactaatttttacaaacatcgatttctttacaattctcatggttcttgcgcctacaatatgactctacttccgtattggtgatcccctaacgttatatcaatcaatctaagactctgtaacaaatattaatttgtttaaaaagccacaaagtgattattatgttttgtttaagcactttcgtttctgattcatgtgaagtgatatagttcaaattgccttaaaacctctctctcaaataacagattgagtacaatatttaaaggtcggattccacaaagttcttttgttcacacaatgagctaagtatcaagattaagctagaagagtgtaagaaaaaataaaaagaaagtaaagtaagcaaaaagcaggtttgttggttgtgaagtttagagtattttcaggaaccaatgattagtaggtctagatatcgttaggttgttatccaactgttcttaaactcaaactctaatatcagaataaccggtgatgttccatgaaactcactatgcctagagctaagatttccggtgatgtgccgtgaaatcctatacctaaacatgcatgctaaccgagtttgataagttcaccttagtagataggccgattcttattacacacctataaaccagcctcttcaaatagtagttctggtaacagatacctatggtgggtatatctattatctggaatcaagttctagttaattactctagaactagcattaagaacaactaaagatgaagaatcctacaaataaccaagcaaagggggcgatctactaaatcatatgaatccctagtgagaaaccctatccctaacaagcatactgctcagacatgatggatgaaatacacaacatatatgagtaagaaagcataaacaaatcagtagagaaaagagttagaaaagatttcttcacagttattgaaaatctgatgaaactctgaaaacatgggatgaatagcttggttgctaggaaacttgataaaaagcttgatagaaagcttgataaaaagcttgatatgtctaaacaatgacttttaaaactatatatatgaccttaaaaatgtgcagggactaataacgaaaataaggaagtcttctgggtcaaattttcaattcttcaaacttaaaagcatcatggatttctctgggccgcaactggtgttgatcgacaccaagagtgtgttgatcgatactctcgactggatttgaaagtgaattcgtccttaagcttcttttcttcatctttcgctccaaaatgtcttctcatctccattgtagtccctctcaatagaatacctgaaaagactctagaaataacaaaaagactcaaaaacctatatctaaaacatagttaaaacagtaaaaatagggttatctcaactccccagacttagcttttgcttgccctcaaacaaaacacaaaagccgaacccgtggaagaggttctaaaaacaaaggaactcccaacatagtctattgccatgatcattctaaccaaattcatatgcctagtaattctaatcaaatcctaaccaacatgtacttctctacaagtttacacaacattctagattccatacctaagttccacaactatatccaccttgctttcatcgctgggtctcatcaagcaagctaatattcaagaaccttctagactcattcctgtaatataccatgataaatcgaccgttctttatatttttctggtattgtttctcgtcccagacttattgacaccgttgacatatttccatatttccaaccgttgtaattgatcattcctaataatgtataataattggttcatggaaaacattcctaccgttatacactaccgaaaatcatatcatttttttttttttttttttataaggggagaggaatactttcctttttcacataggtcttaataacaggtatgaacaaaacgtcaagttctatgaatactaaccgttatgatgaggtaaatggaagagcagtgtgattagatccacccgtaatggattgtgttggaaaccaggatatcctcaactttgtcggtttgctatctggattttccaatagtcggattgagttgacccttctgcattcatcaaccagaaaataatctaaagaaatatagatcatgatttctaattagactaaacaaaaatgtttttttagaaaacaaaataaaatgactcataactctaaacacaaaaaataataagaatcaaaaataaaagcatagttaataagcgcctcccccagacttaaatatcattgtccccagtggcattcaaatccgaagagagaagaaaacataaaccaaaaataaaagaaataaaaagaaaaaaaatcataccactcggttccctctcactaagcgcttaattagagtcaataggttcacttggaggagttcaggacttggatggaggggtggaggacttgtgctgcattcgcgccttccaaggcggtatgtaaacagatcggccttgtacagcagttggtgtcgatcgacacagttgtttgtgtcgattcgatactctctccgtttcctgcaagatcaacagaaaaattagctttcgggaaactcgatgctcgtttaccggtgaagcacacttcgaacaatataaagaaataatcaaaggaacagtaagagaagagatagtgtagtacctatcacagggaactgaaataggtgtgggctctaaaggaggtgcagaagcatctatcgcgatggtgtcaatcgacaaggggtgtggtgtcgattgacactggttctctgcaaatctcatatgcgggctaagctgtaggggtctctgttgttggctctaaaagtgaagtctgagcagccagagaagacttgttcttgttggtggcaatgctactgataggcgatgtgaattctgaaccatccatacccaactccatctccttatcacatatgtggagagatatcctacccttcttcacctcaatcctagcaccagctatagctaggaaagctctaccaaggatgagaggatccttaagttctttatcatatgccaagaccacgaaacaacaaggatgaggcagttaccaactttcacagggacatcctcgaggataccttcatggatttgtttggaacgatctgaaaagaggagagtaatccttgtatgcttgtagatggtcatgcctagtctctcaacaacaaacttgggcatgaggttaatgcttgatcccagatcgcacaaggagtggctgaatctgctagtagatatcgagtagtcaagaacaaagctaccaagatcgtggagcttctgggatctctgactcggagtgatagtacggatgtacccagcaatgtcaactctccttggcttgtcctttgtaacctcagatgatttcagttggcacaatatcttggagattattggtttttctccataattgattccctttttgacaaaccatttgtttctgttcaaaaaatagatatgtgaagtctccgaagcaaaacaaggattggttgtcaatatcttttccattgcagcaatgcacttcttattgtcaagcttagaaagacgccttggagttgataaaatatctggaaagtagatcggtgcgagctcctcatgttgtgtttgttctgtttagtgtcgatcgacactagatgagtgtcggtcgacaccgtcgcgtgacgaacgatcctctctattcctgtttgacactgtctcgtcatctgattcgtcccagatcgggttgccttgtgttgatcgacactgatgtgtgtcgatcgacaccaactctgcagcagcgtgtcctaactcgtctatagcagcccactctctacagctttcctctttaatgctgaccatgatagcattgcagctcttcctaggattagcatcaggggtgccaggaagaaacccttcttgtctcttaatggattatgcagtttgaggtatttgaacaactagcttattcatgagaaagctcagattttggatcttcccattaagatatgtgtagatagcatcaaacttgccatcaaagtccataactaagttggactgaccctcaagaatctgttcaagcattgattccatcttattctcggctgagagtggaggggagttttggtaagatgaattaccataaatactctagaagttcttctaaggaaaggtcttctagaaggaaggttttggagtgaagcctgaagaactctggttccctgtaaacatgttgccactaaagttgccatgtggttgtcctaacttcctgtaaccttgaccatcaatgtagaagactccttcttctgaatctagctcaggctcgatagtctcttcttaagctgcaaagtgtacatgcttcttccctataagcaagttatgaactgaatccagcttagcatgtacctcaaccatctgattccttgaaacagctcctgcaatctttttcctctcaaagtcagcgttctttgtactcttcttgcacgcaaggttctcaatcaatgatgtagcatctgtcggatacctggtattgaagttaccattgcgcgctgaatctagagccatatagtatcttcaatcaactcctttaaagaaggtacctagaagttgtaccttgctgaagccatgatgcgggcagtcccgttgatattccttgaagcgaacccatgcttctttgactttgtgtgaaggtagacattttgttccgcaccttctcagacttagcatcatcatagaagttgttcaggaaggctttcttgatgcttcttgatagaaatagtgagtgaactagcctttaattgcttcaaccaagaaacatcttccctagcaagtgagtaagggaaaagcttgcacagtaagtagtcctcagagactccattagccttaatgtttagtacgaagtcatcaaaatgctcgatgtggtccattggctgctcgtgagataagccatggaaagggtgcttgcctaccagtgcaaagtagccaggcttcagttcatagttgttcctctaaaaaggtctgggtatgatcgttgatcggtagcgaggcttcagctcatagttgttcctctagaaagcttcttttcttcagcttttactccaaaatgtcttctcatctccattgttgtccctctccataaaatacatgaaaagactctagaaataacaaaaagactcaaaaacttatatctaaaacatagttaaaattagtaagaatagggttatatatcatgaagcataaatatgctactctagaactaaatgtgtagtttcataaatatatgcctttgttctctgtttcttctcttatattgcgaaaataaacatttctcattattacatggtaaaaatgtgattacaagacatcaaataaatcttgaaactatactcacttgatatttctcttttaccttaacaggattccaacccaaatacacttaaggactagacaatcgccacatcaacaaattgtatactagagccactctttcattgggagatgcaaataaagcaacagaaaaattgaggatatggtagaaaaaaacaactgcaaagataactttgtggaaaaactgcatttgaagaggacttgaactccgcaaaatggagggatggtgtgcttgaggaaccaaacgaattgtgtttatgatgtttaatccattaggacaaattttgattaaaaaaaccattgctattttcgatgtgagatatttaagatgaaatattaagtaattgataattttttgattttattttattttcttatggtgttcagcatataaaaagaattactttatttgtttacctgtcttaatctaacagtatacaaaatttaggtgccagataaatttttgctaaaattaaaaattatataacatactagacgagtaacaaatctaataaaattcgtaaaatatataatggtatcttatataattacatatctgcaccaacaaaattataaatagagaacaaaattcttaagaaggaagatattttggaaagaatcaagtaattaatatacgtccaaatacataaccaacatattctgggcgtagtttcagatttactttaattgtttattttgtgtgaaatcaaaatatgtcatgtactataacatatgtttcaatcaagttatttataaatctatatttgtcaaaatattatgaaatattaagggggtgttattggttcttagtttacaaggaatattgatgacttcaatcaaatcctagaaaataaataaatgaaagaatttaaactattcttgtagagttttttcataattgaaggtttagtgtcatccgatctcaagatatatgctaaagtgtgataagtatctgaagcaatcagagggtttgacccaagcttccttcattggctcacgtgagaagcacacacgtgagattagtaataagtcacaactagaagggtaaaagggtcttttatcattggctctgtatcttcttcttctctactcttctttgagtatgtaacagaatgaaacagataagagaagcgtgacaacgagactacgcaagtcgacgagagacgtgagcttagagttagaggtagagagagtaactggttttgtgttggtgagtgagagaaagcttgagagtgactgtaatccggtgagcgattgtaacggtcacttgtatgagctcgagtttgagctatgatctagtggattccggagtcaatctccggcgagacgtagggttccacaccggaacctaaactcgtaaaatctcggtgttctttgtttgcgttttttctattttctttcaaatccctaaactaagtcgcaagttctaatcggaaattatagattaggcttcacaaattggtagcagagcctatgttctacgatttcatggaaagcagaggcattgcgaattgaaagaaacggaggatttgaagtttcgttgatatcgtgactaaagataagaaaaacggaagatgttgtgatgtcaagagcgaaggaagaattggactgcggttgttctcggaagaagacgtcgtagctagaggaaagaacctccacggagaaagatccaaccggatcaaatggtttcaagtttatgaaatcagtttagtcgataagttactctctctctcttctagactctgaagtttgacatcactgtgatttctagtccaagaaattcacaagagatgatgttgagatcacgaaagtttaagatcttcgtagtctggatcaatgttatttgagttttggaggatgaaagttttacggtgatacgtttcatcgtattgaagactacttcgagtttctaagattgtgaagttgtaagttatctcctctaattgttttgtgtctgcatcattgcgagaagatcaagaaagactcgctagtgagtgcaattgcaaaggagaattggtccagatggaaagaaagaatgatactacgagttttggagatgtaagaagaagaatgtttagtgatggcttaggtggaggaatattcaccagcaagaagttttgatttctggtttaagaagtgtgtgagttcaagtactggatttgaagtcttgaaaccagaatcaagtcaccatcatgaagactcaaagcttggtgaaactaagtttgcatccgctgcaagtcacaaggttaattgtgatgttctggtatctacatgtctgcaaataaaggagtcaagatttggtaaagcacaagtttgtatgttcactgcacaagtttttagctaagattcgatacttggttagtgtggtttctggttaaggaagtgtggaagttttttgatgcaaacttgtgttcaagataagtaaagaacagctattggaagctcataaaagtctaggaacttggggacgccttggttgtttgattggtattgggttaatggttgtttggacatcagttaaggctcggtattgaaagacagaatttgcaggatcgttcaagaataatcaagaattctgcttagtcaaagtgggttgataattcagaaaaattcaaggtattacaagagttttgagtaagggttcttcaaagattcagtctcagaggtaattatcagattcttaagagataagaagagctaaaaggatatggtaatcaaagggttaaattctggtcatcattgagttagtggcagctaggacattccaagtgaaaatggattaaagctgcagcatcgttttgtgtttgtttggtggcagtagtgttttaaggaaaaatgaaacaaggctgcaagagtttgtgtattagtgttctctgtttaaacagagaaagtaacaaggacacaagaagcaccaaacaattctcaactacagtctacagatgaagaaacatctagtgtaaaaggaaatcaaggtgtgactggtataaaccagtaagaatgaaaccaaggaaattttaagttggtttctggttcttatggctaagtatgagagtcaagaataaaaatggatcagctggttatagaaacatctagacatgaagactcaagaataaaggtcctgcttataaatctctagcatcattcgggtgttttctttggagttttcagaaatggtacattcaagttagtgtgagaatttctgcaaataagaaagggtggtgctttgtgagatggttccaggagacatctgttatggtggaagaaattcagtataagggtgtgaagagtcaagtgttctaatgctataacaaggtagtggttgatcagttggtctctaagactaaagtattcaatataatatcacaaaatcagattgagagcttctctagaagcaaactgctaaagagtaaagagactgttggtgtagctacaaagtggaaagaattatggatatatcaagtgataaggttcatacagtcaagcgcacaaggttttatgattgagaattatagagacagtgacaaagaggcagttcgctcggcaagtcagaattaatgtcgagagatacaagcaacatcgatggtttaaagtttcaggtggagtcatcagtattacagggaagtaatacacgttcgtaaaagatggtttgtgatttcaggtggagctttagagttgaggagtttctcggttatcttaagtacaaagacaaggtctgagtatactgggttttcaacgcatcaggtgttagctatgagaagaaataagttgctgtttggatataattcggattggtcaagtgtgtgaagaagacagagtttcgagaacgggtaagagatgtcagaaacgttcaagcataagaaggttgcaacaggagttaaaaggaaagtttttcaggtttaaaggatgcttgatggtagttcagacattggtatatcagttgcatgattaagaagatcagcaaagctgaagtacaagctcaagataaaagtttattgaagtgattctcttaggagacggtaagagacaagtgcaaggtcttgcaaagaatttgtctgcggttcattcacctcaagtacgtgaattgcaatgcataaatcatggtttaaaagattcatcataagagctggtatagcaactgagaagaattcatccaagataggatgagaatgaagaagtagaacaaggaaaagttctgttcaccttttttgcttcataagaagtaacaaataggcacatgtaaaggaagcttatgaggataaagaaaggattcagattaatctctgatggttttaagatgcaagtgccaagttaggtgaagattgcaaacgtgaggacgttttgcagagtgttttttttgcagcaaggaagcgacttcgagaagttctagagtgaagttcaagggctgtaaaggagaagtctcaggcatgtcacaggagtgttgatatgagacaagtttaaagaagctaacaggggttcaaatctgttggattgaaagggtttgctgattcagaagggtttcgaaccagattgagcaaaaagagttgtatcggaagttttcctttctctgtgaaagttaggaggcatgttttgttggtaacataggcggtgcaaagtgatgctcaaagttcaaacaaatcactgtaagtacaatctctagttaaatacattttactactaacgggttattggcttagattgttttgcaggatgaatcattgactgtttcaggatagaaaagcacaagcgatccaagatatttttgcataatgattcaagggagaatttgattcaaagttcagtgcacatgaaatgaatcaaagggctagcgaggaatcgatctgcagaggttaaaaaaggatccaggctgtgaaggaaacaagtgaagcaaacatgagttttttgttgacacaagtctgtgttaaagttggttcacaactcaagaagtgatactagaacgtcgatggttcgggaacgtcggtgtgattcacatcacagctattttttttccatcgaagatatgttcactaatggttgttgaagtgtgaagattggagttgtcaaggttagagcaagtttaaagggttctaaggagcagctgcgaggaagtcttcaagtagaatcaagacatgttgattttaagatgcattgaggaaacaatttttcaaggaagcattgaagttgaacggtgaagttcaagatgagcggtgaagctcaagtaccggagatggaatccaagaagctagataaggagcgtgaagaagatcgatgacaaggtggagatttgaaggtttagtgtcatccgatctcaagatatatgctaaagtgtgataagtatctgaagcaatcagagggtttgacccaagcttccttcattggctcacgtgagaagcacacacgtgagattagtaataagtcacaactagaagggtaaaagggtcttttatcattggctctgtatcttcttcttctctactcttctttgagtatgtaacagaatgaaacagataagagaagcgtgacaacgagactacgcaagtcgacgagagacgtgagcttagagttagaggtagagagagtaactggttttgtgttggtgagtgagagaaagcttgagagtgactgtaatccggtgagcgattgtaacggtcacttgtatgagctcgagtttgagctatgatctagtggattccggagtcaatctccggcgagacgtagggttccacaccggaacctgaactcgtaaaatctcggtgttctttgtttgcgttttttctattttctttcaaatccctaaactaagtcgcaagttctaatcggaaattatagattaggcttcacaataatcttgtaaagtttcttaaacaatctctctattttgataatatttttcattactttttatgactttattttgtaaacaaaaatatagaaagtcatgaaccaataacataataatttaaatcattaacaataagagattcttttgttttaattgaataccacaaaactcttactgactttataagaatatgaatccaataaccccaaatttatgaagattttagattactttttacaaatcttaaatgaataacacaaaacattaacatagttttatattatcttgattgaataacaacatattttacatgacattttaagtcaataaaactcctttgaaatcataaaccaataatatcccctaaaacttaactattacttttgttgaaagagaaaacatgttcaattaataatgaatctattatactcatgaaaatattgtgtatatatattctaacatataattcactgattaacatattacccatatttctaatgaatgtaattaaagtttatgtgccacaatagtttggtcaaaaagaaaaactatttattgtcttaagtaaaaaaaaaatcttacagaatcttatagagttaaatttgcaagctcacaactacatgagccaaaaaaatgtcaaatacttaaatgacatttacttcaaaactttttgatgttaagtcagcctgtcaaaatttatttcactttaacacgtgttagaattcaataactacaaaactatatatgtcataatattatgaaactatatatcaaacaaaattagtgttatttgggtaagacaaaacatattcaattaattaattttaatctaacttgaaaacatagtatctctctattggtataagctcttaattacaattaaccacgtacataagtacaacttattgtcactatatatacccttaacacaaacaaatatttttatacaaaccttgcataagcctttacggagtaaggaacattgaaacccgatttttcatatatctttctgttctaactcatggcgaattttccagataagcagtatgactcaaacaacccatataacatcatgataacgttgtcaccatttgacgtcgataggagtactacgataatgatgccaaaagcgttactagaaaccaatttatttcctttcatggagataagtactctcgtccagttgttacaagttcaagacaagccaaagatgattggagtgtatgatattgatactcaaattacaacatatgtaatcataagacaagatggaaataattttaaatttcatggatggaatgatattctaaaaagaaaacattacaaagcaggcgatactattgcattttggtgggatcttcgtcatactagactaaatttcaaacatgttgcttaattgatggagcgaatcttcacaacttcatttctcggatatgcatctataccgggtttgtctgatcgagtccagtttgttgtcgttttattatgttggtttaattcctgtttctagagaacatgtttttctcttatatttataaatatatatatttggatttataagataatatatgtaaataataaaagagtcgagagaaacaatttctccaaattttttatctatacattcaaatttaatataatattttgatagtaaatcataaaaaggaattgtttgtggtagaatcatttgtgtaacagttctcataatttgcaataaataataaatcaagacagcaaaacaaaaattaatatgtattaaaatttaatttattttaacacgcgttaatctaactaatacaatttctatgtgcctaaatattttggcttttaaaaaggttatatgcatgttgtaacaaatctgatgacatttctgaattatacataatcggcatctaatttatattttttttatcagttgctataataactaactagattttgacccgcggtataccgcggggctaggtttttaataaaatttgttatataaaatgtatatgtagatatttgttttattaatattgtttgctttgtttagtgtttaagataatgtatatatagattttaattgttatatctaggatttcatccgtagtatatcgttttgtattattatcgatcaaaacccgtcataccatctaatcatgcacagtgaaattaaacatatctaatggatttcacttgtagtataccatctcgtaatactgtcgaccaaacccgtcctaccactaaccctgttcagtaaaattagacattattttgtgatttttgttttaataatactttaatttaaaaaatatttaattcaaatcaatttaaaagttttctttcaaatatttctttaattgttataaagtttatatattataatattataaacacgtcataccatctagtcctactatctaatcatgttcggtgaaattatttttttatttttttaataatatttttattaaaatatttataatttaaatcaatttaaagttttctttcgaatgattatttaatttttaaatcttttaaccattttggcaaaaataattaggccatggaataagagcatattcttttgaataagatttgcttttatttggtagttaattttcgcattgaataagccggtgacagccattgtaaataagttccaactccaggatttatttcacaaaatggctgcaaaaatgtatataagataaccaattaaattaattaaaccaaaataacatagaacaagagaaagagaaacaaaaagatccatgttcttatagaaggatctagaagatccatatgatccaagaagatattatgaatatattctagagatatgtatatatcttatatgattctattagttagataattagattaattcattttctatataagtgtatcccttatgtttgttagagattaatttgcggtacatcgcgagcctatatgttaattaaataaaagattaatttttttaggatgatctatgtatacgctattattttgtttgatttaaatgtacggtccactgcaaaataatattttagaattaaaaaattataaaatttaagttgtatttgtttcgttactattgtctatatatatagtcttgcgctattctaagcttatgaatgaaaccttgttcattttctcttgggttttagggttttgaatacaaatttaagtgatttgtttgttatttcttgctaattattcaactaagcggattaggtttcatttgatcggtatatatatgtgtgcatatgatttaagtttgactaatgctcaatgaaaatatatctttgtgtcattatatatatgcttaacacattaacaaaatttctaacccaaaccttacctagatatctctaagaaaaagaacacttaaaactgatacccatatatctttgtgttctaactcatggtagataccgagctgtatccagatgagccgcgcgtttaatgtggacagcccttggatacccatagatctttgtgttctaacttaaggtagataccgagctgtatccagataagccgcgcgtttaatgtggacagcccttggaacatcttgataacattaaacaccatcaaacataggtttgagtaatatgataacgttctcaaaagagatagtagaaaccaaagtgtttcctttcctaattccggcctatgaatattttcataggttatttggacttttcgattttgaatttaattataagaactcttatcataaaagaagatttaaatggaaatttccaatttcatggatagagtatggttctccaactaaacaattacaagacaaacgatatgattgggttttggtgggatgccaataactctagattgaatttccaactactcttgattgcttactttatggaatggatctttgcaaaatcattttagattgaatttccaactactcttgattgcttactttatggaatggatctttgcaaaatcatttgtataatatgtttagttgcttttttaaaattatttcattccgaaaatttgtgtattctatgttgtattcatcaagttgtttaatatttctatcataagtcttaactatattttctagagatcatgttttacttcctcaataagaaatggatccattgggctttatatgataatatatattttacctattactcataagtcgagagttttctccaatttgtttttgttttggcaatcaaacatgtcaactttatatttgatgaggcaagtccaaaagtacgaaaggagattttgtttttgattttaatagcatcaagtttctaataagggcttaaacccaagactagggctagtgtgagcccggaaggtttcgcttatctatgtaaaacccctaattttcaaatcagcgttgaatctaactactaatggcgtctccagtcaccacgaacggtaaagagccattggttaggaagcagaaaaagagtttgtcccttcctcatgatgtgttagtaagctgcttagcccatgtctcgagattgcactattcgattctctccttagttttgaagaacttccgatcactcattgcttctccggagctttacaagactcgctcactcttaggtcgtatagagagttgtctttatgtctgcttacgtttccccaatgaatctcatccacgttggttcactctctacatgaaacctaatcaaatcgtagccaataacaagtcaaattgtaatcttttggtcccaactccaactataagttcttctcctgcgcactggttatgtctcatagcggttggttctaggatttattaactcatatgtcacccatagagtgttcatatataagaatatctttgtgctcatgcatgaattagattataaacactccatatggaattatcgtctaaaatacaaaacctaccctgttaatgaaaattacatgtctttacactcattatttcaatccctaattatttatattcaaaccaaagcagctaaattcatctagaatgtgatttataccatattaagctgtaaattcaactactatatcttttgatttaatttatgggcttattgtcctctaatatcatatgtttagctgcttagggtttctaattatgggcttaagcccaagactgggattaatcttagagtttcgtttttctatgaataaaacctaatctcaaaatttcagcggaaaatctatgtgctaatgtcgtctccaacaacatccctgaccaccacgaggggcgaagagctgttggttacgaagtagaagaataattgttggggtcagatttcctatttcccccaaataaccgagccgaacagagtcataagcgcctaggtaactaggttcgtcgccgtcaaaggcgtagaaatgattcgagagagtccttatccggctcaggtgtcattccaagcaacacacccagagccggggaaagcaatacttcgggcctcaagaaaacacctctttaatccctcaaacggttcgagtgttattccaggaaacacgcccgagccaagcttaagcatgcctcggggatcgtctaggatcggctcggtgaacgtcctatcaagcagtattcgtcccaagccaaaatccagcgttccccagaccatatacttacttgaggaaaagacttgtacaaattctgtgaaggtcccaaaaatcatttcctaaaaacccggaagtgatattggagaatctctgagggtattgtcaaatctgaaagtttttctgaagctcccgaagaataaggaaaatctctttattgcaaagatcctttttagccgacttaaagataaatggaaatcttccgagaatattgcaggaggcggtcacttggcctataaaagggacctcaaggacttcgcaaaaggggacacaaaaaatgctctcaacttcagactatcaaaaaggctctgactttgaaggctaaacacttttctaatcacatttctaaacacttgcatgatcaaatcatcgtttccaattaataatatcaaaaacaccatccgtggttacttatcgattgttgatctttgagattctcgcgaagactgtttctttgcgagtttcgactctaacaatttggcgctagaaggaggggggatttagatttctcttactccaagaacacaaaaccatcgaaccaagaagcaatgaccaacaaccaggtcctcgctaacactgtcgacgtggagggaaacccgaatcatccagtccagacgaacgctcctgaggttgccgctcctacagtcctagcagaactgagaagcatgatggcacaactctagaagaaggtggacgaccaggaaaaaagtgcaccgatctttggcgcagcagctccaggcggctacttcccaaggacagctgaggaccactctcatcggcgcgcaacaatttcaggctcgtcgagtaacgactgacctcaatccaacaaggcttgtaatcgctacacctggcaaaacgacgagaccaccccggctaatcgcaccagcactcgttggaacccaagcagaattgacatgtttaggagaacagaacccaacaaaccaggtgggggcgtttgatccgcaaaatcacaaccatcgagctgaaactgctggagccgatcaaatcgaagcttccgacgatgaggaatcggaagaaaacatccgatgggcagaagagtacgctagggagcaagagatgaaagccatcagactctccctggccaaggtagaaaccaagatgaaactcgtacggtcacagatgcacaacacggtttcctcggctccgaacatcgaccacatccgggaagaatcacagaacacgccctttactcgtaaaatctctaacgcgataatctcagagccatgaaagatgaagatcgagtatttcaacgggtcatctgacctaaaggggcatctcaaatctttcataatagttgtagctcgggccaaattcagaccggaggaaagagatgctggcctttgtcatctatttgtcgagcacctgaaggggtcgaccttggattggttctcgagacttgaagggaattcggtttacagtttccaagagcactcgacgtttttccttaagcaatactcagtgttgattgatctaggcacctcagacgccgacctttggttgctatctcagcagccaaacgagccactcagagatttcctcacaaaattcaggtccaccctacccaaagtcgagggaatcaatgacgtcgcggccctctcccccttgaaaaaggcactgtggtacaagtctgaattccgtaaggaattaaatctatccaaacagcaaacgatccaagacgctctgcactgagccttagattatgtcccatgaggaagaaatggaattgttatcgaaaaagcacgagccttcgaagcaaacacctcgaattgataagtcccaacctagcgctccgagccagaaaaagggcgctcaaggcaggaccttcgtgcatcatgaggggcaaaacttcaccggagcacacaattaccaagccgacacgccccgaggtcgaggaagagagtcctacacttggactaaatactgcgagttgcacaagagctaaattgcaatactgcgagttgcacaagagctacggtcgtcacacttccaggtgtcatagtcttggagctaaattggcggccaagttcctagtgggtgaaattggatggggtttgaccatcgaatatttagaagtagagaaagccagagttgagcaggtgaatgctgtggcgaaactcgagtaggcagtccccgcggcaaaccctgaagggcccaagagaggttagggcgaccccgaggcagatgacgatgaagaagaagctacttggagcaaaatcttcacgattttgggaggttcaaccttttgtcaagatacaacagcctcaatcaaggcttctcaaacgaaggtcgattcaaatcgtaactgggcgcaaccgttcaacggaccggatgacaaagtcacttttccgtgagagcgacactaacggatagtcatatttgactccaaaacacttaccaaaattcttattgcttctcatagctttgatgttgtaaccaaagtccgtatgattctttggctttgaatcttctaacaaggaaacactactttagcttttgggaaccagttgcggttctagttcttatactcaatcatacacatgacatctagtcatatttgactccaaaacactaatcaagcttcttattgcttctcaaaattttgatggtgtagccaaagtctgtatgtgtctttgcctttgtatcttctaacaaggaaacactactttaattttttggaaccggttgcggttctagttcttatactcaatcatacacatgacatcttgtcatacttgactccaaaacattaacctagcttctacatgcttctcaaagcttttatggtgtagccaaagtccgtacgagtctttggctttgtatctcctaacaaggaaacacaactttaacttttgggaaccggttggggttctaggtcttatactcaatcatataaatgacatctagtcatatttgactcgaaagcactaaccaagcttcttattgtttctcaaaacttttatggtgaagccaaagtccgtatgagtatttggctttctatcttctaacaagggaacactactttaccttttgggaaccggttgcggttctagttcttatactcaatactacacatgacatatagtcttatttgactccaaaacactaaccaaaactctggttgcttcttaaagctttgatggtgtagccgaagtctgtatgagtttttggctttgtatcttctagaagggaaacattactttagcttttgggaagatgttgtggttctagttcttatactcaatcaaacaaataacatcttgtcttatttgactccaaaatactaaccaagcttcttattgcttctcaaagctttgatggtgtagccgaagtccgaatgagtctttggctttgtatcttctaacaaggaaacactacttcagcttttgggaagcggttgcggttctagttcttatactcaatcatccacatgacatctagtcatatttgactccaaaacactaacaaagcttcttattgcttctcatagctttgatgatgtagctgaattccatatgattctttggctttgaatcttctaacaaggaaacactactttagcttttgggaagcagttgcggttctagttcttatactcagtcatccacatgacatatagtcatatttgactccaaaacactaaccaaacttcttattgcttctcaaagcattgatggtgtagccgatgtctgtatgtgtctttggctttgtatcttctaacgaggaaaccctactttaagtttttggaaccggttgcggttctagttcttatagtcaatcatacacatgacatcttgtcatacttgactccaaaacattaacctagcttcttcatgcttctcaaagcttttatggtgtagccaaagtccgtacgagtctttggctttgtatctcctaacaaggaaacacaactttaacttttgggaaccggttgtggttctaggtcttatactcaatcatataaatgacatccagtcatatttgactcgaaaacactaaccaagcttcttattgtttctcaaaacttttatggtgaagccaaagtccgtatgagtatttggctttctatcttctaacaaggaaacactactttgggttttgggaaccggttgcgattctagttcttatattcaatactacagatgacatatagtcttatttgactccaaaacactaaccaaaactcttgttgcttcttaaagctttgatggtgtagccgaagtctgtatgagtttttggctttgtatcttctagaagggaaacattactttagcttttgggaagatgttgcggttctagttcttatactcaatcaaacacataacatcttgtcttatttgactccaaaatactaaccaagcttcttattgcttctcaaagcattgatggtgtagccgaagtccgaatgagtctttggctttgtatcttctaacaaggaaacactactttagcttttgggaagcggttgcggttctagttcttatattcaatcatccacatgacatctagtcatatttgactccaaaacactaacaaagcttcttattgcttctcatagctttgatggtgtagctgaagtccatatgattctttggctttgaatcttctaacaaggaaacactactttagcttttgggaagcagttgcggttctagttcttatactcaaacatacacatgacatcttgtcatacttgactctaaaacattaacctagcttcttcatgcttctaaaagcttttatggtgtagcaaaagtccgtatgagtctttggctttgtatctcctaacaaggaaacacaactttaacttttgggaaccgtttgtggttctaggtcttatactcaatcatataaatgacatctagtcatatttgactctaaaacactaaccaagcttcttattgtttctcaaaacttttatggtgaagccaaagtccgtatgagtatttggctttctatcttctaacaaggaaacactaccttaccttttgggaaccgattgcggttctagttcttatactcaatactatacatgacatatagtcttatttgactccaaaacactaaccaaactgcttgttgcttcttaaagctttgatggtgtagccgaagtccgtatgacgttttggctttgtatcttctagaagggaaacattactttagcttttgggaagatgttgcggttctagttcttatactcaatcaaacacataacatcttatcttatttgactccaaaatactaaccaagcttcttattgcttctcaaagctttgatggtgtagccgaagtccgaatgaatctttggctttttatcttctaacaaggaatcactacgtcagcttttgggaagcaattgcggttctagttcttatactcaatcatccacatgacatctagtcatatttgactcccaaacactaacaaagcttcttattgcttctcatagctttgatggtgtagctgaagtccatatgattctttggctttgaatcttctaataaggaaacacaactttaacttttgggaaccggttgtggttctaggtcttatagtcaatcatataaaagacatctagtcatatttgactcgaaaacactaaccaagcttcttattgtttctcaaaacttttatggtgaagccaaagtccgtatgagtatttgtctttctatcttctaataaggaaacactactttacgttttgggaacaggttgcggttctagttcttatactcaatcatacacatgacatcttgtcatacttgactccaaaacattaacctagcttcttcatgcttctcaaagcttatatgctgtagccaaagtccgtatgagtctttggctttgtatctcctaacaaggaaacacaactttaacttttcggaaccggttgtggttctaggtcttatactcaatcatataaatgacatccagttatatttgactggaaaacactaaccaagcttcttattgtttctcaaaacttttatggtgaagccaaagtccgtatgagtatttggctttctatcttctaacaaggcaacactactttggcttttgggaaccggttgcgattctagttcttatattcaatactacacatgacatatagtcttatttgactccaaaacactaaccaaacttcttggtgcttcttaaagctttgatggtgtagccgaagtccttatgactttttggctttgtatcttctagaagggaaatattactttagcttttgggaagatgttgcggttctagttcttatactcaatcaaacacataacatcttgtcttatttgactccaaaatactaaccaagcttcttattgcttctcaaagcattgatggtgtagccgaagtacgtatgagtcttcggctttgtattttctaacaaggaaacactactttagattttgggaaccggttgtagttctagttcttatactcaatcatacacatgacatctagtcatatttgactccaaaacactaaccaagcttcttattgcttctcaaaactttaatagtgtagctgaagtccgtataagtctttggctttgtatcttctaacacagaaacattactttagcttttgggaattggttgcggttctagtcatatttgactctgaaaaacttaccaagcttcttattgcttctcaaacctttgatggtgtagaggaagtccgtatgagtcgttggcttagtatcttcaaacaaggaaatattactttaacttttgggaatcggttgcggttatagttcttatactcaatcatacacatgacacctagtaatatttgaatccaaagcactaaccaagcttgttattgcttctcaaaattttgatggtgtagccggagtccgtatgagtctttggctttgtatcttctaacaaggaaacattactttagctagtgggaatcggttgcggttctagttcttatactcaatcatacacatgacaactagtcatatttgactccaaaaaactaaaaaagcttcttattgcttctcaaaattttgatggtgtagctgaagtccgtttgagactttggctttgtatcttctaacaaggaaacactactttagcttttaggaaccagttgcggttatagttcttataatcaatcatacacatgacatctagtcatacttgactccaaaacattaacctagcttcttcatgcttctcaaagcttttatggtgtagccaaagtccgtatgagtctttggatttgggggagttgatatgtctataatttgcatgatttcggcattcattcttcaccactttgtcattgtttcgtccacatttcatctcattaagagtcgttttagtgtgttttgcatacttaggacgattttgcattaggattgcatgtgcattgcatatttggttgttttcaggtactttggatgcttttggatttcaaacagaggagaaacagaacagaaagttagaatgcctaatgacaccttcagcaaaagtactctatcgcagccttggagccctgccagggcaaatcactctatcgcaaccccggagaagctagcagctcagtttcactcaatcgcgaagccggaggaatcaccccatcagaaccactcaataaccaccttatgatattcactcgatcgcactctatcagagggtcgctggaccattcaatcttgacttcactgcatctcacttgatcgcaaggcggagcccctgcagcccagtttgatcaatgacatactcgatcacaggaaagctcattttagtccatcagatgccaatgacacattcggtcgcagggtcatgacgtgaagattcgctatatatctagtttccttatttgtttcatttctcgcttatataaactgcctcttagggttttcccgagggcattcgttattatctcgtcttttttgcaactttcatagctgaagtgtttctcctgcgactttgtattttgtctttcattatttctgttatcatgttttcaatcgttgttttgctattgtttttgattatgtctgagtagtgaactgtatttctgaggatgagatagattagttgtagtttacttggtcgttttaggtggttgagtttagaatactagaatcccttctggattagttgcgcttattgcttgtttcactgactaatgtggaatatgagtccagacgtccagcgctcagaaggcgtttaataggcgttggatccaattaattccagaggtatctgactctaccccaacggattgactgtagagagggtattggctttaacatgttgattcgataatgccttcttagttagagatcgctaatgagaattagttcagtgtctagttatgcttgaggatttctatcacgggagtgaattaatctgttgttgaacttgttgtctagggatagcttctatgaagttttgtcaaccacttgaatagattaaggagaccatactattcgattaccccatccttaagaatcgtttatccatttgattgcctgttatcatttctgctttgttatttacctgcctactattgccatttctgcttttagtttcatttcatttctgttattgcatactaggactgttagaaccaaccgactctctgcttggcttgacttagagctttctaatcatatctcatctgtttgcatcacaccggattggattgacatcctaaaatactacaacgacaagatagtgttttaggattaattgagaaaaatcctactatcaatttggcgccgttgccagtttcgtgtttgtttgttatatttgagatcattagaaacgttaagatcaagttcggttttgttacacaagttactaacattgtgccttttctgtctttgtgtttcaggtaccttgcaacccgctttacagacgcatctttgattcatctgttatagcacggctgctatatgttgcatgcatacacggtcacaaggaaatcagaacctcctattcaacaataacatcgaccgtattgctcgccaactgatagaacagacagaaaccgacacaatggctgacgttgtagatgagcaagagcaacctaccaacgttggtgctggtgacttccctcataaccacgaccagcgtcatggaattgttccacctctagtacagaacaagaactttgagatcaaaagcggtctcattgcaatagttcaggggaacaagtttcatggccaaccaatggaggatccgctagatcatcttgacaagtttgaaaggctccgtggccttactaaaatcaatggagttagtgaagatggtttcaagcttcgcttgtttccattctcacttggagttgaagcccatctgtgggaaaagacgctaccccagaattcaatcacgacctgggatgactgcaaaaaggccttcttggcaaaatacttttccaactccggaatgagatatccggattcactcagaagcaaaatgaaagattctttgaagcttgggagcgctttaagggttatcaaaccaaatgccctcatcatggatttaagaaagcttctcttctcagcccactttatagaggtgtcctgcctaagatacgaatgctctttgacaccgcttcaaatgggaatttcctgaagaaggatgttgaagaaggatgggagctagttgaaaactttgctcagacggatggcaattacaatgaagattatgaaagaagcatccacaccagtactgaatctgatgacaagcaccaccgagagattaaagctctcaatgaaaaaatcagcaaactcctccaagtgcagcagaagcatgttcacttcgtctctgaagacgaagtattccaaatccaagtgggggagactaatgagtgtgccgaaatcagctatgttcagaatcaaggtggctacaacatagggtacaacaattacagacccaatccaaatctgtcatacagaagcaccaatgtcgccaaccctcaaaaccaagtttatccccagcagcaacaacagcagaaccaaccaaaaccgtttgttccttataaccaaagccaagggttcgttccaaagcagcagtttcaaggaggatatcaacaacagcagccacaacctggtttcacaccacatcaacaacaagcacctgcgcctcagaattcagacataatgactatgctccagcagctcattcaaggacaagccacatgagcaatggaaatcgctaagaagctggctgaattaaacaacaaagtcgacggacaaggtgtcgaacttaacagcaagttcgaatcaatgagcactaggatgagatatgtggaaggcatcctcgcttcaccatctgttaacaacaacccatgccagctttcaggcaaagcaatcatgaatccaaaggagtatgccactgcccatgccatcactatcagacatgatcgagagctgccaactcgacatgtccctacctcaaacactgaggacagtgttattctagagggggaggatttttatcaagatgatgttttggctgacaaaacaatcaaagagcccatccttgacagtcatcgcactcgaccacaagctccgctagctactaccttcgttgcaaaaccgacagctgcaaagaccaaagatacagtcttcgtgccaccgccttaaaaacctccacttccattccctggtcgatttaagaaagttctggttgcgaaatattgagccctattggaaaaacagataaaggatatgcctttagtggattgtctcgcgctaatacctgacgagcacaagtacgtgaaagacctaattatagaaaggatcaaagaagtccaaggaatggtggtattaagtcatgagtgcagtgcaagaagattgttcaagaaaagttggaagatccaggatcttttactctaccatgctccattaggcaattgcctttcagcaattatctttgtgatctaggagcctcagtcagcataatgccactctctgtggcaaggaagctgggtttcgttcactacaagccttgtgacctaaccttgattcttgctgataggagttcaaggagaccttttggcaagttagaggatgtgtcagtaatgattaatggagtagaggtccctactgattttgttgtgcttgagatggatgaagaatctaaggatcctctgatcttaggaagacctttcttggcttcaactggagcagtcatagatgttaagcaaggaaaaattaatcttaatatgggggaggatttcaaaatgaactatgaaatcagggacactatgaagaagccaacaatagaaggacaaaccttcttagttgaagaaatgggtcagctagctaatgaactgctagaggagcttactaacaaagatcaccttcaaactcctgtgatcaaaagtagtgaagctggatttctctccagtgagaccttgagctatgagatgtcattagactcacacaacaaagtaccaggatcagagatctttaaaggtgtcattgcgttagaaagagaggatgttgcattgaacgaggaaggctcaattgatattcgactagagtgctcaaccaaacagctaaagtcaagcatgagggcatcaaatgattggctagaactcaaggagaggtctaaatggcacgacagagctataagagagctaacacacactgtgaaagagctgaaggatcaagtcaaggagctccatgggaaagccaaccaagcaccactcgacatcaaggacgtcccaaatgatgaagttattcctatggttagaaaagaaggatgtgaattcacattagaacagtctagaaaagacgactatccagatgatgaaaaaggagcttacgaagaaagggccattgagtactcaattatagacctgtcacgggagcatgctgaatttgatgttgtatctactaaggaaggagaggagacgtcaattctactctatcatcctccttgagcctaatgagtgtgaggagtcaagctagagacttaaaacaagctcacttgggaggaagttccatgcttatccctgtatatagtttttattttatttagttacttttgatttgttttggttttggttttgattctcaggaaatgaataacagctggagcaacatcagggatgcaaccgagtgttcaaataaaaaaattcaatttttttttgatgaatcactcgatcgcaagatgagagtaaaagctcgagagtgcgatctagtggttttgggacaacatctttctcaacgacaatgtcaatctactcgatcgcaacatggaagtggtgtgattgagtggtcttctagtggaattgcccaaaccactcaatcgcaaggagaagtgaaaacgcccgtcaggacttcaatgataacccgcctgaagacatgccatccagctgccataatattgccctacaaaggcaatccacctatcaacagagggaccacaccgttctgcaagttcccgtaaggcacgagtctcatgagccaatggagcacaagaggcggaagagcgctaggatggtccgatcatcaagcaagggttggataatgtcgggtcggagaacacatgagcgacgtgctgcacaacctgctcgggttgcgatcgagcacaatgacgaggagatggcggagccacaccaagaaccggtcatgcctactgaggtaacacactaaaaccctttgtaaataccgcttttgtttttgtttttctgtgtttatcttgaattctttcacaaattttgattacacaagggactgtgtaatttaagtttgggggagggttcaagacgtatttgacttgtttttgtgaatatcatttgactctgcatatcatctaagtcatagagaaaaaacaaaaaaaaaattgaatttttttgaaaatgaattccacataaacagagtgatcatttagttgcattacatttaggatagagtttagagtgtttcatataggattgttgcatatgcataggggataatgaggaattagccttgaagcatgatgattcactaaaatgagttattagttctctaaggcatttgaatgactttgaagtaaaaccgcaccatgttctatagacaccactcgatgcatgtcatgacaccttttccctgtcaatttgaacttgaatctgacttataattatcatgtttgcatcgtttttgaactcgtggatagaatacatatttggattttctttcacttattcaccactcttgttaatccaagtagctgcttctattattggagtagttcacccttaaccaatccttctttcaagccatgttattttatgagagcatgtgaggcctattttcaggattgagcttggtagaacgtgttaggtttgagccgacaagagtagtatctcatgtagttccaatccgtatatttggacttagtaggactaggtgggaacttatttggggatagggattgagtgtgaaaagaaaaagaaagaaaaaatgggttagagtctttaggagaaggaagctaaaaatcatattgaggtctagtaaatgtttgggaagcataaaattgttaagatatgctctaaaaaaaagagatggcagcaaaaacagaaaagaaaaaaataaaaataaatgataagagccataagagtttaagaaaaatccaattcattagactagactcatagagtttaagaaaagcttctccttaagaacaagagctaaagaaaagaaaaggaaacattgatccaagaaaaaaatcgaaatatgcctttggtgcaaaagggtagacttaggatcatcattgggtttagagataggaccatcttcttgttattcacggtttatgtcattgggtagatgggatgctattcttgtatgcataggttggcacttacctttagcattcttctaaagctcggtcctttttcattgagagtcccctgctataaaaatctgaaccacttaaaagggactatctttgtctcataacctgtcactagccaaatgcgttcactagcgatgcatatcttgattcatgtttttgacgcattgtgcatttgagtgtaggtttggatcataacagagaatggctaaagtttttatgtaaaagtcgatcacctcgcatcttagaactgttagctggtacattgatcttaattgtcatatctcatgctttggttctgaatccccaacttcaaacctctccttccgcttatgtcttcttgtttgcttgagggcaagcaaagactaagtttgggggagttgatatgtctatactttgcatgatttaggcattcattcttcaccactttgtcattgtttcgtccacatttaatctcattaggagtagttttagtgtgttctgcatactaaggacgattttgcattaggattgcatgtgcattgcatatttggttgttttcaggtactttggatgcgttttgagttcaaacagaggagaaacataacagaaagtcagaaagcccaatgacaccttcggcaaaagtactctatcgcagcctcggagccgtgccagggcaaatcactctatcgcaaccccggagaagctagcagctcagtttcactcaatcgcgaagccggaggaatcaccccatcagaaccactcgatcaccacctcatgacattcactcgatcgcactcgatcacagggtcgttggaccattcaatctcgacttcactgcatctcactcgatcgcaaggcgaagcccctgaagcccagtttgatcaatgacatactcgatcacatggaagctcatttcagcccatcagatgccaatgacacattcggtcgcagggtcatgacgtgaagattcgctatatatctagtttccttatttgtttcatttctcgcttacataaactgcctcttagggttttcccgaaggcatccgttattatcttgtcttttttgcaactttcatagccgcagtgttttcctgcgactttgtattttcactttcaagtatttgatattcagttttcgtctaagtctttcatcatttctgttataatgttttcaatcgttgttttgctattgtctttgattatgtctgagtagtgaactgtatttctgaggatggaatagattagttgtggtttacttggtcgttttaggtggttgagtttagaatactagaatcccttctggcgtttaatgggcgttggatcctattaattccagagatatctgactctaccccaagggattggttgtagatagggtattggctttaacatgttgattcgataatacctacttagttagagatcgctaatgggaattagatcagtgtctagctttgcttgaggatttctatcacgggagtgaattaatttgttgttgaacttattgtctagggataaccgtgaaattttgtcaaccacctaaatagattaaggagaccatactattcgattaccccatccttaagaatcgtatatccatttgattgccagttatcatttctgctttgttatttacctgcctactattgccatttctgcttttagtttcatttcatttctgttattgcatactaggactgttagaaccaaccgactctctacttggcttgacttagagctttctaatcatatctcatctgtttgcatcacaccggattggattgacatcttaaaatactacaacgacaggatagtgttttacgattaattgagaaaaatcctactatcatatcttctaacaaggaaacaatactttaacttttaggaaccggttgtgattctaggtcttatcctcaatcatataactgacatctagtcatagttgactacaaaacactaaccaagcttcttattgcttctcaaaacttttatggtgaagccaaagtccctatgagtatttggctttgtatcttctaacaaggaaacactacttgaacctttgggaaccggttccggttctagttcttatactcaatcatacacataacatatagtcatatttgaatccaaaacactaaccaagcttcttattgcttctcaaagctttgatggtgtagtcgaagtttgtatgagtctttggctttgtatcttctaacaaggaaacaatactttatctcttgggaaccagttgcggttctagttcttctactcaatcatacacatgacatatagtcatatttgactccgaaacactaaccaagcttcttattgcttctcaatattttcatggtgtagccgaagtccgtatgagtctttggctttgtatcttctaacaaggaaaaaatactttatcttttgggaaccgactgcgattccagttcttatactccatcatacacatgacatctagtcatatttgactctaaaacactatccaagcttcttcttgcttctcaaagctttgatggtgttgccaaagtaagtatgtgtctttggatttgtaacttcaaacaaggaaacactactttggcttttgggaaccagttgcgtttctagttcttatactcaatcatacacatgacaagtagtcatatctgacttcaaaacactaaccaagcttcttcttaattttcaaagctttgatgctgaagctgtagtccgtatgagtctttggtttgtgtcatgtaacaaggaaatatacttaggttttcaagaactagttgcgattctagttcttatacgcaatcatacacatgacatctagttatatttgaatcctaaacactaaacaagcttcttctagtttctcaaagatttgatggtgtagccgaagtccatatgagtctttggctttgtatcttctaataaggaaacactattttagcttttgggaaccggttgcggttatagttcttatactcaatcatacacatgccatataatcatatttgaatccaaagcacttaccaaatttcttattgcttctcaaagttttgatggtgtagccgaaatccgtatgagtctctatctttgtatcttctaacaaggaaacactactttagcttttgggaaccagttgcggttttagttcttatgctcaatcatacacatgacatcaagtcatatttgactccaaaacactaaccaagcttcttattgcttctcaaaactttgatggcttagccgaagtccgtatgagtctttggctttgtatcttctaacaggaaacaatacttttgcttttgggaaccggttacggttctagttcttataaacaatcatccacatgacatcaagtcatatttgactccaaaatactaaccaagcttcttattgctacgcaatactttgatggtgtagccgaagtttgtataagtctttggatttgtatcttttaacaaggaaacattactttagcttttgggaatcgatggcggttctagttcttatactcaatcataaacataacatctagtcatatttgacttcgaataactaaccaagtttcttattgcttctccaagctttgatggtgtagccgaagtccgtatgtgtatttagctttgtatcttcaaacaaggaaacattactttagcttttgggaatcagttgcggttctagttcttatactcaatcatacacacgacatattgtcttattttgactccataacactaactaggcttcttaatgcttcccaaaacttttatggtgtagccaaagtccgtataagtctttggatttgtatcttttataaaggaaacattactttcgcttttgggaattggttgcggttctagttcttatactcaatgattcacatgacatcatgtaatatttgacttcaaaatactaaccaagcttcttattgcttctcaaaatttcgatggtgtatccgaagaccgtatgagtctttggctttgtatcttctaacaaggaaacataactttagctattgggaatcggttgccgttcaagttcttatgctcaatcatacacatgacatctagtcattttgactccaaaacactaaccaagcttcttattgcttctaaatattttcatggtgtagccgaattccgtatgagtctttggctttgtatcttctaacaaggaaacaatactttatcttttgggaaccgactacgattctagttcttatactcaatcatacacatgacatctagtacactatccaagctttgactctaaaacactatccaagctttttcttgcttgtcaaagctttgttggtgttgccaaagtcagtatgagtctttggatttgtatcttcaaacaaggaaacactactttggcttttgggaaccagttgcgtttctagttcttatactcaatcatacacatgacaagtagtcgtatgtggcttcaaaacactaaccaagcttcttcttgcttttcaaagctttgatgctgaagctgtagtccgtatgagtctttggtttgtatcatgtaacaaggaaatatacttaggttttcaagaactagttgcggttctagttcttatacgcaatcatacacatgacatctagttgtatttgaatcctaaacactaaggtggtgttattcaattatggagttaaagtcaattcttaaagctttagacttgttttctgatattgcttttaagaatatgtttgtatgaattttaaaatctctgcaatatgtcttggattttgattctagtgatttactcatgaaactccaaagaggtttcatttcaaatgaattaatatacaaagattttacaagtcttttagtttttaataacgctggattttaatgaaatatttaaaatcttaattgaataacatcaaactttaaaatctattaagcatgatttacaaagatgagttccaataacactaaattttaaagttggatatagaatcattagttgaataacagtggattcggcttggatttcaattctattaaaatccattaacgaataacaccccctaaacaagcttcttctagcttctcaaagttttgatggtgtagccgaagtccgtatgagtctttggctttgtatcttctaataaggaaacactattttagcttttgggaaccggttgcggttatagttcttatactcaatcatacacatgacatatagtcatatttgaatccaaaacacttaccaaatttcttattgcttctcaaagttttgatggtgtagccgaaattcgtatgagtctctagctttgtatcttctaacaaggaaacactactttagcttttggcaaccggttgcggttctagttcttatactcaatcatacacatgacatctagtcatatttgactccaaaaaaataaccaagcttcttattgcttctcaaaacattaatggcttagccaaagtccgtatgagtttttagctttgtatcttctaacaaggaaacattaatttagcttttgggaattagttgcggttctagttcttatactcaatcatacacatgacatctagccatatttgattccgaaaaactaaccaagcttcttattgcctcacaaagctttgatggtgtagccgaagtcggtatgagtctttggctttgtatctacaaacaagaaacattactttagcttttgggaatcggttgcggttctagttcttatactcaatgatacacatgatatcctgtaatatttcactctaaaatactaaccaagcttcttattgcttctcaaaattttgatggtgtacacgaagtccgtatgagtctttggctttgtatcttctaacaaggaaacataactttagctattgggaatcggttgccattctagttcttatactcaatcatacacatgacatctagtcatatttgactccaaaacactaaccaagcttcttcttgcttctcaaaattttcatggtgtagccgaagtccgtatgagtctttggctttgtatcttctaacaaggaaacactacttttgcttttgggaaccagttgcggttctagtttttatactcaatactacacatgacatatagtcttttttgactccaaaacactaaccaaacttcttgttgcttcttaaagctttgatggtgtagccaaagtctgtatgaatttttggctttgtatcttctagaagggaaacacaactttagcttttgggaatcagttgtggttctagttcttatacttaatcaaacacataacatctagtcatatttgactccaaaaaactaacgaagcttcttattgcctcacaaagttttgatggtgtagccgaagtccgtatgagtctttgactttgtatcttcaaacaaggaaatattactttaggttttgggaaacggttgcggttctagttcttatactcaatcatacacatgacatctagtcatatttgactccaaaaaactaaccaagcttcttattacctcacaaagctttgatggtgtagccgatgtccgtatgagcctttggttttgtatcttcaaacaaggaaacattactttagcttttgggaattggttacggttctagttcttatactcaatgatacacatgacatcctgtaatatttgactctaaaatactaaccaagcttcttattgcttctcaaaattttgatggtgtatccgaagtccgtatgagtctttggctttgtatcttctaacaaggaaacataactttagctattggcaatcggttgccgttctagttcttatactcaatcatacacatgacatctagtcatatttgactccaaaacactaaccaagcttcttattgcttctcaaaattttcatggtgtacccaaagtctgtttgagtctttggctttgtatgttctaacaaggaaacactacttttgcttttgggaactggttgcggttctagttcttatactcaatactacacatgacatatacttttatttgactccaaaatactaaccaaacttcttgttgcttcttaaagctttgatggtgtagcagaagtctgtatgagtttttggctttttatcttcaagaagtgaaacactattttagcttttgggaagatgttgcggttctagttcttatgctcaatcaaacacataacatattgtcttatttgactccaaaatactaagcaagcttcttattgcttctcaaagctttgatggtgtagccgaagtccgtatgagtctttggctttgtatcttctaacaaggaaacactactttagcccttgggaaccagttgcggttttagttcttatactcaatcatccacattacatctagtcatatttgactccaaaaagctgacatagcttcttattgcttctcaaagctttgatggtgtagctgaagtccttatgattctctggctttgtatcttctaacaaggaaacactactttagcttttgggaaacggttgcggttctagttcttatactcaatcatacacatgacatctagtcatatttgactccaaaacattaaccaagcttcttattgcttctcagaacttggatggcttagccgaagtccgtatgagtttttagatttgtatcttctaacaaagaaacattactttagtttttaggaatcagttgcggttctagttcttatactcaatcgtacacatgacatctagtcatatttgactccgaaaaactaaccaagcttcctattgcgtcacaaagctttgatggtgtagccgaagtccgtatgagtctttggctttgtatctttgaacaaggaaacattactttagcttttgggaatcggttgcggttctaattcttatagtcaatgatacacataacatcctgtaatatttgactttaaaatactaaccaatcttcttattgcttctcaaaattttgatggtgtatccgaagtctgtatgagtttttggctttgtatcttctaatagggaaacataactttagcaattgggaatcggttgccgttctagttcttatactcaatcatacacatgacatctagtcatatttgattccaaaacactaaccaagcttcttattgcttctcaaaactttcatggtgtagccgaagtccgtatgagtctttggctttgtatcttctgacaaggaaacactacttttgcttttgggaaccggttgcggttctagttcttatactcaatactacacatgacatatagtcttatttgactccaaaatactaaccaaacttcttgttgcttcttaaagctttgatggtgtagcagaagtctgtatgagtttttggctttttatcttcaagaagtgaaacactattttagcttttgggaagatgttgcggttatagttcttatgctcaatcaaacacataacatattgtcttatttgactccagaatactaagcaagcttcttattgcttctcaaagctttgatggtgtagccgaagtctgtatgagtctttggctttgtatcttctaacactactttagcccttgggaaccagttgcggttttagttcttatactcaatcatccacatgacatctagtcatatttgactccaaaaagctgacatagcttcttattgcttctcaaagctttgatggtgtggctgaagtccatatgattcttttgctttgtatcttctaagaaggaaacactactttagcttttggaaaatgggttcgattctagttcttatactcaatcatacacatgacatctagtcatatttgactccaaaacactcaccaaacttcttattgcttctcaaagctttgatggtgtagctgaagtccttatgattctttggctttgtatcttctaacaaggaaacactactttagcttttgggaaacggttgcgattctagttcttatactcaatcatacacatgacatctagtcatatttgactccgaaaaactaaccaagcttcttatagcctcacaaagctttgatggtgtagccaaagtccgtatgagtctttggctttgtatcttccaacaaggaaacattactttagcttttgggaatcggttgaggttctatttcttatactcaatgatacatatgacatcctgtaatatttgactccaaaatactaaccaagcttcttattgcttctcaaaatgttgatggtgtatccgaagtccgtatgagtctttggctttgtatcttctaacaagaaaacataactttagctattgggaatcggttgccgttctaattcttatactcaatcatacacatgacatctagtcatatttgactccaaaaaactaaccaagcttcttattgccttacaaagctttgatggtgtagccgatgtccgtatgactctttggttttgtatcttcaaacaaggaaacattactttagcttttgggaattggttgcggttctagttcttatactcaatgatacacatgacatcctgtaatatttgactctaaaatactaaccaagcttcttattgcttctcaaaattttgatggtgtatccgaagtccgtatgagtttttggctttgtatcttctaacagggaaacataactttagctattgggaatcggttgccgttctagttcttatactcaatcatacacattacatctagtcatatttgattccaaaacactaaccaagcttcttattgcttctcaaaactttcatggtgtagccgaagtccgtatgagtctttggctttgtatcttttgacaaggaaacactacttttgcttttgggaaccggttgcggttctagttcttatactcaatactacacatgacatatagtcttatttgactccaaattactaaccaaacttcttgttgcttcttaaagctttgatggtgtagtagatgtctctatgagtttttggctttctatcctctagaagtgaaacactattttagcttttgggaagatgttgcggttctagttcttatgctcaatcaaacacataacatcttgtcttatttgactccaaaatactaagcaagcttcttattacttctcaaagctttgatggtgtagccgaagtccgtatgagtctttggctttgtatcttgtaacaaggaaacactactttagcctttggaaaccggttgcggttctagttcttatactcaatcatccacatgacatctagtcatatttgactccaaaaaactaaccaagcttcctattgcctcacaaagctttgattgtgtagccaaagtctgtatgagtctttggctttgttcttcaaacaaggaaacattactttagcttttgggaatcggttgcggttctagttcttatactcaatcatacacatgacatctagtcgtatttgactccaaaacactaaccaagcttcttattgcttctcaaaattttcatggtgtaggcgaagaccgtatgagcctttggctttgtttcttctaacaaggaaacactactttaccttttgggaaccagttgcggttctagttcttatactcaatactacacatgacatatagtctttttttgaatccaaaacactaaccaaacttcttgttgcttcttaaagctttgattgtgtacccaaagtccgtatgaggtttttgttttgtatcttctagaagggaaacattactttagcttttggaaaaatgttgcggttctagttcttatactcaatcaaacacataacatcttgtcttatttgactccaaaatactaaccaagcttcttattgcttctcaaaactttgatggtgtagccgaagtccgtatgagtctttggctttaaatcttctaacaaggaaacattactttagctttcgggaaccggttgcggttctagttcttatacttaatcatccacatgacatctagtcatatttgactccaaaaaactaacaaagcttcttattgcttctcaaagctttgatggtgtagctgaattccatatgattctttggctttgtaacttctaacaaggaaacactactttagcttttgggaaacgattgcggttctagttcttatactcaatcatacacatgacatttagtcatatttgactccaaaaaaataaccaaacttcttattgcttctcaaaacattattggcttagccgaagtccgtatgagtttttagctttgtatcttctaacaaggaaacattaatttagcttttgggaattagttgcggttctagttcttatactcaatcatacacatgacatctagccatatttgattccgaaaaactaaccaagcttcttattgcctcacaaagctttgatggtgtagccgaagtcggtatgagtctttggctttgtatctacaaacaagaaacattactttagcttttgggaatcggttgcggttctagttcttatactcaatgatacacatgatatcctgtaatatttcactctaaagtactaaccaagcttcttattgattctcaaaattttgatggtgtacacgaagtccgtatgagtctttggctttgtatcttctaacaaggaaacataactttagctattgggaatcggttgccattctagttcttatactcaatcatacacatgacatctagtcatatttgactccaaaacactaaccaagcttcttattgcttctcaaaattttcatggtgtagccgaagtccgtatgtgtctttggctttgtatcttctaacaaggaaacactaaatttgcttttgggaaccagttgcggttctagttttaatactcaatactacacatgacatatagtcttttttgactccaaaacactaacgaaacttcttgttgcttcttaaagctttgatggtgtagccaaagtccgtatgagtttttggctttgtatcttctagaagggaaacacaactttagcttttgggaagatgttgcggttctagttcttatactcaatcaaacacataacatcttgtcatatttgactccaaaaaactaacaaagcttcttattgcttctcaaagctttgatggtgtagctgaattc

(The sequence listing continues in the following parts.)

What is claimed is:

1. A method of preparing a transgenic plant cell comprising contacting a starting plant cell with a recombinant DNA construct comprising a plant centromere, whereby said starting plant cell is transformed with said recombinant DNA construct, wherein the plant centromere is an *Arabidopsis thaliana* centromere, and wherein said starting plant cell is an *Arabidopsis thaliana* cell.

2. A transgenic plant comprising a minichromosome vector, wherein said vector comprises a plant centromere and a telomere sequence and wherein said minichromosome vector comprises a nucleic acid sequence consisting of SEQ ID NO:4.

3. The transgenic plant of claim 1, further defined as a dicotyledonous plant.

4. The transgenic plant of claim 2, wherein said dicotyledonous plant is selected from the group consisting of tobacco, tomato, potato, sugar beet, pea, carrot, cauliflower, broccoli, soybean, canola, sunflower, alfalfa, cotton and Arabidopsis.

5. The transgenic plant of claim 2, wherein the dicotyledonous plant is *Arabidopsis thaliana*.

* * * * *

UNITED STATES PATENT AND TRADEMARK OFFICE
CERTIFICATE OF CORRECTION

PATENT NO. : 6,972,197 B1 Page 1 of 1
APPLICATION NO. : 09/531120
DATED : December 6, 2005
INVENTOR(S) : Daphne Preuss et al.

It is certified that error appears in the above-identified patent and that said Letters Patent is hereby corrected as shown below:

Cover Page,

Item (75), cancel "Gregory Copenhaver" and insert --Gregory P. Copenhaver--.

Signed and Sealed this

Twenty-first Day of November, 2006

JON W. DUDAS
*Director of the United States Patent and Trademark Office*

UNITED STATES PATENT AND TRADEMARK OFFICE
CERTIFICATE OF CORRECTION

| | |
|---|---|
| PATENT NO. | : 6,972,197 B1 |
| APPLICATION NO. | : 09/531120 |
| DATED | : December 6, 2005 |
| INVENTOR(S) | : Daphne Preuss et al. |

It is certified that error appears in the above-identified patent and that said Letters Patent is hereby corrected as shown below:

At column 100, line 14, in claim 3, replace "The transgenic plant of claim 1" with --The transgenic plant of claim 2--.

At column 100, line 22, in claim 5, replace "The transgenic plant of claim 2" with --The transgenic plant of claim 3--.

Signed and Sealed this

Twentieth Day of November, 2007

JON W. DUDAS
*Director of the United States Patent and Trademark Office*